United States Patent 10,174,376 (METHODS AND COMPOSITIONS FOR DIAGNOSING, PROGNOSING, AND TREATING ENDOMETRIOSIS) - sequence listing, part 2

SEQ ID NO: 38 - DNA, 413966 bp, Homo sapiens
  misc_feature (285173)..(335172): n is a, c, g, or t
acatgttacttcctattcccataaaccctccactgtaggattaacacctaagacaccaaccaagacacaaaccaatacaaaaaaagatatgacccttggcgtacagtctgtttttgaaactccagaaagtcaggggaaagcgcgaacgcagtcccccactaccacaaattatgcagtcgagtttcccacatttggggaaatcgcaggggtcagcacatccggagtgcaatggataagcctcgccctgggaaaaccaccttcgtgatcatggtatctcccctgccaggtaagtatgaaacgttgtgcctctgccccgacacagcctcatacgcctcactctttacacacacggtcacttgccccgcgcactcccgagccctttccagccctgacacacagctgggattctcacttccgatcagcggtcctgaacccgctcccagggcacgggaactcccttcgtggcgaagcagcaagtggcgaagcagcagcctctgcgctgcctcatctacatagaagtcgccctgtccgtgatgtcaccgacagtgccttgcccagtccccgtctgcctttctgccactcaaccgaccaatctgctgccagagtcgccaagaggaagtgacgtctgcctctccctttttccctcccgcccctgcgtctgttctctcccaaagaagctggtccttagcctgtgttaaggagcaatctttcggtggccagatggagccggggcatccttcttcaaataatggcttttaattcgcagactagaatgtttcggattacaaaagaaaccggttctcttcacatccttatccttgtgatgcagcattccgcttgcatttggaagccgtttaatatcagagagaagccatatttatgaaagtaaagaggctgctcagatgactgcaaaccagccttccttactggttttatcactggtaatgttataaagacagttgtccagtttcatgaatcttgtaggttttttttttttgatgttgtttttttttcaaaaatccgtattgtagaaaaatatgctgtcccagaagagatgattggacactctcaagcgtggtgctggactttgtcatctcttgcacagccatctccacaccttagtgcttacctcatgttagttttttatattctgcaaagacgaaaccaaaataatccaaatttgacacaaatacctgggctacatcttatttgagatgtttaacaaatgtctggatcatcttttcttatatattacgcaggaaacactgtgaagtaagcaaagttggaatgcccaagtgaaagaccatttgaatatttacaagtagatttcagacaggaatactacagggtggtcacaggataacaaattctaggcagcagatttacatgacttgaggctgtgggctgttaagacgctgaaaaaccagggtgtggaccaagctggctaaggctgagtggacccaacgtggtgctggattggatggaggttttacctaggccctcattatatgctcattaacatactaaatcacacacccgccagtgccatgacagttctgagaccagtgtttgatgtaaaaatggcaccacagttccaagaaatctccacctttacccaggaattttcgtgaacattccactccttggttaaagaaacccatcaagatgaaaccccagaacccattattctctcttgggtatgcccaagctcccctttcttgagagtgtactttttgctttgcaataaatctcttctttcactatctgctgactcatctttgactttgttctcgcgatggtgtcaagagcctggacaccacggctggggtcgagatcccaccagtgtccagggacctcccccagcccaccagtatcagattctattccattgctcaaatcacaaaacatcgagtggagagttctctttggagaccgtaaagtaaagattctgtggcatggtggccagttaggccactggaagcatggcaaaatattgaaaatgagggattgggtgacagtgtagtaactgctgaatactaaatacttgatccaggccccattccctggagattgacagggagacacattgtccaggtagtagtggagaaatgctttctgggtatctgaccagcctttgtggaaagaactggcaccatcctgcagatgtaaccacctgatgggttcttcctgaccaatgtacacaaaaattcaattcatggagaccatggcactgcaggaaagagtttcattgacacaggccagccacgacatgtgggagacagagttattactcaaagcaatctcactgaaggcttggaggtaaggggtttttcaaagatagtttggtggggagggggctagggcttgcgtggtgctgattgttggggatgaaatcacaggggtgtggaaaatggccctcctgcatggagtcagcttctgggtgggggctaagggactggttgattttcgggccagatggtgccttccagcagtcagaaatgcaaaagcctgaaaagacatctcaagaggccaatcttaggttctacaatagtgatgttcttcacagcagtaattggggaagctgccaatcttgtgacttctggaataatggctggtaattatttaacgaggcatacatcttagtagaaatcaggcccctttcatccttctaacttggtggcctttcattcattttacaggggtaatttagttttggggaaggttatcatttaaagcagcctttttggctgtcctcaacctttttgtcaccagggactggtttcatggaagacaatttttccatggaagggggtggtggatggtttccagatgaaactgttccacctcaggtcatcaggcatcagttacagtctcataaggagtgcgcaatctggatcactcacatgagcagttcccaatagggtccgagctctgacgagcagctaatgctcatgctgatctgacaagaggcagagctcaggtggtaatgctcgaaagcctgcagctcacctcctgctgttcagctgggttcctaacaggccatggaccagtacctgtcttatggccctggggattggggagtcctgatttaaactataaactctatttttcccaaagatagcttgggagaaattgcacaggaatgagcaaagacagcaagcctgtgaggctagaaccaagatggagtcagccatgtcagctttctcttgttgtcataattttgcaaaggtagtttctgaggggctgcactggacacttcttaaaaacatgagacagatgttattgtatttactacagtaggcaagagagaccagcagagaactgggctcaacctcgaatacagcaggaggagttgaagattatagccaattggcaagataagaaagtcagtggatggaaaattactaagaggaacttgattagctatcaaaggtggttgcgaggactcttgctaaactagactcaacagtattctttcctaaaactggacttggcaggcaaagaaataacagagaaaagggctcagaggaaactactaaggtttggtcaaagactagagtccttgtcaactctacattgaagcttctgcaaataaacaaagaccaaccaaatgaaaaaaagcaaaagctatttattctgagcttgctatagcagggagtcagtcactgttatttgtgttttggcagagacttgaaggcagtcataaaggtgggaaagctttttaaaaagaaaggcttcaggggccgggcacggtggctcacacacataatctcagcacttcgggaggcccaggtgggtggtcacgaggtcaggagatcaaaccatcctgactaacatggtgaaaccccatctctactaaaaaatttacaaacaattagccaggtgtggtggcaggcaccagtagtcccagctactctggaggctgaggcaggagaatggcatgaacctgggaggcgaatcttgcagtgagccaagattacaccactgcactctagcctgggtgacagagcgagactgtgtctcaaacaaacacacaaacaaacaaacaaacaaaaaaacaaagaaaagcttcaggtatgcttggattggaggctgtcagcatggtgaagctgttgatagatgaagaaaatcaaagtattttaccccagaatatatttctttggcatattttaagatggctgtcagagagccagcaaacagaaggaactctgcaaaactgtcttttgtaggggaaatttacacctgcagagaatctgcattaatccagctttatcttgtcaggtttgagaaataaaaataagccctaggccctacaaccaactgaatggactccctcttggctgacaggaccacagagaaacttcgaaagcagtttctggatgtggcaggctaggaggttggacatgccacctcaaaaccctcccctcactaactgccattatgatgcaggagaacagcagagggaattggaagttggataaaaggcagagtgagtgaaagcagagaaagaagcaaggtgatggggtgggagagcaagaagcaagatataaggcagaagttgagcagccaaaacaaaaagtaagatttaaaaaagcaagcaaggctgggcacggtggctcatgcctgtaatcccagcactttgggaggccaaggcaggcagatcacctgaggtcaggagtttgagaccagcctggccaacatggcgaaaccccatctctactaaaaatacaaaaaattagctgggcgtggtggtgcactcctgtactcccagctacttgggaggctgagacaggagcatcgcttgaacccgggaggcagaggttgcagtgagccgagattgcaccactacactccagactgtgcaacagagcgagactctgtctcaaaaaaaaaaaaaaaaaagaaaagcaagccaggaccccatggccggtgagatccaaaccagtaaaggggcagctcctcagagataggcatgtgcattagagaaaaaaagtatccttaacatgactccatatgataatcagctcattaaaactcatgcatatggactgcacatcatgcatgtacttaaaattatgggatggaggcaatgtgcaagcacacaagggccaaagtaactaagcaacccacctatcaatcaaaaggcaaacactggctaacgattaggcatccttgggaagagaagagaaagaaacacacataaaaagacccaacgtacaccaaactaatactgatctcacatcccagagatcagcccactctccccactctgagactgttactgtgcttaataaattttgctttgctttgctgctttgtgtgtgtcatgtacagttctttgtttgggacaccaagagcctggaaatgcacggcaccatctggcaagaattaggattttttttcctaagggttaacaatccaagcctttggagagacttgcttcactgctgttatcaaccaacagcctgatgctttccctcccttttgtggttttgacaaaacaagcaagcagcattccctcctgataagagaccaccgacctaggaatcattctggccagactacagaggatgtacagtgagggttttcatgtccattgcctcagattttgacgtcagagggccacaaactccactctcagatgattgctaacgccaccattttatgaacatgagccccatggagaggcacgcagctcaactgcacatctgcacatttttcctcttataaacattcatattggaatattatttggtactgctcccgtgaaagatacatttgcagaatggactcagattagaagcattatacaagcactataatgtagcaatggcacatccagctctctacactatagaaatgtctgcagggtaaacatttccacaatgaccaaagatatctgtacaggactggtgactgcagcattctttgtaatcctaaaactatgaaactaaagtcatctcaaaaacattttgtttttttgagatggagtctcgctctgatacccaggcagtgcagcggtgtgatctcagctcactgcagcctccacctcccaagttcaaacgattttcctgcctcagcctcccgagtagctgggattacaggtgcatgccaccatacctggctaacaaaaacattttgaaaagggttaaataaatcatgcataaactgaggaaaaatactattttcaaaaatgatggagagaatcactttcatgatgaatgattccactggtcacattattgatagagcaatcaggaaacccaggcacatcctggaggtaatactggactcctattactaaaatatgaaaaaatggagacacgtaaatactcgtttaagcgtataacggactgaattagaattttatcacatcagaagtgggttcctaggtctctgtttcaggattccttagtgacacaggtgtaaacccggcatttcaggagatagccggctaagaatctggtcggggaggtgggcggcccttgacatggatctgtcataaattagtggcttgagactttgggaagataaaatcttccccatttatctagtgattgacattgcgtgaatgcttcaaaagttccaataagcgtccctgggtgggctcgaaccaccaacctttcagttaacagccgaacgcgctaaccgattgcgccacagagacaagcgcttccaactctactgggcatctaggaagggcgcactcactgaacttcctccgttccgtctattctcagggcccaccgggcaggaccactgagcaaggccttggaaaaccagagagattagagcggtgagtcgcgccggtcacgttggacgcctgcgtgttaggagattctggagccagaagaacagcagaattgccttcgcccgccctgcccctcgcctgctgcagaagcttccagaaactccctggtgggcgacccagcccgagctgcctggggccccaagggaagctgaacgccctgtgggctcctgggatggttcttcccgttctttgcgccgccttcacccattgaaggagcctgtgcccaccctgcccagtcgctttccgggccgctgaggagcttccgctgccatcttcggatcctgtgttccgcacgggggctccaccagggcagggatggtggtgagggtcgctcgtgggtcccctcgcggggagcagggtctggtactcaccagggcgcacgactaggacttgtggaatgaattcatcgtcgcctttagcttttagtcctttgaagagccctgagagtggaaatcaagagattttttccacggggaagttctttttacaaagcgttgatttctcggcacccggcagggagggcaactggcagggtctctggcgcaccttctgcgcggtggagccacgggggctcagctgggcggtggtgcggccgtggggtggtaggtcaagagctgggaaaggaaaaagcaaaagctgggaaagaagccggggagcggtggaccagacatccagacctcctgaaaggctcatgaaggggcacaggcaggatcttctggaagtgagaattgttttgtttgtttgtttgtttattgtagtagaatggggaaatggagagagaacctgaaagagccccaaactcgaggacctattgctccccaagaataacatcttccagaagaactagacagaaaactaggcgtctgggaactctgaaatccttggaggagtagcatcatcatgaccctctgtgttccttttggcaaaggacttgctcccattgtttgcttgttcaattgtctgtccgttaaataaataaaacccttttcctatatctttaaaattacgttggttttatcattttatgattacaagtaatgctgcagtcatcattcttgtacactctcattggccactggtgtatttctatagggtggaggcctggagagtagttgttccagcatagtgtttacatagcttttatttcattccgttttctttcctttgttgctttattagctataaccgttttcttatttcagaggctgctttagggtttccggaatacatctttaatttatcatagtctgctttctagtgtcattatgcctccctttctggcctttatcctagtgttatgtatctttactttatgcactataacctttgtgattcattattattacttttatttgttacgtcaaatattttttgaaagatttaaattataagaaaacgtgtagtacatgctttctaaatgccatttccaatattcgtttctttgtgtaggaccacatttttatctggtatccttttgcttctgcctggaggacgcaagatttcttgtagcgtgggttggtgaattcttttagcttccgtatgtttttcaatgttcttatttcactcacagttttgaaattttatttttgcatagaattctaggttaactttttttctctaggtactttaaaaatgttgccatttatgaagcattgtcatttaaaatatcatctttctttcctatgtttgtaaatatggcgtaaagccggtttcttgtgctggttatacaattttcagaatgtgtatttaaatttaaaatattaaattgtactaaaaaactaaaaatattaatcatgaatgtcctagattcatcttaagttccaacagtgcacttaaaatgtgcccaacctgagggtcaaacctacctgctgatgtggaatttgtgtttgtgagacattctcaacagcatttgctttccccagcctagtgattttcctcacatctgaatgtcttcattgcaaaaggaaacgtttttctttgcaaaaatactttaaaatattcttacttcaagtaggtgtactaaaaacaaatttctcagttgcatccctgaaatccatcgaaagcccgggagagacaatcaagtgcttcaggaccaagagtgaaacaggagaggacaaagcagggcttcttcactaggagtcaagccaaagtcaactgatttggtctccaatggagaacggaactcggttcaccagcaacgtgaggacgtggcccagaggagacggagtttcccttcatggtgccttcagataggaaatctaggattttctttctttccctttgatctacttccaactctccctttctgtttcttcaagatctttttcggatccctgggtgcgaaggacataaggggccagtggccttccctactggtccctccttgactgggtgtctttggagcccaagctcacccggaacattactgcccgctgcagacagtgagaggacaaaggagggcggtgggtgcagtgggaaccacagagtcaccgtgcacctgcgcccgtgggctcctagcaaattgaataaatgccccctgaagcttctctgcaggtcagagggaaggggagggtggctgccgacctggcgggagaagcttcaagaaacatcgggaggacttggccctgcccctgggccttgaagacaggcctggccaggctgattttgatgggtaggcccaaagaaaaggttcgagggcagcccaaaccccgaccctgagattaaggctcttaagtgtctgacagttttgagaatcgtcagtagaatcgatcctgcctgtatcaggagacttctttgccaaaattcagagaccaagaaagagaaagattgggcagatcaaaatctgtcattaaccaaacaggaaacataagttttctgacaaattgaatgtgtgctgtgagaaaaagactagcctcaaggagaacctggttttttggcttgagtgtagggaagaatggagttgccaccaacaatggtgcgttgaaacggcaggtgcatcaggctgtagatgtgaaggaattaaaaatattttaccccaaactacatttctttgacatattttgagatgtctgttcagaaagccagctgcagaagtagccctgcaaagttgtcttttgttggggagatttgcatctgtagggaatctgcattgatacagccaagtctttccttgtccagatctaggaaagatgaactgagagtctgacacctgtaaaggtctgaaagaaacttttagggtttattctctctgagagctgctacctgtaaggtttcatttacatattaagaccacctttgctagccgagcctcattttctctccctgccatcacttatcttgtccacaataaatggatatacctctgactctgattgcacctggttttggccatgctttgagccctcattcattctgttatctcgagatggtatataagcttctgcatcccattgtgggtaggggagggtaatcactctgtgactctccccatgcacatgttagtacattttatgccttttctccaattaatctgccttttgtgacttgatttttgagtgaaacttcagagagttaagagggagggtttccattggcccctacagttttggagctgtaaacaggataggaaagctctgctcttctggaagctgcagtgaagaacccaggatatgatcagctatcataagggtaagaatttttttaccagccaggctcctggcctccttctctgtgtggaatctcatcaagtggatggtaaaaatcactgtttctttcttttccctctccaaaatcttgattaattggagaaaaggatttgtgtgactagtcttgggtgtagtgactctggtgtgctttttggtactttgtggtaccaattcctattgtttaatccctttcttcccagaaattgtctgttcctttgtctttgtctctatgtgttattctgtcataaaagggggtactggttgaggttccttctcatcttattttatgtccttgagagcttgacttgtgaccaagtggaagcgctttctcttggtttccactatctggaaagaggcggtaactttcaggtcatactaggtggcctgtctgaaaatggctgggaaccccagcacactttttgttctgaccatgacaagctcttggggtttgtcttaagaagtcccatccctttgaggcttttgtcatctcaattcttgttgcctggttagttctaggaaagctcaatcccaagatggcctacctggtatcatggattcacaggtctgtgactggaagtccccataaatttgtgggttgctggaggcaaacatcatccttacccatctgtggtctactctactaaaaatacaaaaattagccaggtgtgatggcatgcgcctataggcccagctactcgggaggctgaggcaggagagtcatttgaacccaggaggcggaggttgcagtgagccaagattgtgccactgcacactagcctgggtgacagagcaagactctatctcaaaaaaaaaaaaaaaagaaagaaagaaaagatttaagagaacaattattttaattgaatacattttgtcaagattaactcaactttcccctagagtagtgaaagaataagcaatcgtaatttagattctaagttactggtctttgagaaagtgtgaaaaccaaaaaggtgccataagtcaaaaagagcaaaagtcctaattttcaaactgatgaaaataaagtactaaaaaattgaaatcatcatagttcatcttggtccttggcaaaatacaaatgtattgattcaaattataatatcttagctaccctattgtgcgtagctcttaccactgaggagaaaaaccaaacccaaacaaaagtgtgttcaagttggcaacaatgtttacaaacctgcaaaatctcttcagcctatcccttaaactccagacttggtatttactaagctctgtggtgtacaatacccaccttaatatccattcttgcacaagttctgttaggtataagccaagatgacatgagatttttttttttttttttttttttttaccctctcatgcctatgtttgcttttgcttccacagacccttctgagtaaggactatcctcagactactggaggcacttagtcacaagcttgcctgaggctcagagctggcaatacctgggagtttatgtcaatcccacagcacccagcaaccctgcctgcaaaatatttacccatgattgacaggtgcaggtgtatgaaagcccagctccttgacttgaggggcacctttgtggtgaattaggtttggcaaaagggaatccagaggccaactttgtaaaaatgcagatagataaatagaaagaaatctttgccttggaagtccagttgagaaagagagtgatttacttgagactctgaaaacagagactaaaatctgtactttttcatgggaaagaagcctatggtgaaagagaaacaaagagaaaggtaggaaatagggtgggtctactccgtagctttaaaccactctgtcatattataaagcccggtgaggttttaactaacacaagtgtctggactctacacatagagattctgatttaaacgcttccaggtgggtggaagccactagtagtcttaaaacactcccaagtaattttaccatgtggctagagatgaaaaggacaatctatctactagaatctcaagtaaccattattgaagtgccccaaatgtgcagctacctcatagaaaaggcttaacaccaccctttgatggaatttcccttcctctctccatggtcttgtctgcatagcatggaaaatagagaagagataaagaggtagatggagaggttgaacctgtaatttgcctatgtagagcagtttctcaaacttttctgaccacaagatgcagtgagaaatatacaattctttgtgatcagttttttttttttttttttttttttttgagatggagtcttgctccgttgcccaggctggagtgcattggaatgatctcggctcactacaagccccaccctcctgggttcacaccattctcctgccttagcgtcctgagtaggtgggactacaggcacccaccaccatgcccagctaatttttttttttttttgtatttttattagagacggggtttcaccgtgttagccaggatggtctcaatctcctgacctcgtgatccacccgcctcggcctcccaaagtgctgggattacaggcgtgagccactgcgcctggcctgtgatcagtttttaaaaaatcttttactatgtgtaatccaccctacctagaatttaaataaagcctgcagtagtaagcagtcgactatattgatttcacaacccctaagtggttcagaattgcaattagaaaatttttccttttggccaggtgtggtggctggagcctgtaatcccagcactttgggaggatcacttgaggtcgggagtttgagaccagcctgaccaagatggaggaaccccgtctctactaaaaaaaaaaaaaaaaaaaaattagctgggcgtggtggtgcatgcctgtaatcacacctacttgggaggctgaggcaggagaattgcttgaaccccaggggctggaggttgtggtgagctgagattgcaccattgcactccagcctgggaaacaagagtgaaactgtctaaaaaaaaaaaagaaaataaataaatttttacttttgctctgcctttttatcaagcaaaatcccaaaagaacatttactataaacatctttctgtgaatccttatttctgtcccagccaccatgacccaataatctctagagcctgttagtgttctccagattgaagccttccctctaactgctcctaaactctgtgatgtagtggaaaagttttgaggcctcgattctcatcccaggtttttcacctacagatcatacggccttagcctcttgacaccattgtctccttatggccaaagatggaactgtacttgggtggtatctgagcaccctgttggctttgacattctagggctcttcccttggcaccactctcttatttaaaaggaacaggatgtggacttaggagggttatttctctgcaaactatcctctctttcttatgacaagctatttctgaatgtgcacatttgaggctaagcaaattccttcctgggaggttgaaagacccttatttctctccagaggagtattatggagagtcaattgatgctgaggaggtggtagagacctagtgaactcatctgcagtggctttgagcaaggcttttagaatcataaggtgggtggggtcctgtgtcctacaccacaggccagctagttcatttcaggagacttttttttcaatctattattactatcttcttctagactgtagttcactactggagattatccacttagttacactcagtttgcacctggcctgtatcaccagtcagctctcactccagcctcaggtatcagcaagacctcaccaaagattattgtttaattttgtgtgtgtgtgtttttgtttgtttcgggtaacaactaatgttggaactatgaaaagctcttctctacttttaacaaagcttagtcacaaacagttccccagttgatgagaaaaactaaaacaacagaacaattgaaagtccaaatctgcaagctcatctctgagaaccgaattctacagccactccagatttgtactccaaatggatagtttgattgtagaaatcacatcccttcagtctgccaatgtgataagggcccaagagacagtgatgcctagattcatagataatcccctttcccccatcctatatataactggagtcaacagcagctggaggaaaatggcaagaacttggaatcaagattaggttagaataacactgctgtagacagtttatcagctcttcagcatacgtccgttttccttgaaggatgagcctgtagaaacctctgacaataaagtttattttacacccattcccttgcctatgattttttcatacaaatcacaattataaaactttcttgctccagctaaaagcaggaaactcaatcatgaatgtgttcactaaatatataccacagaatgataacaaccagtctgattgcatcacttgattccaaaattaaatgttagccctcaggggtgcaactacatgtatctccaactctggaagccacaggcaacatattcctgtttccttgcagggaaacagatctataagcagggcggcagtctgacacatgtacattcctgggaaacccaaggaaacaatgatagtgacgcagggcaggcaagcccccaaactgaaagagttttgctaatgtcgcgattggctttctatgttatttgaagactgagatctccatgaggagtgaagataggtaatgcctaaggctgaggcatgacctcactgggtcaccttagctgtaaagtgaggtcagttgtcaccttgcaaaccttttggtaatccaaatcttggaatgatttctttaagaatttagacacttccaatacttttcctgtccttgtggggaaagcttctatccacctggtgaaagtgtctataaatactagcaaatcttgtagtcccctgtaaggtggcatctggtttaagtctgtctgccagtcttcaccatggtatgttccttggtgttgtacaggtttaagcagggatcggggtatggggtggcttcctgagtggtaaccctttttatagtttggaacagtcccttccgcaagaatatttaggaaactaatttaaatggaaaatcctgtcccaaatgtgaggaatcatgaaaatgtttaattatttcccatctgtcagcctcaggaatagagtttgttcttttctagcaaccatccagatgggtctccctggaagccttttactcagtccctttaatttccttaggggtatattatggtgtcactgacacggatggagtacctggtagtagcgcagcagcctgaaataccagggtttccttagctgtggccttagctgctctttccaccagggaatttcctctaataataaaagtgtctcccttctggtgtcccctgcggtgagtaattgttatttctttgggagttggacagcatctaaaagttccaagatctgagtaaagttgtgtgggggatcccttggctcttgatagtcccctttccttccctatggctgcatgagcatggagcaccaggaacccatatttagagtcagtcaacacattgactcttgaggttttgttctttttttttctttttttgaaacggagtcttgctgtgtcgcccaggctggagtgcagtggcatgatctcagctcactgcaatctcagctcactgcaaactcagggattctcatgccccagcctcccaagtagctgggattacaggcgacccccaccacacccagctaatttttgtatttttagtagagacggggtttcgccatgttggctaggccggtatagaactcccaacctcaggtgatccacccaccttggcctcccaaagtgctgggattacaggcgtgagccaccgtgtccagcttaagtcttttcatggttggaaggccctaattagagcagctaattctgctttttgaacagaagtctgagaaggtaaacccttggcctcaaaaacttcttgttggctaagcttcctttcttactccctcatgaatatagctatttccatctctaaaccactcaacatttgggttagacaagagcttgtcttcaaggttgggccttctagagtagagctcttccgtggtttccacacaggagtcaatgagtttgggatctgtttcttgagacgtgaggtgcagcaacagagtagcagggtttaaaaatcaggacactttcagggtaacatctggggtgtcaagcagaagggtctgatatttaagtaactggccccctgttagccattggtgtacttttgcctctaggaccctctgtactgtacttcatggggtggcagggggtgggggtgggggtggggtggtatggcatgtaattgttgtcccaaggtaaacttactggtttcgtctaacgatagagtgatggtagtcacagatctcaagcttcttggtcacctagctgccacctggtctagctgtttagagaaataagccactggtccaaagcaattcctcagcctttgagttagaacattcgaagctgtcccttgttattcatccacatagagggtgaaaggtttttctaagttcgagagtcctgaggcaagggatgtccctggcttttcttttaaggctaagaatgccttttgacaggttccaagctccgcctcctgggttcacaccattcttccgcctcagcctcctgagtagctgggactacaggcgcccgccaccacagccagctaatttttttgtatttttagtagagacggggtttcaccgtgttagccaggatggtctctatctcctgacctcctgatctacccacctcggcctcccaaagtgctgggattacaggcgtgagccaccgcacccggccaacaagtttttttttttaaatgaacagagcatcagtgaatgatagtgcaagtttaagacacctaatagacaagttaaaggagtcctccaggcagaaggaaactgacaccagatgaaaatgtggatgaaaaaaaaaaagacactagaaatgacatctacataggcaaatatataattttaacatctgactgtttagctgggcacgatggctcacgcctggaatcccggcactttgggaggccaaggaaggcggatcacttgaggtcaggagttcgagaccagcctggccaatatggtgaaccttcctctctacgaaaaattcaaaaattagtcatatatggtggcgcaagcctgtaatctctgctactcaggagtctgagtcaggagaatcgctcgaacccggaaagcagaggttgcagtgagccaagactgtgccactgcactccagcctgtccgatagagtaagactcgtcttaaaaacaccaccaccagcaacaaaaaagcaaaaacaaacaaacaaacaaacaaacaaacaaacaaaaacacatctgactcttgaaacaaaagtaatagagatggattgtaaggtttataacaggtgtaaagtaaaatgcatgacaatagcataaaggcagggggaggagtcatgtgaagaggtatgatgccacttgaaggcagactgtgatgggttaatttttgtggaaagcaaggcagaatttttgaagtttgtttcttcaaatactttctgtttcccgtacatacaagctagtttgttctgcagagatctcattttctaggaggctcggagggggaccttctgctgtctgtcctcatgggatgcacaagacacaagggaacagtctttcacttttaaatacattgatgggtctgaggagatagatacaactgcattttttttttaaatgaggtgggattctcattggtcttgaacttctgagctcagtggaggcttcccctacttcagcctttcaaagcgttgggattaataggcatgaggcactgcgcctggtcacaaccaacgtttaaaatcacgtccctgggtggtctgtaaccaccaaccttatggttaacagccgaacgcgctaaccgattgcaccacagagacaacctcaatcgcttgctttcatctctatatagattaagcaatcactaaaccctaggagttgccatttgctttctgcgggacaactgtgcagactacaaagcttcagaaaaccggagaggctgagtcgactaatcgtgttgttgcacgttagaaacgcgtgcattgcgtgactctgaagccagaagggcggccgaatggccttcaccctgcgttcaccctcgcctgcttcagaagccagtgcctctggaaatgcctggatctgcgaccccagcctgagccaagtagggcccaagggaagctgaactccccgacgtctctcatggtagctctttctgttcttttgcgccgccttcaggcaatcatctgttccgcttgctctcccttcactcaactcggcttcagtagatggggtcggtggggcgggagcgggaaagaggcaggggagtcaaaagggaaaacgtgaaaaggaggagggagaagcaggggagaccaggactagacaatgggacagcccaggatgcccgtgcagagggcaccggctggatgcagagaagatgggacatgtatcagatcggagaggaggaaatggggagaagatgtgagagaaaatcacaagaacctgtagctgcccaagaataaagaagtaaaaatcgcataatgtttttacattaataaaaaaaatcgggggaccaggggcggtggctcacgcctgtaatcccagcactttgggaggccgaggtgggtggatcactcacttgaagtcaggagttcgagaccagccgggccaacatggtgtaagctcgtctctaccacaaatacaaaaattagctgggcgtggtggtgcacgtttgtagtctcagctacttaggaggctgaggcaggagaatcgcttgaacctaagaggcggaggtagcagtgagccgagatcgtgccgctgccctccagcctgggcgacaaagcgaaattctgtctctcaaaaaaatatataaataaataatagaggggtggggaagcaaaacgacgggcagtaggtgtggggcgccttgggattctctagtggttagtagtctgcgttgtgcctgcagcaacctctgttctaatccgaatcctggtacagtcagactctatcttggacccactggggcgaacccacgtgtcttttggtttgcttttgattcctgcaccagctgaggcctttatctgcagccagaaagccggaaagcagggtttacccctggccccacagcgccatactgtctggggaaaagaaggaaacccaagagtacacaaacagtggcccaaagagaaaccttccaagtgctctatgcctcaccgtttagcagaaaatatcaagcaactctcaatctagctggtctgtaccttccacgaatgaaataatgtatttattgcagtctttctggttgagatatttcaaatatttggtggagcttttaatgagagagacactctcgagtgtggaagaaaaaaaagaggggatgtgaagataaggcgactttaggacagaaaaaaaaaaagagacaaggaagccatgtaaacgtttttggatgggcgtgaggcgttgtcagtcttgaaccccgttatgtcaggtaaagagcgcagcctcttctaccacaaacaccatttcccacatggaggaaatcacagggatcagcaactctagagtgagatgaagaagcttcactctgggagaacccccttcgtgaccacggtctctcccctgccaggtaaagtggaaatgagcacatggcttgcagggacagcacagcctcctcgccctggccggtcgctcagggtcaccaccctccccactgccgcccctcgccattcttccaaaccactctccaccaaagattccaccgacagtcaccccacaagacaacccaggccgcctctcagcagcggctcccgccccgcagccaccgcgccctctcacccccgcgcggttctgcccgccgcctctgccgagtctgcgcacttcacctccctggctcccgctctcccctgagcttacagtggactcggggttcttccgaacccctcttgggagtactgaatggaaaagggggagcgtgcgcaagtgcttggtagagtgtagacgtcgtgggatttgactgtggtacaatcgcttcgacgtcctagtgctgatttttccacctgccttctgcttagggcaccggcagcagttttccgtctgtgcctactccacctgctgtccttgttgggtcagcgaacatcgcctccctctaccgctcaatcagcaaacgggaccgccctcgaggacctcacccgccgcttacccccctaacaaattcgcgggcatcgcctccggtcgcctcttcccaaggcctaacgagcgccttcgctggcaacggaggtgaggaggctccgctgactggctggtgcccgtgtccggggctgccacaaacgccacgacttggcttggcctctctcttagttattcgcagctcagcccgatgggcgtctccggggtggcgacgggaaagaaggtgggcttattgggtgcagctccacgggggctggcatctctgccgggctgtgtacacctgagcgagaagctcagtcgctctctaaagctgctcccgcggatgacggacacggagacaaataggaacggtgtgtcgtgagaggtggtccacaagcacttgccctccttcgcccggctttaaccccgctgcggagactgttctgcttctggcccttggagcaggccggctgacagcgtagtgaaggaagattcctgcgggagggcggccagtgtaaaacaattccctgaccgggaatcgaacccgggccgcggcggtgaaagcgccgaatcctagccactagaccaccagggacacacaggagggagctttctctcccttcttctgtcagaagcgacagcttccctgagctctgggaggacttgggccttgtgagggtcgctctttgctcctggagtctctcacaaggccattccctccctgctttcttcaaaaaaagagcctgcaagcgacacaccgagggctccgcgagggacaccgaggccacgagtccgaaggcctggagcgagttgcagcgacccggccgcagctcaccactggactagagatgcgcctttgcgaggtggcagcaagtgaccagtcggtcgtgcgtcgccaggtccggagccgcgcaccaggttgccaggaggaggcgggagcgcggaggcgcccggggtgagacgggggcaccctctgcatcataaaggacccagacgccagcaccctcaacgtcataaggaatcagacggatgcggaaaccgagacgggctggatgggaaactctttccaggaaggctccggggccctcagctggtctccgaccttcccctgcaacctgtgacacctgccattttcccatcttaggcgatggcaacgccacccttccgtttgctccgggcaaaacttcgagagttccctctgactctggagttttttcctcagatccaagagccaactggtcatcaattcgtaatttcccatcggctaagtgcgtgggcattgagctacacgcgagtctctccacctctgcggaatggctacttcggggtaggggaggggccctcccgtggattgtaaggtgtttagcagcagccgtcgcctccgctgactagatacatgccagggggttagcattctccctccccgcttcccccattcgtgacctagtgtcccagcgtggaggtgagaggcgtgtaagggcaaagttgccccctcttgagaaccactgatgcgcgttgtcctgctgtctgagcttgtgcagaggactctccagatgaaggctcaggggtcgatccagcttgagaccccctcgctcccccgcacagtcagaccttaggattggaggcttttaacatctctacatcatgagattcgaaacctttaggtcttttcttccgttctgtcctccaaatcggcctcttccgagcctgttgaccagggccagccaggcagacggctgggttcgctcaacgaggctcctctcggccctcctggagcttcaggcctctttcggttgcagagaaactttatgggccacttccttcggcatccccgggggcaggtgcgcggtgcccggggaagaagagggtttgactgcggttctcgacccccggcgaccaacctccaccccggtgggcgcgcttttccaggctcctgctggtcccactggccgggagttaggtctcgggtcagcctgagctccagagatgcccaggcccggaaggacacttaggggaaaccagctgctcactttggtcttgtccgcaacggacctcttgctgccaggaaagaaaggcgtcgagtcctgtcctgttgggtaggcggaagagagatcaaagggaagacaagaaaaatcctgggaggtttcaggatctaaagttaccatgaagtcgacctaacctcctctggaggtcctcccagtcctcccgtggctggcgatggtgaatcgagtttccgtctccagtttgccaaggcggacaaagccgacacaatgggcctgtccactatcttctttcatatacacaaaatgtcagcttttcctgtttctaactggcaacatcccgcctgatgaccagcttagcaaattagagactctccatgggattccatctgtgtcttagttcgggcttctctaacaccgtaccatacataaactgggtggctgattcacaacagaaattgatttctcacagttccggaggttggaagtccgagatcaaggtgccgacatggtaggtttatggtgagggccttttgttctggttgtagactgccacctcctcattgtatcctcagggggcagaaagagggcgagagagctccccgaggtcccttttataagggcattagtcccattcagactaatgggactaaatccagactctgtgctgagtgttgtggattttttgcatgttcatcctccccgcaggcaactggagatgtattgtccccagagggtacaatagagaatcttccgtcacaagtcagcaaccagcatatgtgagtgacagcatgtgttccactcagaaatgagagtgtattagtccgttttcacgccgctgacaaatacataacatagtccaggacgaaaaagaggtttaattggacttacatttccatatgactggggaggcctcagaatcatggcgggaggcaaaaggcacttcttacaaggcagcagcaagagaaaatgaggaagaagccaaagcagaaacccctgataaacccagcagatagtgagacttattcactgtcaggagaatagcacaggaaagacccacccccatgattcaattacctcctcctaggtccctcccacaacacatgggaattctgggagatacaattcaagttgagatttgggtgagggcacggccaaaccatgtcagaaagggatgaagtgacagcatatcctgatgtgtgtgatggttttatgagttattacctatttcaaaaattattgcaatgtgtaaaaaagaacaaggacttgtactatctgactttaaggcttactataagctattacagacaaggcatcaggagtgacaaatagataaacagactgagttaagagacttgaaactgatccacagctatacggtcaataaatgggttttcaataaaagcagttcaataaaagaaaataaatcatttcaattaatggacttttatatggatgtggggagaccaacaatgttattctccctcacactacacacaaaagtaatttcagccgcattacacaccaaaacttaaaagttaaagatataaagcatttcaaggatagtttgtgacttgttggtaggcaaagatcaccctaccaacaagcaggacacaaaaaatacatatataagaaagacatgataaatgagacttcatcaacattagccacaccttctcatcaaaagataccactaagaaagtgaaaaggcaagcaagtcacagacagagagaaaatagccacaaaacgtgtctgacctccacaccctgcagttataattatagtggtctggtacactgcgcccagtttctgctggatggagtattttctgggtgtctctaatgagtaagagagggccccatgggatattccttcagttcccaggtgaacagtgggaaagactccacattgaccaacctcgggggcctaaaaatccaggtcctataggagggtagagtatacctggaccctgacccagacccctggatgggttgtgccaagagacccagcaagggaaaggatttcctcctgcctcaggttctctgtccttctgtggttagacgacctgaacccaactccctccccaagcactggagatggggcttttccaagggctggggatcttgctgtcctgagaacagctgagcaagggggtcgaggaggagcttgggtggtggaggagaggaaaccgggtaagatgcatgaagccgttggctataccaggcacagagaggacccactgggacccaatggcctgcatgtgaagccaggccttgggccacctcgttcctcaaaggggtgctgacttccatggggtgttcaaagggactgtggaaagagaggccttcagcccacacctctgaatgcttttcgaccacagcatgccctgtggcctttatcctgctggtgtggaacagtcagagccctgcagggctgcagagcttctgtactgggcggcatcccagcctgagtgtcagagctcagagagcaggcaccggagcaagtagagaggagggcaccttttggacagaatgtgtgggacaagagcgacggctcatccattcaggttcctcagaaaatgagagtcaggaagatgagggcgcagacctgattccctacacagggctgaaagcagacaaccggaggaagagcagcacctgggccaacgaggtagaagacagaagaccacagtctactcctgccctcaatctcaccccttcccacccacatcctccacgccccctgatcaccttcctcagaagtgtaataggaatccagattccccctggcctggttgctgcgggaggcacagtggcctgatggagcctgaggcaggtgtgggaagatgtggattgtctaactggaggttgggagttcagggtgaggaaggagaagcttggagtgcaggatttggtggtatgtatgtggctgtaggcaaaagaaagagacaactaagccacttgaaataccatgagaattcaaatttagaaaattcccagggaagtatgcatgcaggcactcatgagatccaaaaaacagctgctgcttaactgcgtgttgcaagcaagccctaaattgctgattttgaaacagcctgatgggttcacaaagacaatttctgaatagtcttaagagcagaggtgcactaaagccactgtgccccgcagctcaggatcccagaaagttctttaaggagtaagtcttacttccatttatggaagatttttggagttgtccttagtcacccccaaaaatgttttggttaggagtagaattttagatgtcatcaatttaaaaattaaaactgaaacgctggaactcatagagagataaaattaagagaatccattcacatcctgagtagaaagatttttatagaacatgacgggctttaaaaataaagaaaaaatatggcaaaatttcatcaaattaaatgctttcagaactaagattaaaatctgaagccacccaactagctggacagatggcttctttgccaaggagaccccagagaagtcttaaatactgagttcctggccagtacttggaagctcagacacctctccttatactctctccctttgtggtttagacacaactgaccagcattattgttaaaatagagatcctaagactgacagaacagagtccttacagtagtaagataccatattataaacaagacctaaggccatgccaggcaaggttaagtcatgcacccctcaacttaaagaataaactatgttctaattgccacaggtttttttcttcttcctttttttcctctagctaaacaagcactggccttgagataagcaatgctgaagcacttgcagctcacccattagcataaactgactgagccctccctacacaagccataactacagctttgattggacaagagactgatttcagtaacttccccttgataagagagcactggctgtggacgggttctggacggtttacagaggctgtgcacttgactgcctttgtgtccctacttccccttttgaagcatagggcctaattataatgtatttaaatgtcatctccaccccaaagtgaacatgggttgcatgtaacaggcttgtttactcagcatgcatgcagcaggatcccttcatgaatattcagagctcctcctattccctgttgaatatgcatatgtggcccaccacatcaacataaatccctgttcccccctcccctccctggaaacctacttttcggtttcagcaggagggtatgcctcccagtctgtgggaatggccaccttgcaggctgtaaccatttataaaaaataaaatctcccttctaaatttataaattgtgtgatttttcagttgacagctttcagtcagacttttcactgactgggaaaagtcatttgcaatatatttattttaaaaatgactcctcaggatacaaaattcttgtgcaaagatcacaagcattcttatacaccaataacagacaaacagagagccaaatcatgagggaactcccattcacaattgcttcaaagagaataaaatacctaggaatccaacttacaagggatgtgaaggacctcttcaaggagaactacaaaacactgctcaacaaaataaaagaggatacaaacaaatggaagaacattccatgctcatgggtaggaagaatcaatatcgtgaaaatggtcatactgcccaaggtaatttgtagattccatgccatccccatcaagctaccaatgactttcttcacagaattggaaaaaactactttaaagttcatatggaaccaaaagagagcccgcatcaccaagtcaatcctaagccaaaagaacaaagctggaggcatcacgctacctgacttcaaatgatactacaagtctacagtaaccaaaacagcatggtactggtaccaaaacagagatatagaccaatggaggagaacagagccctcagaaataatgccacacatctacaactatctgatctttgacaaacctgacaaaaacaagaaatggggaaaggattccctatttaataaatggtgctgggaaaactagctagccatatgttgaaagctgaaactggatcccttcattacaccttatacaaaaattaattcaagatggattaaagacttaaatgtcagacctaaaaccataaaaagcctagaagaaaacctaggcaataccattcaggacataggcatgggcaaggacttcatgtctaaaacagcaaaagcaatggcaacaaaagccaaaattgacaaatgggatctaattaaacttaagagcttctgtgcagcaaaagaaactatcatcacagtgaacaggcaacctacagaatgggagaaaatttttgcaatctactcatctgtagattcatcagaatctacaaagaacacaaacaaatttgcaagaaaacaacaaagaaccccatcaacaagtgggcgaaggatatgaacagacacttctcagaagacatttatgcagccaaaagacacatgaaaaaatcctcatcatcagcggccatcagggaaatgcaaatcaaaaccacaatgagataccatctcacaccagttagaatggcgatcatcaaaaagtcaggaagcaacaggtgctggagaggatgtggagaaataggaacacttttacactgttggtgggactgtaaactagttcaaccgttgtggaagtcagtatggtgattcctcagggatctagaactagaaataccatttgacgcagccatcccattactgggtatataaatcatgctgctaaaagccaaatgattataaataaattatatatttatttgatttatatgattataaataaatgattattataaatgattataaatgccaaaggattataaatcatgctgctataaagacacatgcacacgtatgtttattgcggcactattcacaatagcatagacttggaaccaacccaaatgtccaacaatgatagactagatgaagaaaatgtggcacatatacaccatggaatactatgcagccataaaaattgatgagttcatgtcctttgtagggacacggatgaagctggaaaccatcgttctcagcaaactatcgcaaggacgaaaaaccaagaactgcatgttctcactcataggtgggaattgaacaatgagaacacttggacacaggaaggggaacatcacacaccagggcctgttgtggggtggggggagggggagggatagcattaggagatatacctaatgtaaatgacgagttaatgggtgcagcacaccaacatggcacatgtatacatatgtaacaaacctgcatgttgtgcacatgtaccctaaaacttaaagtataataaaaaaagtcaaaaaaaagactcaattcttgaatatacaagagaacttttgtaaatcagtaatatagagctaagccaaataaaatagggcaaaatatttgaatagtcctttgcaaaggagagtttcttatatgctggaagccacaagaaagtatgcttcataggattgctcattaggcaaatacaaattaattccacactgagatagcactaactactcaccagtgtatggctacttttttttttttttttctgagacagggtctcattctgtcacccaagctggagtgcaatggtgcgatcttgactcaccgcaacatccccctctggagtagctgggactacaggtgcatgccaccatgcccggctaatttttgtattttgagtagagacagggtttcgccatgttggccagattggtctgagagcatagctacatttaacaaagttagtacaccaaatgctgacaagaatttggtgccacttcaactgtcatcgctggtgaaaaacattctagaagactggcaatttatactgatgttaaacttatactcaggtcatgacccagcaattgaaggacttccatgaatctcaagtgcacacaaagactgttataagaatattcagcacaagaattcaataaccccaaaattgagaagtgatctatgaaactacatggatatatctcatgagtataatgaatgtaactgcagaaaaaaggccagacacaaaacatatgtacattcattcatgtgaactttaagaacaggcaattgtaacctgtgggaatagacatcagaatagtgataactaagaggacacagggtgggaatcacctggacaggggctctaacaggcctttctcagatgatggcaattttctataacttgagctgggtggtgataacattgatcaaaactaaacaaattgcactaaagatttgtgcactttatgtgaactgtagcttctttactgttctcattgcttgaacctgggagacacaggttgcagtgagccgagattgagccacggcactccagcctgggtgacagaacaagactacgtctcaaaaacaataataatagtaataatttactgttctcataaaaattagcagatggggaatggaggcaagcctgtgcagaccatgacaactagtttagattttattgtcagctcattaaaaactcgtcctcgttttgtgtttttaaaaaattccactgatacagccgttttctctaccagaaaagactataaccgcattatttcatcagtggaagctacagacaaagggcccttgagaggcggcatcttcacctacgggaatttttcctgctcaattgtgagacaaagagcatgtccaagttttcctatcggccaggccgccccctagtttctgcgctgtgggctaaactccagaagctggcgcccttcagggccagaggtttactctgctctctggaggctgctaggattaaaggcaaagcaaacgacaggtctattagccacagttgcaggttagaaaacactactgtgactcagattagaacccaggttgtggcaaccacaactacaagtattaactactacacgaccacaaagcctgctgacaagcattgcacttctatgttttgaatgtaaaaacactcacactattttatctgctttattgttggacgtccgcagattttcgtgcttttctgtctttcgtgcgcttctccctttctctccccattctgctacataattaaaaaaaaaatctcatctctcaggatccgaccactgcctctacaacaagcctcctgggaggtctctttgtcccattgacatctctgccttctttcgctgctttttttttttctttcttttttgacggagtctcgctctgtcgcccaggctggactgcagtagcgcgatcttggctcactgcaacctccgcctcctgagttcaagcgattctcctgcctcagcctcccaagtagccggaatagcaggtgcatgccaccacatttggctaatttttgtatttttagtagagacgggattttcccatgttagccaggctggtcttgaactcttgacctcaagcgatccatccgcctcggcctcacaaagtgctgggattacaggcgtgagccaccgtgcccggccaaatttcaggccaacacctgttgacacacattgccagacacacggaatctctcggggaacaccgatgggcccacaaaacacgcggaggccgcggtcgctgacgatgtgagcaaattcggttcacggtgtctggggtacagccctgagggtctactggccgcctctgcgcaaggaccagtctccgccgctcccctcatctccacgcagattcttgcccacacaccacccctttctttgggccgctgacgcctcttggacctctgaggtgactgtcctgcccgcagcttctctccttccaagagcgtcatttcttgatcctctccatagtggctcaacggtaagcccaaggtccagcacgcgaatcaggaacctgatggttcttcgggtttgcagggatccttccagtgaatagatgaaagtcacaggtaccagtatgaaaactgcagtgactcaccggaaacacttcatgcttgtcagcttgctaagctgtttgagtccaacaactgcatggggtcctgagttagtctcctgaatgtctcctgccgctactttcgtgagtgttgtcgtcactttaccttgtggtggccaagcccctaaatgcactattaggttatgcagtatgattttcagcgtaaaagacagataaagagcaacagcggggtgaaaaagaccctcttgcattggccgggaattgaacccgggtctcccgcgtgggaggcgagaattctaccactgaaccaccaatgcctctgcgtaacaaccgcctgcaggataacagaaaacagtatccacaaagacttagaaaccgttccaagcggttttttcaagtgtcgactaaaagctaacaaagacatccaaaccaaatgtgtttttacaggaaacttttactagacaacgttataaatatcaaaatagctcatttgtcggatcaaactcttaactctgaaaaaggtctttctttctacctgcattacaaacccctataataaaacatcagaaattcattcacgtttcttttttctaatcctaaatcttccatcgtcaacctcaaactgctgccttagaggttctaagaaggtaacctaactggtagtttaggtaagtaaagttcaaatccagggaggaaatcagtagcagaagcagaattagaagaaagaggaaataaaaggacagaaccaaggtagagataatgaagaaacaaaggttggtccactaagttagtcttttgtcgctggtttttttggcaaaagagtaatgatcagtctcgtaatcattataatactattatttgtctgcttgaagatgtataaagcatttgaaggaaatgtgatatgaaaagatgaagaacgctcgctgtcaatgtttccttgtttgggagaatcccatttcctaagttaatatgctttgatgtattagctatgtaagcagtagactagtttaaggaaatattgacggtcaaatattagcatattagtcttttgatgaagttcaaatagtagagagatttctttcctcaattttctctggaaacattcaactgaagagacaaatccagagttttctccatatgttgggtctgggagtcattatgactttttcaaagacaggagctgtgacatggaatcatgcttcttctctagctgagaagccaagctaggtccaggctgcgtcataaacttgagcccaccaaggaaatcacccttcacattgacctcgcagagttttggctgttctctgttctttgcccaacacccaagacacacaccagctctggccaacaaaccttaacatatgatctatatccaccagagctatatttattcccaaatctccttctaaaatacaaacctgtactttctactctcaacttctaaatttacaaaggcctcatatgcatctcagagtcacagatgctaaaacttaaccggttttctgaggattatttggggaaggggtatgcatgcaaatgtatatacataattcatgtgatttaggaatattgactctatgacttccagatgcagatttagaacctttttaaaaaatattttgtttttgttgtcttgcaaatcagccagatctgcaacttaccagagtaaagcgaagccaagcgggacccttaggaaatgcactaagatgtcatccactttcagtgtcagcctgtgaaaatacaggcgatagaagagaatgaagagaacctgaaggaatttctggaaccaaagctaatattaagcaggcctcttgctggcagaccagtggaaactgtagcctggtcaacgatctctctagattgaggaggtctaaagtgtagccacaggttcaactacttttctgtttgtttcccaacctcgattaaactcactaaatttagggacaaaaaaacaaaacaaaacaaaacacgatgttcccacgcagtctcgaaccagagacctttcatatgtgaagcgaacataataaccactacaccacagaaactgcatatgcaccaaaaaaggcaaaatatcatcatgaaaatcttaggtcagccatttctattatcgtttccaaagtaagaaattcaactgcatttcgaaattcgactgaaaaaagcccaataagcaccagccatcaagaagactatggctcccaataggcccaggcttagcgttccgcgcccacccccaacacgaaaaccatggggacccacacccgggcttcggggacacatacccgggcttcgggctcccgcatcctcccctgggtatgcagttccagaactaagcgccgtgtgcgggatcctcccggctgacactcttcggctcccagaagctgcaggagccggcgggctttgagcgtccgagccctgggcgccccgtgcctctcaggagtgtggacgccgcccttccagggatgcggaccccgcctcggggccttttccccggcgccggccgtcggggctcttggctcttctcgtcctcccaggaaccgtaggactctccttgccctccctcccgtaggccgaggggcgcgagctgcgcctgtttcctcacggaccctttggcctcagcgcctcgacgtcttgcaattcttagctcacggctcttcctcctataacaaggcccttccatgtcatgtcccctactccctcttagcaccagagagatgtctcccctgccccacaggtcacattccatgagtggtgaagtttctagagttgtaaccatggcatctccagccctgtgtgttcctctccatgctccccattgagcagtcttgatcctatattagccccaggaaatgaaatagaaacaggaccctacgttaaaaagttgcagtggagatgtggtggccaccaggggctggaactgtggggtgactgagagtatccaaagccctgtggccaacctactggtgctgagtgtgctggtgagcctctctgtcagctggcttccccgggccagttgctcccggaagctctgtcccaggtagtagtcaatgtcattgctccttaggagatcctcaaaagattttactgtatcttttgcatgctgggtgagaagataacaaacacctctcccttctcgtattttttgccgtaggtaagacagttcccgggcctgatcctgaatcagggaatcatatttcctaatgcaggacagaagaggaaagggtggatgataagttatgggggcttctgtagagatttctatgagaacatctctaaggaactcccccaaactgaattctggcacgtaagccataggaggtatttaagagtaaattctaccctgataaagtattgcactgaaaaatttagtatgggccgagcatggtgactcacgcctgtaatcccagcactttgggaggctgaggcaggcagatcacaaggtcaggagtttgagaccagcctggccaatatggtgaaacccctcctctactaaaaacacacaaaaaaactagctgggcatggtggcacatgcctgtaatcccagctacttgggaggctgaggcaggagaattgcttgaacctgggagggagaggttgcagtgagccgagatggcaccactgcactccagcctgggtgacagagtgagactctgtatcaaaacaaaacaaaacaaaaaatttaccatgccactgttcttcaactgttctatatatgttaattatatgtccctagataaatcgtaaggtctgtgagaatgaagatagttctgcgtttcacatcccttacagcaccagcatcacagagattcacagcagatactcaatgaataattagactcatctcatcctaagtctagataggacctttcatgtcttctgttttaaccaccacctgatgtctgaatttcttctgtgttgtgatactgtggctgactgtattttgcaatcatggccatcacataaactctcatgccatcaactgatgagacccaaaacaagagaccctaagtgagagccacccagctgagcccagtcaaaccacagaaccgtgaagcataataaagtactgtttgaagtcactaagttttagagtggttcttacttagcagtagataaccaggacacataccaagatgaatgtctgtgttttcaacacaaagtgtcaataacactgataactatggcaaatagcattgagagcttaatgtatgctgggcaccattctaagcacttgtactaattttttttttttttttttttgagacagagtcttgctctgtcacccaggctggggtgcagtggtaccatctcggctcactgcatcctccacttcccaggttcaagcgattctcctgcctcagcctcctgagtagctgggattacaggggtgcaccaccatgcccacctaatttttatatttttagtagagacagggtttcaccatgttgggtagcctggtcttgaactcctgacctcaggtgttctgcccacctcagcctcccaaagtgttgggattacaggcatgagccaccacacctggccagcacttgtattaattcatgtaaacctaatatccaccctttgagatgggttctgttatcatcctcacttaataggtaatgacaaaggctcagaaaggttaagaaggttgcatgggtagtaagcatcagagctaggcagtctgattccagtattaccactatactatactatactatactatactatactatactatactatactataccataccatatgtactattactttactgatatatccctaagaggaaatccctgagatctggtatctcccagatactgggacatcatcctatgccctcctgcttgcctacctgtcttttccacagacctatatctaccatttaaatcagtgtccttgtgaatacccagacatgttgtttcttccaactgcctgagctaccctacaccaagcacaaacttacacattttcaatccagaaagtgcccagacagtgccatccttacccaggccacgaggctgatctcagctcctcagccagcttcccttctagtcaattttttgggagctgggcctccagctgggatactctctggatgagactcttcaggtcctttttggcctgaagtcctggagagtagaaagccccagtgccatcagacagccacacctcatcctcatcagtgacactatgaggtgaagacccctccagggtgtcaagagctctcagcttccagggtctttccagactagatgaataatcacttgtaactgagagggactggacccggctcttgaagttttgaatgaccttgttggcattctgcagctgggccttcagatctttgatgtcctttcataggacccagatgttttctgactttccatatacccagaactcttcctgcctccctagttcattctccaagggcttcctctcagaggaactagccagcgttcagccccggcgcccctgctcagagcacagcccctccaccaggaccatttccttgcggctgctgtgctcctcatgctctgaaaaaagacaaagatgtcttcctaaataaaagttggatgtgctgttgtggccactgcctttgagaggaggcaggtttggtcatgaggacaataattactagggaataaggtgaagtcgtactttattcaaccctgacactgtactaggcattcaaatacagtatttcttatcctccttatacccacaagttaggtttcaccactttctattttactgactggggaaaccaaaacttaaagagaggtggtaaaccagcttgttctagatcactcaaactagcacatggcagagcctgaattcaaatcctccaacgtcctgtgttcattccacacacactgatgtttctcaagccattaacatggccttatctagttaggatagccacaagaacgcaggacaagctatttctgcatgctgcaagtttaatgctctctaaagtttactataatttaaaagtttattgggttacaactgtgtgaaaaataggcaaaggaaaataagactttgaataaatatatcagcatgttaacatcagtgtattggggcagtggtagtcagaatgagaactaatccacagcattttacccgatgccagacactgttctaaagcattttataagaatttactcatttaattgacattagtacctgatggggtaggtagttcctttattactattttaacatttgaagaaactgaggcataggaaagtttacaaattgggatttgaagcaacaagtctggccccaggatcttttctcttaactgccacactacacttcctcaagaatgagagagactgtgtttttcttctcttctcgttttgaatgtggtgggtggccctatagttgtagtccttttataatgcaaaccaaaattatttttaacttatggtttgcatgtttccaaaacctcatgtggtctctaagtaggccttagtatttctataataatcagttggatagaacttcatatgattattattattattagcagtatgccacaaactcattgtagaaattcaaacttatactcagcctcattttgggtaagagttctcctattaacctcctgtcctcctcttccccactacttgtcaggtgtggaattggccaacagcacccaaatgtgacagctgactccagggagggaaggtgagccccacaccctgtgctcttaccgggactggtggattcctcctgttcagcctcattcttgctttgaccacaagtctcatagcccaggtcctggaggtccacctggacctgcttgctgtcctgcttcagcaagggttcacctgcgtgggaagagacagcaggtgttacagaatgtctgaatttcccacatatgccctgagcctcaatggcacataccctaaccttgtggggcagggagggcagatccacagtgcaagagaagcttctttgaactggtgggagaagagaccaccagctccaggaagcagaatttctttccacaggaggagcctgcatttgccattgataatctccccttcagataacctaggccttagttgggacaaggtatctgtaagtcagggattgtgtactctcatctctagcagccccactgaagctggcaagtgctttatcagcaggggttcaataaatgttgaatgtaaaacatggctgattactttttattttcaatccaacaaatctccatttctggtgagaaaatcttgccaaaaccaaccaagcaaatgcataaaagtatatcaaaaagaaaatgaaagcttccctgcctcccaatcccacttgcttggtttcagctattatttattacatggaggaagggggctaggcacccaggaagtcccaagtcctgttctgacaatcatctggcctccctgggcaaagggaaaagagggaaggcaaaaagaatataacattactgtttgcagaaatttccccttggtacaggaaactctggtaaactgagagagtatgttttccatgagggaggcctcaagggctcttctctggccctaagcccaaactggattttgcctcattttctaagatgcaaaggaaatggtaaaagttgatcaaaggagagggcagagaaagaaagaggacgactcctccatctcaggtccaccttcctcggtgttgcttgagggatcagaggaaatgcatgaacagaggtgcgtgggaactacggctgctctgtgaactcagtgccctccagttacgagctattgtgaggttccatgatgtaatggcgagcgctttggactctgagtacggtgatcagcgttcaagtctcagtgggacctttctgtataatgccaatgatattcctattgctccctaagcggaatgggggaaattgccccagtcatggtcacccaccgtccaggccactggctgtgtgcaattggagtcctagacccagcgacccagcaagacccctcccctctcagggtgaccctgggcctccaggtgacaggtctcctccactgaaaaggctgcgtcccctcaatcctagaccctgagttttcttttatacatgtcattgggccattgccctgtgtctctttggaagaaatgacctatatgaaaaactttacttccgggattccctaattccttcatcccttaggacggcgcagtttttcagctcctggtcttggctccagttctaatgcacacgtttcattttattgtcatgggatcccctccaacaggctaccactggattcctgtccttggggtctctgtggatggcaaccagatgctgctcttgtcccagatcctgacacctctctccagggaattgcctcccttagcctcctaaatcagccaatatttagatttgggcctgggatcgcagcaactgtggagaacagaggttcccgatccctggccagcctcccgcagtgaaggggagaggagcacagcagctgggaggggcaagtctggggccctgggcaacccccttcttcctgcccagactctgctccaaggagcagttgccttaggaccagatcagatggaaactcttttgttctcttctcatcagcagaaaaatttaggcaagagctctggaggacgttcctagctcctaaaaatggtgtggccaaatctctccagttttggaaatgcccaaggttaccaagtattttgagggctcactttggagcctctgaaaaggaggggtgagggcccatggaaggtacctgagggatgcaggggagagaggggaaagagcagacaggagggaggagagaaggaaggaaggggagaaagggcgtgtgagggccaggagccaggattcaccctgacagttcagtgactgctcccttccaacaagcttcccactgtggcaccttctagcaggtggtttccatctcttattgatgtcctaagaccttggctctatggaacggttctgttctatttgtctggcatgagtcctggcaaagtttctttttcaccatttgggggatgagatgggggtatataggtttgcaagtgactaggagctaagtcaggaacttgtggagccactcagagtcaactgtcaagtagcctccttctcccattcccctgcaggacgattgcctgcaagacagggcctggagaaggccagggcacccaaggccacagaaatgcccagggatgagtcccggctggagatgccttggctgaactcactgtgtacttccagggtgcacagggcaggtactctgggggtctggccgggagactgagcaaggggaccagggaggttatgcagaagacttctgcacagcaaggcagacattcttcttggagcccccaacccaaatcaggtcttccacctcctcttcctaaagaccctttactgcagtcattcttttactagaactgcaagtttatagaacatagatttcagtgtgctcatctggccaaccatcttcagtggccaatgcccaaggtaacctccctccctaccaagacctgaactcagagccttacctaaggagaagatgtcctgttctttctttcccaccagaactgccctggcccagaccccatttctgtctggtgaccaggacagtcccctcaccagtctcccaggttggggagggcagattctcctcagctccctgcccctgagagaccccaacagccttgcgtggctccagcccacagagggctatccatggcccatatctctcaaaactctcccctcccactctgaatccaccctctactgcatgctcccctcacagaacagacatgggtttttttttgtgtcctcgttttgcctacccataccccagattgacttttctgtctcagaactacctgtccctctttggacagtgtcttcttggtactacacatgaagatgtcctgctctcccctgctcaaggagagagtgcctgacctgagctgggcccatcagatccagtacttacccggaataggaaaaagatggagagggtgaccaaagattacaaaaatctctgaagcttatccacttgagagagagtccctgaagatactggcctttcatttcctgctatgtatatccagtgtgactgaactctgaataacatatacaagttataataatgtagtagttggccctcaaactaggacacaaacatgttagagggtaaggtagtgagaggcatgtttgggggtggtggtgatgagcaagtatgtgaaggagagatagtgcctacgcttgaaaatcaaaaaggaataatatctatttagacataaggagataaataactaaatacttgcttctatgtgatgaaactctgggagtacacaaggggactgctgttttactaaacaaattttccagtctatataactttgataaggtatccaaataaaaaaattcctttcccatatatgtatgtgtatatatatgtatttgtatacacatatatgtttgcatttttgtattttgaatataaatttttatagagtcctgtgaacccctcttttcaattaggatttgagtttgatgtcatgcatgcaatgtgatcccactgtgtgactacagaaatgttggcaaaagtaagttcagaggaaatggtaggcaagtacttcccagttttggccagaagatggagaaaaaaagaattctcataaaatattaaaagtatgacttgttacagcttcttttcatagtaatttggatagaaattagcaaaatcagaaatgtataaatactttggtctgacaattccatctccaggtatctacggagaaatagacaagtgatgcacgacagatacatgtgtcagtctggtctctgcagttgtatttgtaataatacacattggaacaatgtcatggccatcggttagagaatgtttgaagaatgacccattcatatcaggaaggacgtttcaaagatcaaagcctgatggaaatgctggaggccgtgacgctgataggagctcatgcgtgttgaccaattgctacgtgacaggcattggctccacgcttttcctgcactgctcgtttaaacattggacaaattaagtgttctgatttagcccattagacagatagaaatggaagcacagaaaattaatgggtttatctttaaacgcgagcagattaggtttttcacccagggcctgtggcttcaccataggtgtgattcaggttctgttgttctccactttaggaattcccagtattccaaatatgagaagctgagaaaacaaacaaactcaaaactctaaaaaccgggataagtaagggtagatgtttgctgggtgtggattaataatgaactttttttgcctcaagcaacaaagaggcaccttggaaaatagacaagagacaagaagaggagaagcttgaagatatatttggtccaaggaagagactcttcagagggaagatcacatcagctagaaacattaatgcgactggatgggctcaaaccaccgacttttcagtcaacttccgacagcactaacctagtgttccagagaccctgcttgttaaacagtgaaagctgttgctcaattgtgtcatccataattgtcaaatattgtcatttagtagcacaaggaagtattctctgttgccaagctagagtacccataactcttctgttttgttgaacattcttccccaccacaaaccctctttagaagactggtggctcctaaaacattgaggccaacagacctgtccttgtgcatgtttgggcattgatccagggccaaatcagtgggagactcctccacgcacatgccaggtccccaggtgacaactgcagtctctggatctgaggtcatccactttcccattcctagctcacctcacccatcatgaagcctggttagtattgccagagacccgagtgggcaggtgcccgcactaaagacagaacctgctgtgtgcccactttgctgatccctccatctttctagacaaggctttgtgagccaaggactttgggtttgctcacaaggcagcccctcacctagtaggcattagttcattatgtatagtatacgtatatgtgtatgtatatgtatatgtatatgtatatgtatatgtatatgtatatgtgtatgtgtatgtgtatgtgtatgtgtatgtgtatgtgtatgtatgtgtatgtgtatgtgtatatgtatatgtatatgtagtcctcaggttgtattccttaaatatatataatatatgtaattccttaaatatataattttaatacaaaatttttaaaagattcctttcataaacatttacaataacaccaagaaatataaactacatagcaaagatgtgaaagccagccaggcgcagcttcaaatcctagcgcttaggaaggccgtggcaggagggtcgcttgagctcagaagcttgaaactagcttaggcaacatagtgagacctcatctctactgaaaatcagaaaaattatccggctgtggtggtgtgagcctgtagtcccaggtactcagtggatgaggccctaggatgtcatcggcctgagaattccatgctgcagtgagctgtgtgatcttgccactgtactccagcctgagtgaaagagtgagatcgtgtctagaaacaaaagaagaaaaaaaaaaaggtgtgaaagcctatatattgaagattaccatgtattactgagagcagttaaagacctttggaatagagaacgttccttcttgcatttcaagattgcttttgttttggggggacacttgctgttttttaggaacatgaagttcttctcaggcattcctgtaaaaaaagccactttttgataggattgtattgagtctgtggattgctttgagttgtatttttatcttaaccatgttacaacttccaacccatggacacaagatgtctttccattgatttaggtcttccttagtctcctcgagcaatgttctgtagttgtctgtgtacaagtactgcaccttcttgaacaaatttattcccaggcatattatccttacaggtgctattataaatgaaatcattgtgtcagtttacttctcagatagctcattgccatcacaatggattgtttgctgaaagtttgctgaattcacttattaactctgatagtgtgtgtgtgtgtgtgtgtgtgtgtgtgtgtgtgtctggtgtctgtgtgcatgtatgtgtgtttgcctttgtatgtattgtttgggattttctatgcataggatcacaccatctgcaaattgagatcattttgttttctgttcaaaaatattttttctcatgtttatttttgaaagataatttggccaggtgtagacttgtaggtgacagtttttctttttttaagtactttattgcaaacttcttgtttgtaaaatttcctatgagaaatcttatgccatccttatatttagtgctctgtatgtaacatgttcttttcccttttattacttttaggatttcctttttatcactggttttgatggatttgattaaggtgttccttggtgaagttttctgcatgtttcttgttcttgggataatcatatttctgtaatatttgaagtttatgatttctatggagcttctaaatctttcatccagtatgttttaaatatctttttctctcttctccactacctgcccttcagggattccatttagccctatactggggggtttaaagttttgatgctgatggtctttatatgttttcaagtcatttgttaatgtgtgtttcatttatgttagtttcaacttctattccttctagtttaataatcttctcttctgcaatatttaatccagtgccttcttccatttcacactgtaaatcatagtttttatctacagaatttgatatttaaaaaatcttcaacctctccatttaattaaaatacaattatactaattgcggtaacgtccttttcttctatttccaacgtgtgtgtcaatttcaaccagattattagattcttcagtatgtgtcatgttttcctgcttctttgactgcttgatattcttttatttttatttatttgtttttggggggatggagtttcactctcgttgcccagtctggagtgcaattgtgtgatctcagctcactgcaacctctgcctcccaggtactcaagcgattctcctgtctccgcctcccaagtagctcagattacaggcatgcaccatcatgcccagctaaactttttgtgtttagtagagacagggcttcaccatgctagtcaggctggtcgtgaactcctgacctcaggtgatccacccggctgcttgatattctaagatttgatgctggagctttggtgtcaatgctcaaaagtgcccaaagacaccactcaacctcagtgtctatgcacacccaagcttttgcaacaggagaggtagagacagcagagatgaatgtgctacaacatgctggtagaaggtaccccaattgtgcttggggcttcctatgcctcatagaataatgtgccttccttaatttttcccataagaaccaccctacttcatgccctgtctctctgtccaaacaccaggacagccctcagaccagtctcaaccacccaatggattgacaaaggtccaaatatgattcagtggagaaggcattctcttgtcaacaaattgtgtagaaacaactggacatgcatatccccaaaggaaaaagattcacctgaacctcaatactgactcaaaaactaactcaaaatggattatgcaactaaatataaactataaaagtagaaaaagtatagcaggaaatataagacaaaatcttcacgacgcagttaggcaaagtgttctttgttatcaagaaacacaaaccattaaagaaaacattgataaattcaactttataaaaagtaaaagtttttgctcaacacgagacagtattaagagaacaaatataagctgcagattgggagaaaaacaggggaaatgacaaatgtgacaaaggacaagtgtgatagttacttgcacgtgtcactgtgactgagcaccagggtgccgggacattcggccaaatgtgattctggttgtgttccagagagtgtttcacatatgattaacatcgggatgggcagactaagtgaagcagattgccccccttaacgggggtgggactcatgcaatcaatcaaaggtcaggagagaattaagaggcctaatgggaaacaaatgctttcctgggtatccagctttccttccatcttgggaatttcagcctccataatctcagaaacaaattcacatatgtatacacacacatatacatttcataggtatgtggctaagattgtatttttaaaagttcagccatgagatgattggtgaagccagccaatgaataagggtgtgttctattatatgactcagtcttcttttgtacacgattgaagttctgcatttgaagtaggaggacaggagagagcaagtccacctaggatgataacagctgaatttctcaacagacacttcaaagccctaggcgttaacttagagagtcaaaaatcccacccataaccctgcccctaaacgccagggctagggaacactgtggccctcaggtgattttgtttcacttggtctgggagccacacaagggcagagggagcaggaaacactaagcaaatcgaggccaggacagcagggagggcctgttcatgacagaacacaggtaaaactatcctcagaaagagcatgtggagaaacacagatcatgcctgagacctggtggattagagcactggctactggggaattgaaaggaaggggcttcaccatgcagaggaccagaggtgccagtcttggaaacgcagaattgctgggagatggggaggcatggacaaaggaagcatcctctggagactcatggtgaagagaacaaatgaagtaactggcagaaattataggtcctggtagaacaaaatagaatcccacaatgagaacatacagcatgtatgtcccgcaaggaagacaatagctcctaaaaatgcaagaaaaatcattttgggcaaacaccttatatccagtaatgcgatccatgtatcaagaccacgaggaagattattaaacatgctaaactcagcgagacctgattccctcatgaggactctgttaaggatgagtaccactcagcaagtgatgactgtgacattcacttttgaacagctcatgagcattaatatatttaattgtggatctaaaccaaaaaccaaggtgtgggcaagatgacaaccacagaatgtcactggcatatgtttaggttcaaataccattatgagaagtggcaggtaaaggaggtaggaaaaagaaaacacatcatgtaactgactgtcatatggaaatatttgacgttgaaagtcataatttaaaatgtataaaccaaatattagaagtgtgtctagttcaaaggggggaaaactatgaaacatttttaatcaatatcaaacatgagctacacaacccttcctaaatgccagaggcacacacagacacacacacacacactctcacaaagaatataaatatctagaaccaagaaatggagtaaatgcattctgctacatatggtaaacatagcctacaaggtggaagagattagaaaataaacagggaaatggaaatgtttttattaattcacatcagtacccaccaaaaccaatcagcataacaaaagattataacactgaatgtaaaaaacaatccaacagtccagagtgataggcaaaagcttttaattgtatagattaaaataactttggacaaaaattaaaactcaggcagagaatgttttttttttcaacaacacacactagcaaaaacaaaggcacagtaaacattgaggcagaaagtttccagcgtagagatatgaatataataatagacacaggcagggatgattaataaatgataaaatgtttacaggatgatcattggaatacaggacatttctaattttgaaaaccaccctcccaaatacttcattataagtaaggtgtctctaaaagggacagatctcctagacccctccttaaccaagtaaccagtcctgatatcatgataatgctgatggacaaactagaccttctctgcccgcagatgggctaaggttggaaactcacagcattgtctctgcagtgttcccggcaaaacgtttaggctgaatttaatcatgaagacattttcagacaacttcagaatgtagatcattgagccagagagctgacctgtcctctataaacaagtccatgtcaccaccatcaatgacaacaacaaaaagatgaggaaatatttggggttcaaaataactaaagaaatgcagctatattatctttttactttttttgaacccaaaatatctcttctcctttttgttgtgtgatttgtggtgatatggactatgtgaaggagacaggtcagttgtcctgctcagtgttctacattctgcagttgtctggtaattacctcctatgaaactcaggctaagcgttttctgcaagaacatggcgttgttcatattctgcaccggcagagtcctgggtgacatgctgtctcctgccagcggctcctgactcctgttctctacaggatggaatcgagaggagcagggctaaggcctcccaatgctgtttgtccatctagctgtggtcttcctaagtactgacaccaattggaggctgaaggactgtggcttctctaaccaaaggagcctagcgggttaacaattgtcaagagcagttggtggttctgaaatacaatcctcagccaaggatccctcctgtgttaaagatggatcagctaaaacaattcaacactgaagatacaaagaatgaggttaggttcattgaaaccagggtaacacctttggatgagctaaacacaaagatgacactgaccttgagcaggtatagaagctcagagacatgactgcaaaatgaaatccctgaggaactttgtagctacccagagataagtggttcaaattaaaatgtctgactgatcactcccggcatgtgctgcacagttatgtgaacgtgtcacacctaacttgggtccattgtcttcagactgagcacagggtgccactggcatggtctgagaataggaatagagccatgcccactgacccatcctatgtctgggcttccaaatggaactatagtttcattcaaatcttcacgtgcctataggtcctgcctgcaggaatgacatctctcggcttagtaagggctgcttactgtgggaatatgactcccatctggaagaccaggtggagacttgttcccatcaaagtaagaaacctattgtccacgtcaagggcgaagctgatgtgctgttcctcaaatgagtaaaacacacttctgtagtgctggaatgagtcaggtagttcaaagtacattgacggagtcgaataacatctatccagtgagtcctgcaagacttcaggctcttccacttccatcagcatgccgctgagcctggaaaagcagacaaaactaaagaagcagccagggaaaatcagacaccacagagccccactagatttcagaagtaacgtaaggaagtggtaagaaaagaaaaggatagatccattagatccattaatgaggtaaaaaaaaaaaattattgcctttatgttgggatagaaaagggccaggtagaaaacaatgaaagagaaagacagagagacagagacagagacagagacagagagaaagtgagctagtgaattggccaggtgacatactggtaagggagtaaaaggacactctgagttagtgccctcatgacacacagcacactgcgatcatgaaaagagtgagctcaatagttttccataaaatatgctcaaaattcgatgcagtggccatgagagtacagcttttgaagtatggtcatcctatggtacgttagtaaatgataaggggaggaagaaatggaaacctaaacatctactgcaatgaaaaccaacagcaatgacagtaggagtaattcagccttcgttgaaaacatgaaatcaaacacactctggtttccctcaatctgttgcctccaggtgttaacacagaattaagcatccacaattgctgaaagttacctggggcatggtgggttttgatcttcttccccttcttttcttccccttctccttcttttcttcgttgatcttcttccccttcttttcttccccttccccttcttttcaatttctgcaataaattcagacatggacagacacattaagctgattcccctacacacataacaatccactgtctaaccctcacacagggacctcaggctcctcagcataagaataggagactgtgagagatatatttcaggaggcctgaaggctggtcatgatagaaattcctcggtttttctcccagaaactgtgggtaaaatgtccctattctagtagatcgttatcccaatatcatttgtcccgagtttgtgcaaacagttatgccatatttttccaatcaatttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgagagtagaatcagagtgccacaggcatggcctgagactaggaagagagccatgctcactgacccatcccatgtctgggcttccagttagaactagagtttcattcaacctacatgtgcctataggtcctcactgcagcaatgacatctctcagctcagtaatggccacttggagcaggaatatgatctttatatggaagactcagtggatccttatcaccttcatagaaaggtactcacctcccacgtcaagagaaaagccaacatgtttttcctccaatgcataaaaggaacttccatagggcaggcaggagtcaggctgttcaagacaactggaaggagttgaataacatctatccagtgagtcctgcaagacttcaggctctactgcctccagcagctccctgctgagcctggaaaagtaggaaaaagtaaagaataagccagggggaatcagaaaccacacagccccagctacatttcatggctaacataaggaactgtttaaacagaaaaaggacagatccattaatgaggtaatgaattattgcctttatgttgggatagaccagggccaggtagaaaagaatgaaagagaaagacagggagagggagagggagagagagacagaggagaaagtgagctcagcgaattggccgggtgacacactgacgaaggggtcaaaggacactctgagttagtgccctcgggacacacagagaacagtgatcatgaaaagagtgggctcaataattttccataaacttgcttaagattccatgcagttgccatacagcctttgaggtatggtcaacctacagtaagttagtaaatgataaggggaggaagaaatggaaacctaaacatctactgcaaggaaaaccaacagcaatgtcagtaggagtaattcaaccttcgttgaaaacatgaaattgaacatactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacgcagggacttcaggctcctcagcatgagaataggacactgtgagagatcttcttcaggaggcctgaaggctgatcatgatagagattcctgggtttttgtcccagaaactgtgggtaaaattccctattctggtagatcgttatcccaagatcatttgtcccaagtttgtgcaaatggttatgccatatttttccaatcgatttaaagcaaatgcccccaaatggttgctgggagaaaaactgcaatattcagccctgtctcatcaaatactcagattcttcatggtagcgaggattttagatgctgaaattagagtgaaggatgaaatctacaagatctacaaaattgagacaaaatcagagttgtgtgaatttgtcacatctgcccagatccaacatcttgagagtgggattagggtgccacaggcatggcctgagactaggaagagagccctgctcactgacccatcccttgcctgggcttccaagtggaactagagtttcattcaacctacatgtgcctataggtcctccctgtggcaatgacatctctcagctcagtaagggccatttgcagtaggaatatgaccctaaccagaagactcagtggatccttatcaccttcatagaaaggtactcaccatccatgtcaagagcccagccaacacgctgttgctccaatatgtaaaaggcacttctgtagggctggcatgagtcagtcagttcaagataacctgaaggagttgaataacatctatccagtgagtcctgcaagacttcaggccctttctcatccagcagctccctgctgagcctggaacagtgggaaaaagtaaagaataagccagggggaatcagaaaccacacagccccagctagatttcatggctaacataaggaagagtttgaaaagaaaaaggacagatccattaatgaggtaacaaattattgcctttatattgggatagactagggccaggtagaaaaggatgaaagagaaagacacacacacacacacacacacacacacacacacacacacacacacagagtgagctcagtgaattggccaggtgacacactgatgagggagtcaacggtcattctctatttgtgctctcaggacacacagtgaacagtgatcatgaaaagcatggcctcaataattttgcataaaatgtgctcaagtttccctgcagccaccatgagaatacagcttttgaggtatggtcaaccttcactaggttagtaaatgataagggtaggaagaaatggaaacctaaacatttactctaatgagaaccaaaaagcaatgtagtaggcataatttagacttgtctgacaagacaaaatcattattttcagcatgtactgttttccctggacttggcatctccaggtgtcaacatcaaattaactgtccacaatttctcagactcacctgggacctgttgcctcttggtcctcctttttcacttgatcccaccgatgtcctgcaaataaattcagatggggcctcttacattaagcagttcttccttgcacacagaaacattcctctgtccaatcctaacacaggtacatcagtctggtcagtgtgagaacaggagactttgagagaaatattccagcaggcctgaggtcaagtcttgagaaaactggcttgggttctttcatgagccttgggcaaaattaccctgttttggaatgttatcttccctatgtgctctgtcctaggtttgtgtacacaaatgagcaactttttccccaataaattgtaggcaaatagttctaacacctcataggagagatacttcaatattaagctttctctcatcaaatacccagaatttgatagtttatgagattgtggacacagagatttgatgaaggggtgcaatgtaccagctcttgagtcaaaatgaaacttggttctacacagaagcatcagctattatggcttttgtgggtgaaaagtcagccatttatctagaaaacataccaggaacatgacggacagatgagctaaagcaagcgaacttagaagacacagaaaatgggaataaattcagtgaaacctgggccacatctttcactgagaggtagacaagggtgacacttgccttgggcaggtaaagaaccacacagacatgctttgggaacaaaactcataaggaattttgtagctggcaagagacatttaattcagatgagctgatctgacagacaactcctggtcatgtgctgcatagtttggtgtgagcttgccacacctgccttgagttcaatgtcgtgacagtcagtccaggttggcacgggcatggcctgagactaggaagagagcaaagctcactcacccaccccatgcctgtgcttcagactcgactccagagtgattgaaatctacattgatatataggttcagcccacagtgatggcaaatctcagcccaacaaggggcacaaggcccaaagattatggggtctacctgggccatgaactggagctttatcaccttcacaatggagtactcaccgcctatgtcaacagccatgcagacttgctgttcctctaatgagtgaaatgtgccgctgtaagacttgtacgaggccaacatttcaggaggaattgagagagtcgaataaccttcatcccaggactcctgggggacttcctcctcttcagactcctgcagattcctgatgagccaggcaggacagggatgatagaagatttaaccaacagacattagacaacaaaacctcccagatgatctgatgggagacagaatggagtggtcacagaaaccaaaggcatttttccttcaagagaaataaaactagccttctaaatacagggtggagggtgactgctctggggacagagcaaaaatgggcagcatgtgctcagtacatttgccacagatgagccaactcagggcacccagactctccctgtaaactaccatcatgacttgcagcacagagaactgacacagggcttcaactactttgcataaattgggttgaattttacatgcagcattcaagtgaagagagttcttgacacagtgcagacacagatcttgtgtattaagggccccattttcccaatattttgatataatatatttaccttttcaatttcttttcttgcaaaaatactagccaacatactaccaacagataggaagaaagcatatatacatctctccctggatttaaacacatgggagagaataggcaacaccaagaaatccctgtttgagggtctggagtggacttccagcaaactccaacagacctgaagctgagggacctgattgttagaaggaaaactaacacacagaaaggaatagcatcaacatcaacaaaaaagacatccatcccaaaaccccatctgtaggtcgccatcatcaaagaccaagggtagataaaaccacaaaggtggggagaaaccagagcacaaaagctgaaaattccaaaaacctgacatcccttctcctccaaaggatcacagctcctcgccagcaatggaacaaagcaggatggagaatgactttgatgagctgacagaagtaggcttcagaaagtcggtaataacaaacttctctgagctaaaggaggatgtgcgaactcatcgcaaggaagctaaaaaccttgaaaaaagattagacgaatggccaaccagaatgaacagtgtagagaagaccttaaatgacctgatggagctgaaaaccatggcacgagaactacgtgatgcatgcacaagcttcagtagtcaattcgatcaagtgcaagaaacggtatcagtgattcaagatcaaattagtgaaatgaagcgagaagagaagtttagagaaaaaagagtaaaaagaaatgaacaagcctccaataaatatgggactatgtggaaagaccaaatctacgtttgattggtgcactgaaagtgacggggagaatggaaccaagctgggaaacattcttcaggatattatccaggaggacttccccaacctagcaaggaaggccaacattcaaattcaggaaacacagagaacaccataaagatactcctcgagaagagcaaccccaaaacacataattgtcagattcaccaaggttgaaatgaaggaaaaaatgctaagtgcagccagagagaaaggtcggattacccacaaagggaagcccatcagactagcagcagatctcttggcacaaaccctacaagccagaagagagtgggagcaatattcaacattcttttttttttccatatgtatagttttcctttattattttttgtgtgtatgtatatatatgtatatatatttttcaatactttaagtcttagggtacatgtgcacaacgtgcaggttagttacatatgtatacatgtccacattggtgtgcttcacccattaactcatcatttaacattaggtatatctcctaatgctacccctcctccctccccccaccctacaacaggccccagtgtgtgatgttccccttcctgtgtccatgtgttctcattgttcaattcccacctgtgagtaagaacatgcggtatttcgttttttgtccttgcgatagtttgctgagaatgatggtttccagcttcatccatgcccctacaaaggacatgaactcatcattttttatagctgcatagtattccatgttgtatatgtgccacattttcttaatccagtctatcattgctggatatttggcttggttccaagtctttgctattgtgaatagtgccacaataaacatatgtgtgcatgtgtctttacaacagcatgatttataatcctttgggtatacacccagtaatgggatggctgggtcaaatggtatttctagttctagatccctgaggaattgccacactgtcttccacaatcgttgaactagtttacactcccaccaacagtgtaaaagtgttcctatttctccacatcctctccagcatcttcaacattcttaaagaaaagaattttcaacccagaatttcatatccagccaaacaaagcttcataagtgaaggagaaataaatcctttacagagaagcaaatgctgagagattttgtcaccaccaggcctgccttacaagagctcctaaaggaagcactaaacatggaaaggaacaaccggtaccagccactgcaaaaacatgccaaactgtaaagaccattgacgctaggaagaaactgcatcaactaacgggcgaaataaccagctaacatcataacgacaggctcaaattcacacataacaatattaaccttaaatgtaaatgggctaaatgccccagttaaaaaacacagaatggcaaattggacaaagagtcaagacccatcagtgtgctgtactcaggaaacccatctcacatgcagagacacacataggctcaaaataaagggatggaggaagatctaccaagcaaatggaaagcaaaaaaatgcaggggttgcaatcctagtctctgataaaacagactttaaaccaacaaagatcaaaagagacaaagaaggccactacataatggtaaagggatcaattcaacaagaagagttaactatcctaaatatatatgcaccctatacgggagcacccagattcataaagcaagtcctgagagacctacaaagagatttagactccacacaatcataatgggagactttaacaccccactgtcaatattagacagatcaatgagacagaagctttacaaggatatccaggacttgaactcagctctccaccaagcagacctaaaagacatctacagaactctccaccccaaatcaacagaatatacattcttctcagcaccacatcacacttattccaaaattgaccacatagttggaggtaaagcactcgtcagcaaatgtaaaagaatggaaaccacaacaaactgtcagaccacagtgcaatcaaattagaactcaggattaagaaactcactcaaaaccgcacaactacatggaaactgaacaacctgctcctgaatgactactgggaaaataacaaaatgaaggcagaaataaagatgttctttgaaaccaatgagaacaaagacacaacataccagaatctctgggacacatttaaagcaatgtgtagagggaaaattatagcactaaatgcccacaagagaaagcagaaaagatctaaaattgacaccctaacatcacaattaaaataactagagaagcaaagcaaacaaattcaaaagctagcagaagacaagaagtaactaagatcagagcagaactaaaggagatagacacacaaaaaacccttcaaaaaatcaatgaatccagggctggttttttgaaaagatcaacaagaaaaccctgtttggctagttcacctggctcatctgatggcaagttcctatcttgagaggactatgaaattaaaaccaatacaagtgccacaaataacatacaacattgtaaatcagcacaatttgtagctgggtgaatggaagaaatagttctattcatcacttcctcattttccctaaatctacaatctccagatgtcactactgaattaacagccaacaattccacaacattacctgggagacactggccctttttcttcctcttcctcatcatcactttcattttctgtaaataaattcagagaagcaggtcacattaagcaattcatacttcacatatgaccaaatcactgtccagtcatagcacaaggacataactattctcagtgcaagaataaggattctgacaggaatattctagggtgccctagattaactttggtgagaattagatgaccctgctttccagacccacaggccaaaatctccctctacgtgtagaccataatgccatattccctgcctgagtcaaagttaaacaaaattttttccccaaaaaaatctccaaaaattggtccattttctaagagtgttgctgcaatacggacttatatcaccagataacatggacattaaatgtttagaggcatctatacatgaaacacacatgatagataaatttgaacaactcttgctttaaaaagaatctgtgatttgggaggccaagacaggtgaatcatttgaggtcatgagttcaggactaccctggccaatatggggaaaccctgtctctactaaaaatacaaaaattagccagatgtgatgttgtgcacctgtggtcccagcaactcaggaggctgaggcaggagaatcacttgaatctgggaggcagaggttgcaccaagccaagatggtgcaactgcactctagcctgggtgacagagcaagactccatcgcaaaaaaaaaaaaaaaaaaaaaaaaaaaaaaaatccacgatgctacaaagaaacattggatcagccattgcattgacagggtggagaaccagggtccagccttgctttatggaaatatatcagcaaagtaaagaagaaaagtttccgtcctgatttcagggtgactgtgcagctaagcaagctgacttaaaggagatccggatgaaagctgagagcagtgaagcctggggaacaatatttccaaatacaaaggcaaggctgccagcttcctgaaacaggcatagaaactccatggacattgttcagggacagatgacttaatcacagatgacaagagatactgaatcgaagctaggaggcctgacagatactgcctgtgcacctcctgcactcaggtgactatgagattgtcacacttgcctggggtcgagtaacttgatactggggactggcagacaaaggcatgacattagctgagaaggacaaaaaaactccctgatatctgtttagaaacccatcatagttttttattcaaatgaatttgtgtttatagagcctgtcttcagagtttatcttcctcagcctagagagaggtatgagacacaaggaaaacagaggctacctgggataatgtgtacagcatcctcccattcaacatgagaggatgagccaatgagagttgagtcgactttgtcttcctcaaatgtgattttggttttcctatgtggctggttggagtcataagggccatggctatttgaacaagtgatggcacattcctccagtgagtcctcagggacttccttttcttcagccttcggcatctccctgatgagccaggtgggacagagatgacagaagattaaacacagagggattggaccccagggagtcctagctggttttgacaggcggcattaagagagtggtcccagaaagcaaaatggaggttccctttaagggggaacatgcaatcctgttctctctgcaacagagcatggctgccatgggaaccagagaggaagagagcagctggtgttcattgcagtggacagataggagctgaggaggatgaagactcagctatccctgtatggtgcagacatgacactcggcacacatagagaaacatgacagctgccgcaccctgtgtctaagctgggttatatttcacatactgtggccaagcaaatgcgggtttttggcccatcatagatgccagagagggtgtacctcctagatattcttcatatgttaccatccattacttgttcctgagtattcagtgttacctgggggcagacgatttctgcactttctcagccacctcaacttgaacatcttcatcgtcatcgttgtcattttctgtaaatacagaagtgttcgttcagatatttcccacttcacagtctgcaagcacagtcagcccaatgtgcaacagagacatgaacatctaggcatgggtcaccgttcaactgaaaactctcatgttttatctttaacagaatgccctggcatggtttcctgatccatcaggcaatgcatttctgatctggagggccaccatcaagatgtggccaaatattgaaaagaccttttgcttcccatatcactggaggcttgtgcagcctctctctggactttggcagctgtcgcccccatcctgccagatctgattcccaggcacaggcttggtgtcctgtcacagtttgcatttcaaacctaattctttctcttagaagcagacaaacttatcccacagtcctctatgcatcagaagatttcaagcctccaagtggcttctgctgtgttattcagggacattctatccatggggagtgctccagtctgaagcacttcctaccacgaaacgccaccacataaagtgccttctccaacatcacacggcgaggggcttcatctcattttggaaagcagttttaagtgttcccacatttgaatgcttcagacccttgcaagagacaatttgccatggagagagagaaactcaggaaagacaagtcattcagtcactgacagttactaagaacattgccgaaaagacaccctgggaaccttcattcttagtccagagctcttttcactctaacaagcctgctcctatcgcagcctccttcctgtcctttaaaactagatagatgctgcctcttactccaaagacaaccttccatcaagggaggagggacaattgcaatactgtgacctccaaccccatgggtttcccaactccgttcttacccaggaagtcctggtcatgtcatggccacataagcttagtggcaaaaaacaccattgatacaactgtcattgtgaaagtatggaggtctggagtctctcataagcctggggttttgggtcatcagggcctatggccaccttacctgggctgagcttttggacaaggtgctgtgccagtctacacccctcagccagctgttcttggaggtcctgcccctgggacttgtctggctcatccggagtgaggagggcctggagatgctgattcaatgagcaggaggcatctctcccttcccgtaacttctcccttaactgggtcagctctcgttcctgagagtgaaccaggactttatattgcctaaggtgagacggtagagaaaatttaagagtggaaagggttgagtgatccgctcaaatattgcaacagagatttctgagacaatgtcctcaaggagacctccaagcagaaggtcagcacatgttggaaggaatgtctgtggctaagagaaagaatagaaaatggtttacaggtttcctctgtatcagagagggctcctgcaagatcctcgatgatgttccattcatctttcccttctgtaaacaaaagtaggtgtcttcctaattccatttcaaaaagacatcctttcagtccctcactctggccatggacatttccatgtgaaaatacacatagtgcatcttgcggccactagatacaaagccatgtacagaaatgaggccaggtgcagatggggcgaattgaaaagatgaaagaagaaaagaatgacagggtcgagaaggcaacattgattgagtgaaagaatgagaagacgcagtcagtcagaaggtgattctcactaagggtaagtggggtggtgatggcacaccattttgagtatactgaatgctgctgtgtggttcacactcctttggttaattttgtgttatgtaaatttcacatcaacaattacttgtttgaaaaagagaaaacaaggctctgagaaacaactgcaacccataaatttttattatccttcttctctgcttgataaatacttgtgtgttgcgagcctgccatggcaattcctgcccttcccctggcccagcttagttcttaagtctccccactgagctgctgtacttcagagatttacacacctgcccccctgcctgcccccatggggtcccctcacctgagctcctcagcttgcttgagctgctctgcaagcttctcctccttgaactgtcgctcattcctcagcatagattttatgaggtctttgcactcttcattttctgagaaaagacagacacgcctgcctcagtggaaggctggacatgctgctgtggtcattgcctacagggcaggagccaggtccatcccaaggacaaaactctccccagtaccagggtctagacagggatttccacatctttactcttcagtctcctgactttctggcatctgatcctccaaaatttagagatgaagagaacctcaatggcacatcaaggaagttgacaagatgattcaaccacaacgaagtggagtcagaattcacagcccctgaggtctgactctgaatgcagggccactttcccaagacttgcagcctctcctctaaaacactgcactggggcatgaagtagtgatttcttgtacagtcgggaaggcccctaggactatgggactgatggtttcccttttactgggaatttcaaggacaagtatgcaaaagattttaaaaatctttgatttttaaatcatatcttcagttatgattttaagaatcatatctgaagcataaagtgtgacacataacaccataaggccatgaaggaaatatgcccaaatgttaataaagtttgtgttaatttagaaacagcagaatgaagaactaatagatagtgtttactgtgtgctaataaatgttctaggagattgacaagaaatagctcatgtaattcactgcagcaatttacagaggtaggtattattgtagtaccctctgaacaggtgaggaaacagggacagaaaagacaagcaacttggatggagcccaggagacaggcccacggtctctgctctgtacactgcactgctatctccacacattctcgggtgcgatctttcttcctctttaggaacaagactctgtgccccaggaagcaggacttcactctcaccaagctacattctgcttcttattcttatttttatttatcattattagtattatttttttaacagtcttgccctgtcgcccaggctggagtgcaatggcaaaatcttggctcactgcaacctcagcctcctgggttcaaaggattctcctgcctcagcctcctgagcaggggtgattacagtcacctgccaccatgcccatctactttttgtatttttagtggagatggggtttctccatgtttcccaggctggtctcaaactcctgacctcgtgctctacccgcctcagcctcccaaagggctgggattacaggagtgagccaccatgcacagcccctactccctgctcttgatgctgtcacttatagatagcacaggttctattaggagcagactcctcttgaagcccctcagagcaggtactggctactatcaccaagtttccctcagagtcactagaacagagctttgcatattgggcctcaacagaaacttgaactgaataaaagttcactagtctcagacatttagaacaacagactagatgttatttgtctgcaggatcttacatggtacagagaggattcttgaaaacatgattgagcctcttggagaaaacaggtcattctgtgcctgtgtcagaaatcaataaatggcagtttaactctagtcccacccccacctgattgcaaacatggaaagttgctaaatattttgggacctctgtcttccaactttaacaaaatgttaaaatacccatttctgttttcctagaagtatggggaggatgacattattttagatggagagagcacttagtttctcagagagaagacaggacttcgttcatcactttcgtgatggtgagcctatagatcttactgtatttgttctgctggttggccaggaagcaggccagttgagttacaaaacatttctctttgaggtttctgaactgctgtttcttctctgccagctggggatgcaatttctcgttgatttctagaatgttcatctctgccttctcgctggacaaagggccggctgataccaccatgctgacgtttgtggcagaagaggtggggccagggactggggagaagaaaggcaaacacatgatgggttaaaaactggtgaaatcaaataggtttaatcacactgagggatgtcagcggcagccttgtctacttatttgaagatgatgtttccctggtttcactcttgtcatctccagtcttgatctcctttaagtcaacttatcttagctatgcagtcaccttgaaaccaggacataaacacttctacacttttcttgcttataagtttctataaagcaaggcttggccctgagatttttaccccatgagtggccaatgtttctgtgtagcacaaaaggtttcattttgcctttttaatttttttcttttttggttttttgttttttgtttgagacggagtctcactctgtcacgcaggctgcagtgcagaggcacaatctcagctcactgccacctctgcctcccgggttcaagcgattctcatccctcagcctgccaaacatctgggattacaagcgccaagtaacatgccagctaatttttgtatttttagtagagatggggtttcgccatcttggacaggctggtttcgaactcctgacctcaggtgttccgcccaccttggcctcccaaagtgctgggattaagatgtgagccagcacccccggtcagagacttttttttttttttttgagatggagtctcgctctgtctcccaggctggagtgcagtggcacaatctaggctcactgcaaactccggttcctgggttcatgccattctcctgccacagcctcccgagtagctgggactacaggtgcccaacaccgtgcccagctaattttttttttttgtatttttagtaacgacggggtttcaccgtgttagccaggatggtctcgatctcctgacctcgtgatccacccgccccagcctccgaaagttctgggattacatgtgtgagccaccgcgcccggccgagacttcttattaatagctaagacaagccaatgaaaaggagagagagtctagcctgagaggagtgaaccagggtgggaggatcgtctcagccgatcctcccacctaagtctcctgagcagttgggactagaggcacgcagcaccatgcctgcctaattttttgtattctttgtaaagatgggtttcaccatattgtccaggctggtcttcaactcctgaactcaagtcatcctcccacttgggccttccaaagtgctgtgattatatgtgtgagtcacagaacctagctccatcctagtttctgactaaaacaatatgtgcgtatacagcctgtcctcagaattgatcttccatagcctagacagaggtatgagacacaaggaaaatagaggctacctgggagaatgtttacagcatcctgacattcatcatgagaggattctctgtctacaaccagagctgagttgactttgtcttcctcaaaggtgatgttgatgttcttgtgaggctggttggagtcacaagggccgtggctatttgaacaagtgatggcacattcctccagtgagtcctcagggactttgctttcttcagccttctgcacctccctgatgagccaggtgggacagagatgacagaagattaaacacagagggattggaccccagggagtcctagctggttttgacaggcggcattaagacagtggtcccagaaagcaaaatggaggttccctttaagggggaacaggcaatcctcttctctctgcaacagagcatggctgccatgggagccagagaggaagagagcagctggtgttcagtgcactggacagataggagctgaggaggatgaagactcagctatccctgtatggtacagacatgacacttggcacacatagagaaacacgacagctgccacaccctgtgtctaagctgggttgaatttcacatactgtggccaagcgaatgcgggcttttggcccatcatagatgccagagagggtgtgcctcctagacattttcatatgttaccacccattacttgctcctgagtattcagtgttacctgggggcagatgattccagtactttctcagcctcctcaacttgaacatcttcatcctcatcttcgtcattttctgtaaatacaaaatgttcgttcagatatttcccacttcccattctccaagcacagtcagcccaatgtgcacagagacatgaacatctatgtgtggttcagcattgtactgaaaactgtcatgttttatctttcacaaaatgccctggcatggtttcctggtccatcgggcaatgcatttctgatctggagggccaccatcaagatgtggccaaatattgaaaagaccttttgcttcccatatcactggaggcttgtgcagcctctctctggactttggcagctgtctcccccatcctgccacagatctgattcccaggaacaggtttggtgtcctgtcacagttcgcatttcaaacctcattctttctcttaggagaggacaaacttgtcccacagtcctctatgtgtcatgagactgcacaggccctccatgtggcttctgctgtgttattcagggacattctatccatggggagtgctccagtctgaagcacttcctaccaccaaatgcccccacatcaagtgccttctccaacaccaaacggagaggggctgcatctcattttaaaaagcattcgtaagtgttcccatatttggatgcttcagacccttgcaagagacaatttgtttgcctttgcagatggagagagagaaactctggaaagataaatcactcactcaccgacagttactaagaacattgccaaaaagacagcctgggaaccttcattcttagcccagagctcttttcactccaacaagcgccctcccatcacagcctccttcctgtcctttaaaactagacagatgctgcctcttgctccaaagaccaccttccatcaaggaaggagggacacttgcaatactgtgacctccaaccccatgggtttcccatctctgttcttacccaggaagtcctggtcatgtcatggccacatatgtgtagcagaaaataaccccactgatacaactgtcattgtgaaagtatggaggtctggagcctctcataagcctggggttttgggtcatcagggcctatggccaccttacctgggctgagcttctggaaaagttgctgtgccagtctacacccctcagccagctgttcttggaggtcctgcccctgggacttgtctggcttatccggagtgaggagggcctggagatgctgattcaatgagcgggaggcatctctcccttcccgtaacttctcccttaactgggtcagctctcgttcctgagagtgaaccaggactttatattgcctaaggtgagacggtagagaaaatttaagagtggaaagggttgagtgatccgttcaaatattgcaacagagatttctgagacaatgtcctcaaggagacctccaagcagaaggtcagcacatgttgaaaggaatgactgtggccaagagaaataatagaaaatggtttacaggcttcctctgtatcagagagggctcctgcaagatcctcgatgatgttccattcatctttcccttctgtaaacaaaagtaggtgtcttcctaattccgtttcaaaaagacatcctttcagttcctcactctggccatggacatttccatgtgaaaatacacatagtgcaacttgcagccactagatacaaagccatgtacagaaatgaggccaggtgcagatggggcgaattgaaaagacgaaagaagaaaagaatgacagggtcaagaaggcaacattgattgagtgaaagaatgagaagacgcagtcagtcagaaggtggttctcactaagggtaagtggggtggtgatggcacaccattttgagtatactgagtgctgctgtgtggttcacactcctttggttaattttgtgttatgtaaatttcacatcaacaattacttgtttgaaaaagagaaaacaaggctctaagaaacaactgcaacccataaatttttattatccttcttctctgcttgataaatacttgtgtgttgcgagcctgccatggcaattcctgcccttcccctggcccagcttagctcttacgtctccccaccgagctgctgtacttcagagatttacacagctgctcccccacctgcccccatggggtcccctcacctgagctcctcagcttgcttgagctgctctgcaagcttctcctccttgaactgtcgctcattcctcagcatagattttatgaggtctttgcactcttcatattctgagaaaagacagacacgcctgcctcagtggaaggctggacatgctgctgtggtcattgcctacagggcaggagccaggtccatcccaaggacaaaactctccccagtaccagggtctagacagggatttccacatctttactcttcagtctcctgactttctggcatctgatcctccaaaatttagagatgaagaaagggaacctcaagggcacatcaaggaagttgacaagatgattcaaccacaacgaagtggagtcagaattcacagcccctgaggtctgactctgaatgcagggccactttcccaagacttgcagcctctcctctaaaacactgcactggggcatgaagtagtgatttcttgtacagtcgggaaggcccctaggactatgggactgacggtttcccttttactgggaatttcaaagacaagtatgcgaaagattttaaaaatctttgatttttaaatcatatcttcagttatgattttaagaatcatatctgaagcataaagtgtgacacataacaccataaggtcatgaaggaaatatgcccaaatgctaataaagtttgtgttaatttagaaacagcagaatgaagaactaatagatagtgtttactgtgtgccaataaatgttctaggagattgacaagaaatagctcatgtaattcactgcagcaatttacagaggtaggtattattgtagtaccctctgaacaggtgaggaaactgagggacagacaagacaagcaacttggatggagcccaggagacaggcccacggtctctgctctgtacactgcactgctacctccacacattctcaggtgcgatctttcttcctctttaggaacaagactctgtgccccaggaagcaggacttcactctcaccaagctacactctgcttcttattcttatttttatttatcattattattattattattattattattatttttaccagtcttgccctgtcacccagagtggagtgcaatggcaaaatcttggctcactgcaacctcagcctcctgggttcaaaggattctcctgcctcagcctcctgagcaggggtgattacagtcacctgccaccatgcccatctactttttgtatttttagtggagatggggtttctccatgttgcccaggctggtctcaaactcctgaccttgtgatctgcccgcctcagcctcccaaagggctgggattacaggagtgagccaccatgcacagcccctactccctgctcttgatgctgtcacttatagatagcacaggttctattaggagcagactcctcttgaagcccctcagagcgggtactggctactatcaccaagtttccctcagagtcactagaacagagctgtgcctgttgggcctcaacagaaacttgaactgaataaaagttcactagtctcagacatttagaacaacagactagatgttatttgtctgcaggatcttacatggtacagagaggattcttggaaacatgattgagcctcttggagaaaacaggtcattctgtgcctgtgtcagaaatcaataaatggcagtttaactctagtcccacccccacctgattgcaaacatggaaagttgctaaatactttggtacctctctcttccaactttaacaaaatgttaaaatacccatttctgttttcctagaagtatggggaggatgacattattttagatggagagagcacttagtttctcagagagaagacaggacttcgttcatcactttcgtgatggtgagcctatagatcttactgtatttgttctgctggttggccaggaagcaggccagttgagttacaaaacatttctctttgaggtttctgaactgctgtttcttctctgccagctggggatgcaatttctcgttgatttctagaatgttcatctctgccttctcgctggacaaagggccggctgataccaccatgctgacgtttgtggcagaagaggtggggccagggactggggagaagaaaggcaaacacatgatgggttaaaaactggtgaaatcaaataggtttaatcacactgagggatgtcagtggcagccttgtctacttatttgaaaatgttgtttccctggtttcactcttgtcatctccagtcttgatctcctttaagtcaacttgtcttagctatgcagtcaccttgaaaccaggacataaacacttctacacttttcttgcttataagtttctataaagcaaggctgggccctgagatttttaccccatgagtggccaatgtttctgtgtagcacaaaagattgcattttcctttttcgatatttttctcttttggttttttgttttttgtttgagacggagtctcactctgtcacgcaggctgcagtgcagtggcgcaatctcagctcactgccacctctgcctcccgggttcaagtgattctcatccctcagcctgccaaacatctgggattacaagcgccaagtaacatgccagctaatttttgcatttttagtagagattgggtttcgccatcttggacaggctggtttcgaactcctgacctcaggtgttccgcccaccttggcctcccaaagtgctgggattaagatgtgagccagcacccccggtcagagactttttttttttttttttttgagatggagtctcgctctgtctcccaggctggagtgcagtggcacaatctaggctcactgcaagctccggttcctgggttcatgccattctcctgccacagcctcccgagtagctgggactacaggcgcccaacaccgtgcccagctaattttttttttttgtatttttagtaacgacggggtttcaccgtgttagccaggatggtctcgatctcctgacctcgtgatccacccgccccggcctcccaaagtgctgggattacatgtgtgagccaccgcgcccggccgagacttcttattaatagctaagacaagccaatgaaaaggagagagagtctagcctgagaggagtgaaccagggtgggaggatcgtctcagccgatcctcccacctaagtctcctgagcagttgggactagaggcacgcagcaccatgcctgcctaattttttgtattctttgtaaagatgggtttcaccatattgtccaggctggtcttcaactcctgaactcaagtcatcctcccacttgggccttccaaagtgctgtgattatatgtgtgagtcacagaacctagctccatcctagtttctgactaaaagaataacaatatgtgtatatacagcctgtcctcagaattgatcttccatagcctagacagaggtatgagacacaaggaaaatagaggctacctgggagaatgtttacagcatcctgacattcatcatgagaggattctctgtctacaaccagagttgagttgactttgtcttcctcaaaggtgatgttgatgttcttgtgaggctggttggagtcacaagggctgtggctatttgaacaagtgatggcacattcctccagtgagtcctcagggactttgctttcttcagccttctgcacctccctgatgagccaggtgggacagagatgacagaagattaaacacagagggattggaccccagggagtcctagctggttttgacaggcggcattaagacagtggtcccagaaagcaaaatggaggttccctttaagggggaacaggcaatcctcttctctctgcaacagagcatggctgccatgggagccagagaggaagagagcagctggtgttcagtgcactggacagataggagctgaggaggatgaagactcagctatccctgtatggtacagacatgacacttggcacacatagagaaacacgacagctgccgcaccctgtgtctaagctgggttgaatttcacatactgtggccaagcgaatgcgggcttttggcccatcatagatgccagagagggtgtgcctcctacacattttcatatgttaccacccattacttgctcccgagtattcagtgttacctgggggcagatgattccagtactttctcagcctcctcaacttgaacatcttcatcctcatcttcgtcattttctgtaaatacaaaatgttcgttcagatatttcccacttcacattctgcaagcacagtcagcccaatgtgcacagagacatgaacatctatgtatggttcagcactgtactgaaaactgtcatattttatctttcacaaaatgccctggcatggtttcctggtccatcgggcaatgcatttctgatctggagggccaccatcaagatgtggtcaaatattgaaaagaccttttgcttcccatatcactggaggcttgtgcagcctctctctggactttggcagctgtcgcccccatcctgccacatatctgattcccaggaacaggcttggtgtcctgtcacagttcgcatttcaaacctcattctttctcttaggagaggacaaacttgtcccacagtcctctatgcatcatgagactgcacaggccctccatgtggcttctgctgtgttattcagggacattctatccacggggagtgctccagtctgaagcacttcctaccaccaaatgcccctacaccaagtgccttctccaacaccaaacggagaggggcttcatctcattttaaaaagcattcgtaagtgttcccatatttggatgcttcagacccttgcaagagacaatttgtttgcctttgcagatggagagagagaaactctggaaagataaatcactcactcaccgacagttactaagaacattgtcaaaaagacagcctgggaaccttcattcttagcccagagctcttttcactccaacaagcgccctcccatcacagcctccttcctgtcctttaaaactagacagatgctgcctcttgctccaaagaccaccttccatcaaggaaggagggacacttgcaatactgtgacctccaaccccatgggtttcccatctctgttcttacccaggaagtcctggtcatgtcatggccacatatgtatagcagaaaaaaaccccactgatacaactgtcattgtgaaagtatggaggtctggagcctctcataagcctggggttttgggtcatcagggcctatggccaccttacctgggctgagcttctggaaaagttgctgtgccagtctacacccctcagccagctgttcttggaggtcctgcccctgggacttgtctggcttatccggagtgaggagggcctggagatgctgattcaatgagcgggaggcatctctcccttcccgtaacttctcccttaactgggtcagctctcgttcctgagagtgaaccaggactttatattgcctaaggtgagacggtagagaaaatttaagagtggaaagggttgagtgatccgttcaaatattgcaacagagatttctgagacaatgtcctcaaggagacctccaagcagaaggtcagcacatgttgaaaggaatgactgtggccaagagaaagaatagaaaatggtttacaggcttcctctgtatcagagagggctcctgcaagatcctcgatgatgttccattcatctttcccttctgtaaacaaaagtaggtgtcttcctaattccgtttcaaaaagacatcctttcagttcctcactctggccatggacatttccatgtgaaaatacacatagtgcatcttgcggccactagatacaaagccatgtacagaaatgaggccaggtgcagatggggcgaattgaaaagacgaaagaagaaaagaatgacagggtcgagaaggcaacattgattgagtgaaagaatgagaagacgcagtcagtcagaaggtgattctcactaagggtaagtggggtggcgatggcacaccattttgagtatactgaatgctgctgtgtggttcacactcctttggttaattttgtgttatgtaaatttcacatcaacaattacttgtttgaaaaagagaaaacaaggctctaagaaacaactgcaacccataaatttttattatccttcttctctgcttgataaatacttgtgtgttgcgagcctgccatggcaattcctgcccttcccctggcccagcttagctcttacgtctccccaccgagctgctgtacttcagagatttacacagctgctcccctgcctgcccccatggggtcccctcacctgagctcctcagcttgcttgagctgctctgcaagcttctcctccttgaactgtcgctcattcctcagcataaattttatgaggtctttacactcttcatactctgagaaaagacagacacgcctgcctcagtggaaggctggacatgctgctgtggtcactgcctacagggcagaagccaggtccatcccaaggacaaaactgtcccccgtaccaggctctaggcagggatttccacatctttactcttcagtctcctgactttctggcatcttatcctccaaaatttaaagacgaagaaagagaaattcaaggcacatcaaggaagttgacaagatgattcaaccacaacgaagtggagtcagaactcacagcccctgaggtctgactctgaatgcggggccactttcccaagacttgcagcctctcctctgaaacactgcactggggcatgaagtagtgatttcttgtacagttgggaaggcccctaggactatgggactgacggtttcccttttactgggaatttcaaagacaagtatgcgaaagattttaaaaatctttgatttttaaatcatatcttcagttatgattttaagaatcatatctgaagcataaagtgtgacacataacaccataaggccatgaaggaaatatgcccaaatattttattagtatgacaggcagcatcaagatttagattagttgtgttaatttagaaacagcataagattagtttgtgttaatttagaaacatcagaatgaagaactaatagatagtgtttacactgtgccaattaatgttcaaggagattgacaggaaatacctcatgtaattcattgcagcaatttacagaggtaggtattattgtagtaccctctgaacagatgaggaaactgagggacagacaagacaagcaacttggatggagcccaggagacaggctgagggtccctgctttgcacactgcactgctgcttccacacattctcgggtgtgatctttcttcctctttaggaacaagagcctgtgcaccaggaagcaggacttcactctcaccaaggtactctctgctttttatttttatttttgttttatttatctttttgtttgtttgttttttgatgagtcttgccctgtcacccatgctggagtgcaatagtgcaatcttggctcactgcaacatctgcctgctgggttcaaaggattcttctgcctcagcctcccgattagtggtgattacagttgcccgccacgacgcccatctactttttgtatttttagtggagatggggtttctccatgttgcccaggctagtctcaaactcctcacctcgtgctctgcccgcctcagcctcccaaagtgctgagattacaggagtgagccacgttgcacggcccctactccctgctcttgatgctgtcacttatagatagcacaggttctattaggagcagactcctcttgaagcccctcagagcaggtactggctactatcaccaagtttccctcagagtcactagaacagagccttgcctgttgggcctcaacagaaacttgaactgaataaaagttcactagtctcagacatttagaacaacagactagatgttatttgtctgcaggatcttatatggtacagagaggattcttgaaaacatgattgagcctcttggagaaaacaggtcgttctgtgtctgtgttagaaatcaataactgtgagtttaactctagtcccacccccacctgattgcaaacatggaaagttgctaaatactttggtacctctgtcttccaactttaacaaaatgttaaaatacccatttctgttttcctagaagtacaggaaggatgaaattatttttgatggagagagcatttagtgtctcagagagaagacaggacatcattcatcactttcatgatggtgagcctatagatcttactgtatttcttctgtcggttggccaggaagccggccagttgagttacaaaacatttctctttgaggtttctgaactgctgtttgttctctgccagctgggggcgcaatttctcgttgatttctaaaatgttcgtctctgccttctcgctggaccaagggccagctgataccaccatgctgacgtttgtggcagaagaggtggagccagggactggggagaagaaacccaaacatatgatgggttaaaaactggtgaaatcaaataggtttaatcaggactgagggatgtcagtaactgaaattcttaacttactgttgtgaaaaatgtgatcactccccacagcactttaggatccttcaccacaaaaacaaggttcgaggtgcctgaactcagagctgaaagcactgccagtagctcagactctgataagagtgaggtagactgtggccagcgtgccaggtaaccgtctgcagttgcaataacagaattagaaggtgggggtgtcatggaatcttaggagccctgcattccaattgcccaggctttcctgaaacacaggcaccctagtctcacctgagggtcaccaccaatggggatcattccttcagcattcactctcagtattcgtgtacccttgtgatgatgccacagacccgtgtctttcccaatacatctaagcatattcctcactgtttatctcttgtctgtacaacatcatcaaggcagaaacagtttcccaacaggttgtattttcttaatggtagtcatgaagtcaccccacctgctctcagttaaaacagagcttaaggcctttccacaggtgtaagatatcaaacttttagcctgccctgatttcctctgggtcttctgcagttttgtctgtatccactagaaagtgaatgaataattcatttgtaaaaaatgttgtctttcctgtctcagtattcttcttgctgtttcccattgttatgttgatttcttttttctcactggggcaccatctttgcttttcattacactctagaccagtttgacatccctatgtccagagctcttcctctatgtgggttgatttggtttttgatgtcactgagcgctacattttatacttgtcacttatggatgtcattctagtgtcacaagagctcttttcaaggtatcaagtgatcaaaatcatttatatagagatctcctgaaaacatgtgtgaccatctatcttgggaagtttcataaacctgatgctattttgttgtttccattttgttttcccatatactgaaaagaacagggccatgagcggttcttatgcaatatggtttgatatatattttgttgagatgacctaacaccattgattttgggttgcattccactaacagaacatggcaagatcaaggttatggtcacggttggttggtgatcctcagtgttgcagtagaaggtgagtttgagatgagaggaatgagtaggaaagagtgatcccctgaaccacctcctcgctttctcagctttcaccccacctaggttttgtgagcctggaacttgggagactgttctgtagcccaggtctcctaagattggctgctggacttgcctgagttgagggtgcggtgggttgaccctgggctgcccagcattcatgtggtagtgaaggaaggaggactggatcaatcccatttcaaagcatgtctctctgcactccacactgtcctccaatgacactgtaaggaaaccgctttaagacgtatcaacggctttaagtaaatgtattttctggcatctgggagacctgacattctgtgtcataatgaaaatctgtcatgtttctttattttaaaaatgataaaactgcaggttcacagagttacatggcttacttgaggtcacacggggatgagttttcagcactgccaataaaagcaatcacatgaattattcagtaattattcataggatccatataattcagtaaatattcacataattatttactagttgttcattgaccaattcgtacaaggcattttgctcaaaactgtgtttatatttggacattgtatcttcatcataatcctgtggtaatgctgttatccgtaagtaacaggtaagaaacctgaagaggagggatagcaaatcatgtatttggacatatttcctttttttttttttggtttttgtgatgctggaagaatgaccagaatgagtcataggaagagtatacattcctgtagtattttccaggacagaggtgtgacctcctagagtactgggaccaaaattcccaagtgtctgcaaccttgctttaacagtatgggagatcacctctatcacctggaattcccctggaactctggaatatacaagagaagtatgagacttgggtcttcccttggctgtgtttaattcactcttctatggaataccaatgattctcactaagactggccttttcataagcacaatgtgcattttatggagaagattttacactttgctctatttagaaagaataaatatgagcagtggtttaggttttatgccctggacttaatatgtttctgattcctgttttgagattaaattctcatgtaaatagaaaaatacttattatttctcataaggccaagtttgttattagtttgagtttttgaagatgaagcacaaacttttgattttatctttgtctgtctctgtcagcgccactcgttgtctctcagtatgacctggacttgcccctgcacttacccttgtcctgctgaaccatctccatgcactgtccaattccatcagtgattcgggctccttccaaggctccctgaaaagggcacagagatcaggacattaggcacattccggacacaaaggcaacccatactgtagagtgggcagctgtgtttccacttccctaatattccagtgatgtcctcaaactgaaaggaacactttccctttttaggggtctgttcttcatgtctcagtgcctctgatctagtcaacacaactgtcctgaatgtgaaagaacttgctaaatttctagtttcttgttaggtggctaaaatagatttataagacttccttacttacccatgactgctgaagtttgaattcttagcagtacgattcgttttcttgtaaggtgagcagcttaggaaagattggccatcttcctgtgcaaaaagaggcaaacttaatttctactcaaagcatgcttgaatttggaatcagggcttccactcttccgaagttggagtgtcactgcgacaggcatgtgtcccgaagggctcgtgtctctgctatactcaaagtttaaatggagcccagcaagccagatgtcctttacttctaggttccctcaacagtttctcctccgctttagagaccgcattgaaaatattcttgttctgctgttgtgttttggctttggaatgatgtgatgcagctcaatgggtcccacccccaacttgatcaaagtaagaaacagctgggaaagtcagtgcaaatacaagttcattgtcctccttgcagggattctgattcagagggctcaggtggggcctggaatgtttgttaacatgactcagatgtgcagtcaatttggggactcactgacagcattgaccttacagtttatgggatgattctttctgtttggtgatgaagaaactgaggcacacagagtctgtaacttgcccaagttccccttgttgtaagtcctggagccagatctcaggtggaccagtgcttctctcccctatacctcatttctgagaaaaggaaatcttctgcaatttgacttctttcatctaacacatttcctcacaacatgcagccagcatcatattttggccacttactattaaagtgagatgcttttttttttttttttttgagacagggtcttattctgtcacccagggtggagtgcactggtgattatagatcacggcaatcttgaacttctgggctcaagcgatcctcctgcctcagctttccaagtagttggaactataggcacacatcaccatttctggctaattttatatttttcatagagacaaggtcttgctatgttgctcaggctggttttgaacttctggcctcaagcgatcctcccacctaggcctccaaaagtgctgggattacagaagttagccactgaacctggccctgaaatgcttttatttctttcttttttttaatgaaaatactggacatggagatgtggaaagacaccttgctttattacttttgttgttattattatttctacagtagaatttatacatcacaaaattcaccatttttaagcatacatttcagtgtcttttaccatattccaaaactttcgcaaccatcgccactacctaattccagaatattttcataatgccaaaaagcatgcctgtacctatgggcagacactctccaattccccccttcttgcgctctctgacaaccactaatctaccttctctatatattgatgtacttgttctgggcacttcctctatatggaataacaaagtgtggtattttctatctgcttcttagaatattgttctcaagtttcatcctttctagcctgcgtcagtacttcaactttttatggccagataatattccactatatggttataccacattttgtttattcatcaactcatggtggtttaagatgtttccactttttaactattaggaataatgctgctgtgaacagctttgtacaggtttttgagtgaacatctgtttttcattttcttggttataaacctaggagtgcaattgctgcatcatatgtcactttatgtttcactttttgaggaactcacacactgtttactaacttcagtagctatatcattttagattcccaatagtaatatatgagaattccatattctccatcacttttgaaacatgtgttgtctttatttttttcttaagtcatactgctgggtgtgaagtggtatctcattttggtttaaatttacattttcctaatgacgaaaaacattgaacatctttgcatgtgcttcttggccatttgtgtgtttcctttagagaaacctctactcacagctttttttccccattgttaaatgtggttgtcgtttattgctcagttatatgaattccttatacactctaggtactagacctgtgtcaaacatacaatttggaaatagttctcccattatgtggattatcttttcacttccttgacagtgtcctttgaagcatacaagttttttattttaatgaagtccatttatctatttttcggttgtttgtgcctacttaaaaaatgtctaatccaaaatcacaaagatttgtacctaggtttccttcaagacatcgtcttttgaatgagaactttcctgggttttagaggagggtggacattgtttattgatgcctcctgtccattaccgatgtttctcttgattgttattcatatgctcaccacccctccatggagcatccatggcctgtgacagagctctggggactgatatccttccactgactttggcgctggtgagagccctggtcatgtgattcagcttggccttaacccgacccagttgcacatattcctcaggccctttagagttgaagtcgagacctctctgagaacgcttgccagcccatgctcttctaaggctggagcaaacttcctccatctattccagacagaggggactgcaggggttggactcactcaagatatctctggtgttagaaagaagacctgtttcaggctttggggaagattgttcaatatgaactaggtcctctctaattatttttaccgtatgtgtgacttctttctagaaacaagggaagaatatttatgttagaacattttgtctattctttgtcaattgttgtttatctacaattttaacatggataaaggagagttcagtgtcaatatattcttaacaactaattacggctcatgtccaccgccatgcgatcatatttaaatctgtcaactatcctgttacttaggtattatcctgttcctgatgagaaaacaaactcagaaagattgcaaaatttccctaggtcacaaaactagtgaggagaggagtaagaattagatatccgttccttttggccttcaaagctaaccttgtaccattagatcaaactgatttacatacttttgctggaattagtctcagacttgtggttctcacttgattttcccaaggaaacagtgtgccactttaatatcatttcaaactttgaaatttaaaactctttttattatacttttttgtctttgttctattccgttgcttttggtttcttctcaacggatccctcttatttatatgctaaatatttgttacctattttctgtcaattttcacctttttgagtgtttgttatctgtctgttgtatgctaacagtttttcactgaggtaaaatttgcgtagagtatactgcaaaaaaacctaaaggcacagcttaataaattttaatataattataattgtaaagtaacacccagttaaagacagagaacattttcccccatgccacaaagttctgatgtggtccttgccagtcaatactcatcccccaaatgaagaatatattctgaatgttgtcactgccttagcccctttgtgttgctggaaaggaataccagaggctgggtaagttatcaagacaagaggtgccttttgctcatagttctgcaggctgtacaagaagcatggcccccgcatctgctcctaatgagggcctgaggctgcttccacttgcagcagaaggtgaaaaggaaccagggtgtgcagagatcatatggcgagagaggaagcaaaagagagcaaggaaaggtgagaggcactttttaataaccagctcctacaggaactaagagagtgagaattcactcactaccttctcccagggtggggattcatctattcatgagggatccactcccatgacccaaacacctcccatttacccccacctccaacactggggaccacatttgaacatgtgatttggaggggaccaatatttaaacttagcagccaccatagattcattttgcttgatcatgtgcttcataaaaatggaatcattttggctgggcctggtggctcatgcctgtaatcccaagactttgcaaggctgaggcgggcagatcacctgaggtcaggcgttcaagaccagcctggccaacatggtaaaaccctgcctctactgaaaatacaaaaaattagccaggcatggtggccggtgcctgtaatcccaggcaccagatatgtactggtatctcatatgtacaggacatgtactggtatctcattgttgtattgattgatgttcctgatggctaaactgtagagcatcttttcctatgctaattgaccattcatgtatcttcttttcttaagtacctattcaagtcttttgagaaattgtttcattgtgctgtttatcttattaaacttatatatatatacatacatatatatacaaatacactctaaaaaacccctttgttggaaataaatatatctcctatattgtggtttcttttaatgttctcttaatgttccctgtttggagataacgatagataatcttcaaaaaggtgaatatacacacccacacccacccacacacatacacacacacacacacacacacacacacacacacgtgagccaccggatccagcctgttgaatttatttctaagcacaacatgtatttagatgttacttgaaatgaaattgtatttttatttcattttccaaatgctcattgctaatacacagaaatacaaaagactacttctattgagcttatattctgcaacattaccaaactcactaattacttttggcagatttttatagatttctaggattattaacatacacagtcattatctgtgaataaagacagcttcaattctttcttttcaatcttttcaatacttttatttttcttactttattgcattgatttagatctctagtataatgctgaattgaaagaataacaacagatattctacttttttctctgatttaatagaaaagcattcaatcctatgccatttaatataatgttacctctgagtttttttcaaatctacccttaatagggttgaaagtgttgccttctcttcttatcatgctgagagttttctggggtttgtttttataaatcatgaaaaaagttttcaattgtgccaaatgcttttactgtgtatgacaaggtaatcatatggtttttctcttttgccctgataatacataacattacattttcttaaatataaaaaagatttcttgaatcaagctaggacagtttttttaattataaacttttaacaaatatattgaaatataacttacatgcaattgagatgcatgaaagtgtataatcattaaagtgtataattttaagagtttgagcacactatacacgagtcaaagagaaaggacagaaaatactaacgatggctcagcacatgtggtctatcttgctgaatgctctatgtgagtttgagaagagttatttgttagctgttcttagatgtattttgcttaaatatcgacctggctaacatgtgtcattgattgtgtgaattaattttgttctagtgggcagtaaaattactgtctgatcactttggacttatgtggactggttcatgttttattacaacggattcatggaaagcccacagcatttcccaagaccctctaatttggcaggactcaatcaccaatccacccctttgtgaatttgtcagggtttgcttttaggctttagcaggttggtctacaataggccttattgaaaagtgtgacacttattcctaaagcacatccattctagtgtctcagttggatacctgggtgctaatgaggtgtgcatgagttcttcccaccatggatggcagaaactccatcatacattccccaaccctcctccacctcaagtacctctggtccaaactcaatttcatagcagccacccctctgttaaatctgttagtcttttccttgtgcaggtagagtccactccttgataagtatgcacatggaaccccacatagactttgagagctgcacctttgatcagctgtctcctcactggtgccctgccctgcagattgcagttgcttcagccgtcttgaactctgatctctgccttctcagctcagtgagctgccctgccctgagtggactctagctcactatgcagctgctgagaaattctccccaaacaactaggaaatcatggggcttcccccttaagttttctcttggactgcctgttgtacactgctgaaaacaattttacgtttgtttatggaggcagggttagtctgatatgatttattctaacagacagaagcagaaatctgttatactcttttaattactgtgtctttataatattatggtagacagaatcctaagatgacccccagtgatctttgctcttatataatcacttcctcctgagtgtagacaaagctactgaggagatgtcactcctgtgattgtgttacaatttatggcaaaaacaagttaacagatgtaatcgagatcccaaatcggtccaatttaagatagacagattatctgatgagcttgacctagtgaacgtgagttccttggagggactgaggacttcctggagagatgtgaagtgcaggagggtttccatgcagggcgatcctcctctgctggctggaggaagcatgcagtgggaacatgggaggcctctaggagcagcgagaggcccctggctgacagccagcaagaaaacagagatctcagtcctacagtcacaaggaactgaactcagctgacaacctgaggaaacttgagaggaagttcttccccagaacctccagaaagaaacccagcctaatttcagcctgtgaggccctgagaagaagacccagagaatccaggcctgaacttctgatctgtggacactgcaagaaaataaatcattcttattttacgccgctaatgcttgcagtaatttagtatgcagcaatagaaaattaatacaaataaaatggagaaggctttggagtggggacaagaaggaaacggtgggagagggatgcctgtatgctgatatggttgatgcctgtatggttgaattgggtctaccgttcctcatctaattagctatggtctattaaggtgcatagctacacacaaatattggtactacgttcaattcagaggaataagatattgcattcttgacagtagacaagaacaccctgaatttggggtcactgtatcataagtcatgttatcaggtccctctaggaaggcttagaggaagatttccaggatacacttgtgacaacattgaaggcttcttttttccccaaagggacccgatctcccctcagtcgagaagctccaagtctctgaactggatgccaggttataaattccccctatactgactccatcaggcttctgtcctcagaactagagtttatcagtaaaagatagactcatgggagtctaggcatttattctcttattttatataaatcagttaatgtgcaggaacaaaacagactttgaagaaagacactcacagttgccacaggaaaacaccttcaacatcctcatgagtcatcatgggtgttctgttgggaggacttgataggaggctttcctcctcacgggctagtgcagatccaggggaaatgtcatcaagtcctccattcggagggtagcagctgaggctgctgattcgttaggcctcctgcagctggagatgcaagtagtgcattttcatggccaccgcagggccctcagtttagcattcttcagagccagcatccaacaagccacagaagctctgagtatttccctttcttcagtcacccacataaatggcttcagggccttctggggaaggcctgaaggaagatttacagcatacacttgtggcagcattgaaggcttcactcttcctcaagggatccaatctcccctcagtcaagaagctccaggtatctgaactggatgccaggtcataaattcccactatggtgactccatcaggtctctgtcctcagaactagagcttttctaagtgtaacgtaagttgatttcttagtagatgtcccatccattacattcccagacacctcacaatgattcgaatgattagtaaccaccacatatccctgcctctcagggaaatccctcccgccttgtctctagatggccaagtcccacggcctgtcctctactcttccagaaccctgttgttctcactgacagcagggagggcaaatccatgcagcagctcccgccatgacctccagcctgcagaggatgggcgccacaggacttttaaacgcatgccgctgttcccctcacctgtgcatttcttaacgccttggtgaggagaatgtctctggatcttccttgatgggagctaaaggaacaaaggtaaataatgctatgggacccactgagaactggggctgtggaagagtggccactgaagtaatagacagatgcagctattgccagatactcagtgccagagcagggagggacagggaagaaatacggacctcaccttcctctcacttccaggatccatcgggggccctccattgctaaacctaactagaagtgtgcacgcacgggagccagggatgcattctaggagggacgagccccgagtggcatgagacaggatggaaatgagtggacagtggatctgtgggaagaaggaggggatgttatgggaaaacaaaaggagaatactagctaagaacgctaggtgacattaatattccgaagtctgtgctcatattcagcaaagaaagttcagcataaagcactaaataaggagtcaagatattgtacttccaactgttgttccaacagctgtattatgaagggccactttatttcatgcctttctaatttgacctaaagtgccaggtggcactggggctggcacagccttgctcaattatgtgttgcagagtacacagagactgccaggctgagggaagatgcaagagaatagaagagatgctctcagggaacaagagaccacatggccccagagtcaggggcagcatcagccactgtcagctgctcattttcccagacagagcccacaagcctcagccatgctttgcttctgcaagacgcttcttcaccttttcaataaacctgcctgaatttaagctgacagggtttatttctccttcatcataaatgaaattcttcaccacaacaatctccaatgaattttgggcacagcaggcaggcccatttctgcttctgttccactatctctcctgtaggttgaaaaggaggaggtactgaattacctccaaatgttcctctggctctgatattctgttattctggttcctttttggctactttgtttttggtagcgtgtatcctaaggcgtccagttgaacaacttttgtctactgtgtccaggcattcctggtggtatttcagataagactctcttgggttgctgaactcacaaccactgaaccaattctatgaccatctgtttcatggccacatgtttgctcattttatatgtacataaagggaggggacagacagcaaacttgcgtgttacaaattgtatcatcttaaaaaggaaacaaggcaacactttgcaataaaaccttaagatgcatgaaatttgagcctaatgcaataaaggatgcccataaaattcttatctaaagaatgtttcgaaaattgttgtacaaggacatcatcatttaaagtgatatgaagaaaccttctcagctaagcatatgggctagattagagagaaaaataaaggacccatctctgccctggaaaaactgctggtagcatctttcaaaaagctctctgtgtttgagtacgcaccttgatccataggctcacatttgatcccaactggcagctgcttcttggcattaacattggattcccaactagtaaatcttaccaagatctgactttctgcagatataatattattttgtttgaccatccttatcttcaagggctaccaagaaggaaccaagaatttatttacctccccaagggaaaaggttttaccaatgagaccctttctcaccatgaccccaggaccccatatgccctgttcacttgagtgccctgtgtggcctgatagaagctcatgctggtcacaggattccttatatgactagcctccttcctgaatcccaatttcatggtggtggtcatgacaggtgtcctgtatcccatgctcatgtccctgaagtcaccagcctatctccagttagaaaaaattacatgtatatagagaggcctctttggaaggagcaaaagctttctcaccttcgtacactaatggttggaaggtacaacagcatatgcactttgggaaaaaatatctggcatattcttacagaaacaaacaactacctattctatgactcagtaattcctaagcatttatccaagagaaactaaaacctatgtccagaaaatgacttatacaagaatgttcatagcagttttattcataatacaaaaaactggaaacattcaagtatctgtcaatacaagaatggatcaataaactgtgatacactcattccatggaatggctaaaggaacaaactggtgacacacagaacaacatggatgaatctcaaaaacatttggagtgcgatagaagccatacccaaaaaagtgtgagaaaaaaagataaataataatggttccaagaaatgcacagcagacagcccagaggcaaagacccacaggacggcgggccggtcccaggctgtcgatcctaattaagaaacttctgctggattttgcccagctccatttccaaactattttgggtcagtgacttctttatcccttccatgttgcctcattttgaactagaatcactgtaagtgttattctatgtctgtcacatcattccacagtaggggcagataagctgtttagaatggctaaaattcaaaaaggtgaacacaccaaatgctgtcaaagatgaggagcaaccagaactttccatcgctagtggaaatcaaaagggtacagtcactttggaaaacttaagttcactcaaaatcctgcacagaagtacttacagcaattttattcatcatcgccaaaacttggaagtgcccaagatgtctttcaccaagcgaaagaataaacaaactgttgtagccatacaaggaaatctgattcactgattttaaaaaacaagttatcaagccatgaaaagacatgaaggaacttaaagtacataatgctagaaagaagccagtctggaaacccacatactgtaccactccaactctaggacattcttggaaagtcaaaaagatagaagtagtaaaatggtgagtggttgtcaggggtggaggagaggaggacgcgtgaaatggtgaagcacagggaattttcagcagtgaaactctttcgcatgatgctgtattggggatttaggacattatgtaattgccaaaacccataatctgtgaaactcaaagaatgacctctaatgtaaactatggactttagttgataatgacgtatcaacagtggttcatcaattgtaatgaatggaccacactaatacaacatactagtagggaaaattgtgtgctggaggacaggggagcctaggagaactctctgtattatccactcaagttttctgtaaacctagaactgttctaaaaaataatgtctattaactgtttttttaattaggatgcagcagccccatatcaaggttttggtggcatcctgtaattgtgtggttagtacttggcattgaagtgcaccaacctggagtcagagcagttggagatttcaaggcctgtgccatttacctctaaccctggggtgcccctggaatacagatagcagatcggttaaggagaagcagcctcagcaatctagacagtgcaggtttctggtgaggacaggtaaaaaccatctgggtgggcagaacttggtgaagaccagaaaccactgagactcagcagctgccgcagtggcacccacaaatcaaaggagggggctgggaagagctaagggctactggatgagctctctgcctgcaagacagaagcagatccagagattttggaaaataatgtaggtttcagtacagtgtgatctcttcaaaaaagtagagagaatgaaaaggaaagaaaaagagagagcatgagagagaaagaagaagaaaagaagaaaggaagaaaggaaagaagggagggaaggagggaaggaggaaggaagggagggatggagggcgggtgggaaggagggaaagaataaaaagagagagaaagagagttggagggaagtagggaaggaaggaaggaaggaaggaaatgaacaaatttacatgaagatgagaacagtggggaaacttacaccaccaatattttccattaacaggaacacgctaagtagttattagagaaagacacgctactgtaaaacaatatactgtttccatggggtacaacaaccccttcctcctcctctgaaacacattctatctctggctcactgttgccagagacactgagtcttgtctttggatacgttctggtgcccacaagaatgagatgagacagtggatcccagaacaccaggccacgaacttccctgttgctccttgtccactccagaagctacccagctgcagttggggacctcagcccctgggtctgatgtcatccatttgcctttctcaatggacttctctccttgcactggctcctactcccccaggacctgtgggtgaccacatgagaagaacacaaacaggccatgcccctttctttctccccctctcaatgcctgcagtagtgggttccatggggtagtgacctgagatttactcattgtggggcctctagcccagagcagggcctactacctcacagtcaccccatgaatgctcagtgaaagaagacgtccaccacaaggtcctggggaaccaagaattccactgtggcccataaattctaagtctacaggattctggaatgggagatgggaaaggccttcaaaagtggccacttttaacccattatactggcaactgagccatgtttccccatcctggacacatccagagggcactgcctaaaaccagacacatctccccacccaggacagtgtaggagccttagcctgggggatgcaggtggacagggagggggtgagccaccaaagctgaagagcagaaagcaggtgaaaggggacagcagggtggaaacagagagaaatgggggcagagaatggggggtgagaggggaagagtgaggagagggatgcagatctagctagtaaggaaaagtcctggagagaacactgtcctctcctgaagtaaaatcacttctacctgaccacggcactgcagctcatgggcagcacatgctgtggatatttgttcattcatttaacaaatatttatttaatatctgttgcatgccaagcaaggccctgcaatgtttagggaccttgacatcttcccttcacatctgagtcataatacaaagaggactctctgaccccactgagctggcaatgcctcgggatttttacctgttggatctggcagctcttgatgtcagcccacaccatgtgaggctgctcttggtgcacccaatggggaagtttctacatcagggcctcggagaatccactggaagccctggacagtgggagtcagcggcatccccagtgtggaggccaagagcacacagtgcttaagctccaggcaccctcaggaggacggcaagggacaattggctggtgagagcccgggtcaccgggaaccttcgcctgggtctaaacaggatttgccttcagattgcctgtgagataaaagagagaaatcaaggttaacgttgagatttagggcttcggtaacttgaaggatggagctgccatttacggagactgggaagacccagggaagagcagattgaaaggtggtgggaactagaggtggttgggtttctgtcatatgtaatcaacagtcctgaccagcctgggcaacatagtaagaccccgtctgggaaaagaaaaaaggaaaaataagctgagcatggtggtgcacacttgtagtctcagctacttgggaggctgaggcaggaggattccttgagccttcagttagcggttagtgagctatgatggcaccactgtactccagcctggggggaaaaaaataaagagtcctgactaaatactagagtagccagggaagttttcacaaagtaagtaatatttgaggcagatcttagtgaacaagaattccattatttctgttagggaattaagagagtgtgggtgtcgttagttaatgcttattaaagtagctttggaatctcatctactggtctagctggtctatctgtacacgtatattgtatatgctgtctctctgagctttcgctaggttatgctacggtaacaaaagccccaaaatcttagcagctacacatacgaaggtttatttttcattgacatgtccttttatggcaggttgactgtgactctactctatacaagctactttatttgttagatggtgaaaactgtgatactcggaggttgttgaatatggtattagtatgttcattcattcattcatttaagaaatatttattcaatatctgtttcatgccaggcaaggtcaagtactgagaatacactggtgaatcaaagagacaaaatctctaattgccaggagcttatattgaaaatcagattaaacacatacaaaatcatcataataacaacaatgaatactatattcataaataatagctgtaagagattttagtacatcttttaaattagaaaaatataaaaattattaaaactaaaatggccaggtgtgatggctcatgcctgtgatcccaacactttgggatgccaaggtgggaggatcatttcagcccaggagtttgaaaccagtctgggcactacaggaaaaccctgtctacaaaaaggagaaaattagccgggcacagtggtgcatgcctgtagacccagctactaaggaggctgaggtgggaggagtgcttgagcctgagagatcaaggctgcagagagccatgatcataccactgcactccagcctgggcgacagagcgagacactgtctcaagaaaaaaaaaaaaattatttgatgtagtcctaaaactattatgtagaatactattgtttatatcacagcacgtgagccccttaaatggcttaacacttatttaggtatgatccataaagcttttctggtaattaagtatacttaagaacaattaagtataaaagagttactgccttgacaggaagattgtaaaaattttaaaaagacaaataaataaaagagtaaaaactgtagctctgtgaggctcaaataacatctaattcaagtcacaatgaacatctagcaatcattctgaacaccatataattcacttaatacgttttgcctgaacacccaacacatctgaattaccaacacccatatgtagccaagaaactggcaatcatttataaattatcacctatgactccatctgctctacgcacttattttttaaattttattcatttatttattatttttatttgttgtagagatgggatctcactatgttacccaagttggtccagaaacagaaacagacccacactaatttcataaatcagatgaccatacagtcattcgatttatgaaaaaaagtgccacatggtgcggaaggaaaaggatggtcttttcaataaatggtgctggatcaagcagacacatccatgtagtaaaaagtgaatcatagccaggtggggtggctcacacctgtaattccagcactctgggaggctgaagcgggcagattacttgagcccaggagttcgagaccaacctgggaaacatgttgaatccccatctctacaaaaaatatgaaaattagccaggcatggtggcacatgcctatagtcgcagctactcaggaggctgaggtgggaggatcacttgagccaggagatggaggttgagtgagctgagatcctgccaccacactctagcctgggcaataatagactgaggccctgtctgaaaaaaaaaaaaagcaaaaactaaaataaaatcgttataaggttaacacagaaaaatgtgttcatactcttaggttaggcattgatttcttaaacaggacacaaaaaacagtaaccataaaggaaaagattaataaagtataatttcattaaaatgaagaatctcaggctgggtgcagtggctcatgcctgtaatcccaaccctttgggaggccgaggcaggtgtatcacttgagcctaggaattccagaccagcctatgcaacgtggcaaaacccatctctactaaaaatacagaaaacagctgagtgtggtggtactcccctgtaggtcccagctacttgggggctgaggcagggggatcacctgagccttgtgaggtcaaggttgcagtgagctgtgattgtgccactgcactccagcctgggcgatggagtgagatcctgtctcaaaaagaaaaaaaaaaaaagagaatctcccttcatgaaaaaacaccataaaagagtgaaaacgcaagctacagattgaaaaaagggaaatgcaatacatataaatcctagaaaggaggcatatccagaataaagtattacaaatcaacaggaaaacaagcatatcaatgaaaactggataaaaagatttaacaggcacgtcacaaaagaggacatataaatggcaataaaagatactcaatctcaatgaaaccacactgatatattactgcacccctactagaatggcaaaataatttttaactgacaggtatcagcgaagatgtggggtaaccagcatatccctgctaaatggtacaactactttgggaaaatgttcaacaatatgtaatactaaagttttatcattcatatacctctaaaaccaacaatgccacccctacaaatataccccagactagtaatgttcaatttcttgatctgtggtggttcacttggtaaaaattcattacttttttttttttttttttgagacagggtctcactctgccatccaggtcggagtgcactgccatgatcacggctcactgcaatctcaacctcccgggctctggtgatcctcccaactcagcctaccgggtagctgggactacaggcacacgccaccacacacagctaacttctgtatttttagtagagaaagggttttgccacattgcccaggctggtctggaaatcctgggctcaagtgatctacccaccttggcgtcccaaagtgctgggattacaggtgtgatcactgcgcccgggccacctgcacatgtaaaattgtgaacttctgtatacttcagtaacttttccaagatttctttgacgcaaagttctcagaaatcttaaagctagcatttcagaatagaaaaagtagcttctggttcactagtgaaattttaccaatagaatttaaaaacaaaaagctactaacgcatatcagctcagaacactaccagcagatcttttctttaacttcctgaagcactgggattcattcttttggcaaagaaaggatgaacaacactgtaacccaaagaaaagataccactgccagaaaagacttcttttcgaaagcagctctaagcaaaagataggaggaaaacaaggaagccaggccaaacgtcttggttaactctccgctgaaaggacgccacatgagatgatctaagaagccagccagccagccagacgcagggaaatcacagcaactctttggagtgcaaacagcaaccccacaatccaatctacccgaaatcctgcggttcatttgaggcttgccccgctagtcaggaggtgattcagtgatggctacaaatgctgctcatgtgcatcctggagctggcacacctggcttgcccatcaccagcctggagacaccgccaggagcagaagcccggaggccagtaaagaccccaactttgcaagtcaggggcgcgagcgcgctcgcctctcaggtccgcagagggaacggatttctggcctggagggtggggtgcggggtcagtgtcctctacaggatataggaggacgtgcccccgaagctgctccgtccctccaccccctgggatgccacagaacacccgccagcgagtttcttccccagcgcccacgagagttgggctgcgggcggcagcggcaggcgaagaatccagcgcggggaactcaggccccggcggtgcacgaccccccacagcccccacccgcccccgcgctcgcgcaacaaaacttgccacggccgcgcctcgacccagctgtgcgcccgcgggtcccggattcaccgcccgcccagcctggcgcggcgccctcacctcagaaacgctgggtggacttcgcgtaacttcccattcacagggcagccggcagccgcgccgccgcgcctcggcccagctcctggcgccgcagatcgcccgtcccgcgttcccaaaagcaccgcgctcgctcagaagctcgggcagcctcgcgaccctcacctacgcctcccagtaccgccgctgtctcaaccgccacccagcccctcgcctgcgcctgcgcctgcagcccactggctcctcaggatcccgatgggcgtgtcaggataacccaaggcgcaggcgcggcggggccttaaagggacccggcggcctcttctgcacaacgggttcgagcaggttaggggccgcgcaggcggaggaaaggagtaacccaggggaaggaccgagtgcagcggggacggggaaatccctctctcccctccgcctgtctttcaaagcaccagccctcgaccctccaaatcgctggtttccccggccacttgaacagcccctgccaggttgaagaggcaggagacacaccccctctggggctggagcgaccccgcgcttaggactgcaggcctcgcgctgccgcaccgccccgaatctgacttccaggcacgggcacgcggtgcagtcgggcaggcttcagaagagcccccagctctcccagaggtggccttaggtcactctcaaaaagaataaccaatgtgtcaatggcacttgtagttattttctaatttaaatttattaacagattttgcagatgggcttccactgaaataagcctttgagaaaaagaaaaactttttttttcaacaggattagaataccaagaaataggaagtaaagccatgccgtccacccagctaaaaactttgaaaacttgatattttatctaaggcaaatgtttgcataactttaggtcatgccattatttaaagtcaatttcagttaacaatttcattgcaactgaatctatcttgtataagaaaactaagatacatccctgataatctacctctcccctcctatactccatccgtcagcaaatcctactggtttttaccttccaaattttccttgaatctgtcctcttctatctcctccgtcaccaccctagtctaggctgccttcacctggggagtgagggtcgagggactactgacctagtcttcttgtggtttacccatatcccctttatcgcctctctaatctcaacacaacaggcagagtggcttttccaaaatataatgtgaccgtgtcacttcccagcctaaagcacttaaacaccttcccattctcttagacaaaacctcctaactaaccaagccccgaatggccaggcgccttgcccacttcttcatctcttctcactactcagaccaattctgttctgctctctctgctccagccaaactggcctcttttattccctatttaccagcttcctggcctccacagagcttttgctcatgctttgctctgtgcctggaaagttcttctaacccctattcttctgagaacagctgtagtctccacctctgaaaagcaccttctgacctccctatggtggtcccttactcctatcacattgcatgaaactgtaatcgggtggttattttggtgaattttttactatcggctacgtaagcccagggtttggttttgtttgcttcatgatttgtatttccacatttgttaaatacatatttgttcataaatgagaatgatggatgctagaagttgaagtaaatttggcataaagtcagagaaagagaaaatgtcacaatctgacagttggagtcagaatgtagaaacttcagttatattaaaactgattttatatcgttttaggctgagttgtcttaggatgctttgggtaacctttaaaactgagttctcaaagagccttgtataaacacctgaattaataatgataagccatggggtggcccacataaaactaataacattggttgctttaagagaggaagactgagccaggcacagtggctcatacctgtaatccaagcactttgggaggccaaggcccgcagatcatttgagctcaggagtttgagactaacctgggcaacttggtgagaccctgtctctacataaaatacaagcaaaattagccaggcgtggtggcgggcacctgtactcccagctatttgggaggctgaggtgggaggattgcttgagctcaggaggttgaggctgcagtgagccatgatcatgccactgcattccagcctggatgacagagcaagatcttgtctcaaagagagagagagagagagagagaaatgaagactggtgactggtggctactggtgggaaggagatttttactaaatgcccaaaaggtttaaaattgtaacttttttatttcaaagtctgtgaagataaatgacacaaaagagcacataccttcccatttatttgaaattctagaaaggggaaaattaatctgtggtgaaaaaatcatagcagtggttccctctggcaggggattgactgggaagttacatgagagaaatttctgggtggtaaaaatggtctctgtcttgatagggatatgagttatataagtgtattcatttgtcaaaaaacatacagttaacatttcaatgaatgtaaattttaccttaaaaactatacgaataaatgcaaatttaaaatctgctagctaacacctagttgagtactcagtgtctatgggcattggccgaggctatacatacacgattttctttagtcctcataccgtcctcatggggtaggtattattatcataacccccttgcatatgaagaagccaaaatgcagtaaataccaaataacttgcctcgatttatacccctggaaaatgcgggaagagctttaaacaccatcagtcaaatgccagaagttgttaaacattagactctatagcacttctctgaaattatagtatttttggtatatgtatatatatatatatatatatcatctactagatcaagagcttcacaatgattgaaatcatagtttgtctttttgtttgaggtttatgtttttattttacttcattattttaaagactgagtctcggccgggcacggtggctcatgcctgtaatcccaacactttgggaggccaaggtgggtggatcacttgaggtcaggagttcgagaccagcctggccaacatggtgaaaccccatctctactaaaaatacaaaattagccaggtgtggtggcacgtgcctgtaatcccagttactcaggaggctaaggcaggagaatcgcttgaacctgggaggtggaggttgcagtgagccaaaattgtgccactgcactccagcctggccgacagagtgagactccatctcagagaaaaaaaaaaaaaagactgagtctcactatgctgcccaggctggacttggactccttcattcaagccatcctcctgcctaggcttcacctgggactacaggcccaatatttttgtcttaagtttctaagcagtcccaagactttgcacagtagctgttcaatgtattttgagtgaatgattaaaaacaagcttgatgtcgattttattggtacaatttatatttacatatgtaatatttatatgcttttatatatttatgtgtgcatgtatataattggtactaacttagcactgctgtgcctaagtgcctgagatgcatctcaaatgaataggcctgaggagagaagcttgtgtcattagctctgaccctgcagcactaatcctggtttacccctttctttcagtctccctgagcacaatttatttgctgaaaggccacatctcactatggagtgaggatcaagaagtaaaggtctgaaagagagaagctgcggggctggggagactgttggtcggagaggcgtcgggggcccaaggaaaagggaggattgtggggaggaatcggcgtagagatgagaggagcagcagagacagagtctcacgcagaggtgtgcccagacaccctgaaccaagttacttaacctcgtccaccaccgtggcacccgtggggtccgtgggcccgtcggtcttccaggagggattctgtgtccctgttattgtgtgtcaacatgtgttagcctgatatttatatttttaatgagagaaaacgaactctggaatttgcgaactgttttttcgttttgctttatacctcttggacactccttccgaaggattgggtctcaagggcagtggggtgtgactacggtagacagggctgattaattttcatccaaaactctttggcggattcccctgctctccgcttctccggtctaacagtagtttaaaatagaagatcagcaacatttggagagtttttttctttgcattttaatgataaacttgatttattccattccaaaagttttcttattctgaggttgtctttctatattttgagtataaaacaatggccatactatgttggaaccaccaaggttcttctcttcacttgttcatttgtaatgtctctttataatctgagaatttcctgagcaaactgggaactgttatacataattccttgtttttcaacattctttgtaaacaggaatcaggattggggatggggagggagggaggagtaggagtcctgatttgtggaacagaaaatcatggattacttatgtgatggagcaaagggtttaaaaactcttagcatccccagatttccccttttactgtttgctgaagaaaattctgtctttgactcccttccttaccctctccgggcctgtgagaagcttcctccctatccagtttatttcctcctctgctccccgacccaccccccacagccccctcctctttttcagtgaagccgctggaggaaagtcgggtttgggagaagacccacacaggcaaggacagcaggagaacactgacatagttacactcttgtcaccagcacttttattaagacgtgaaaagacaaagacaacagaggagagcagagaataatatctctgtttcagctattccaggatgttatgccaattatccagagtccttgatctgatgtagtaaagagctagggacattttccctgaaggctttgattgctggcaaaatctcattaaacgtgtatacattcataggttggccataggatggataaaagaagagcctctggcctacatctgccacgatacatgtgcaaaaatgctctctgcagcattatttttcattgtaaaatagcagaacaaatttattattcaataattataaaatggtcaaatgtatgtgactatatttggacaatgaaaaatgcagctgttaaaagcagacaatactgatgattcagatgatgttactgatgaaaataataacagatgacaattattgagcatttatggcattcttacaggcattaccttatttaaagttcagaactaccaaggaaaagagtaacttgtggcaggcgtgagaggttccgaggcacaaaaggaagataggcattcaaggaacaccaggatagaagacccagagtaggagaagagagaggaagaggagtccgccagatgggatgctggaaaccgcgggatagctcggtggagagagggcgctcctgctccgcaagcctccctacgacggcaggcctacccggtcctgctcctgccggctctgggcatctggtttctgccgctccatctccagggagatggtggccaggctgtgccgtgtacccatcaacttctctgacagcgccatcttctcagactccttcagagacaaggcctgggcagaggcaggggacaaagggcttgggggatgggctggtcctgggggcatgctcaggcttcttgctgcctaggaaatgtgcccactgggggcttagaggcctgagtgtgccactgcaggtggacccagggcagacatgcagccctggaaaagggcacaacggcagtcacaagaatcccggacgtggataccactcatagagctcactaacccgccacagcaccctgactgcagagtctttctttctacccatcttacagatgaggaaactgaggctcaaggaggtaaagtgactcgcccaggtacacagctggtgaggagaggagatgggcacagtctgccctgtctccgttacattataggaaagttagggatttgttatttggggggacacgtcagctgatgcctgtgggcatcgtggggactgctcagaaggcagccatgaggatccatgcccagcgtggggtgggacgaggcatgggagaatatggaacagctttcctggtgtcacgactgtcactgtcactcagtaagtgctcactgtgtgccaggcatggagcacagcaaagcctcacgaacccccttctaatcctcccctcctgcaggtaaggaaactgaggcccccaagagggcagtggcctgccccagggctcctagctgccaagtggcagagcagggcccggccccagaactggagcagctcagagagcagcagaggccacgccagggctcacgaacctgctgcttctcgctctcggccaggaggaggccctcgtcatgctcctgctgcagggcagcaatctcctcactcagctgttccttctcagccttccgccgggccagcagctcctcctgctcacgctgcagctgactctgcagctgggcccgctcggcctccagctcccgccatgctgcctcctagggggccaggactggacgcgtgtgacacaccaggaggggcccaggcagaccccccaaaacatcagggcagcaagagccatctggcccccataccctcagagatggagggtgaccaggtaaatacaagggactgataagggctatgacggggacacgccagggccgtgaaagtgccaaggagcagcagtgggctggcctgggggtccgaacatgatcccctgcggagagacaagtaactgtcagccaggtaaggagagaaaagaccaccccaggccaagagcacagcccctggaaaggactacaggatgcagggtgcagagggaaacagggcacggtgagtcacagggccagagccccaggcagtggctgggccaggacaggccgtgtgggccatggggattctaaggacagtgaggggagtgggagagaggactcgagccaaggtgacaaggagcaatctgatttttagcttaggggatgttccgacagctgtggaagagggattggggttgggatggaggagagttaggactggctgtgaggaatgaagggggtcaggggttgccagaggagctggagagaagaacacagatttggggacattaatgaggccaagccaggcaatgcaaagggcaagaagagcaagggggaggtcacagttcagatccctggggactggacaggcgggcaggcagagcccacaggcaaatagcagcccacccggggagcccgagggcaggtgcctgcctcagcagttgtccctagcaactctgtgagaagcagacagagctgccacttcttttttttttttttttttagacagagtctcgctctgtcacccaggctggagtgcagtggcgtgattttggctcactgcaacctctgcctcccaggttgaagcgattcttctgccttaccctcccaagtatctgggactacaggcgcgtgccaccatgcccagctaattttttgtgattttaggagagatagggtttcactgtgttagctaggatggtctcgatctcctgacctcgtgatccgcccacctcagcctcccaaagtgctgggattacaggcatgagtcagcacgcccggccaagccaccccttctttaagagcttcaccatagctcatgcctggaatcccagcactttcggaaagagctttaccgccccctgatggagaagcgtgataaccaccacccaaggccatggggactgcagggtgagtggcatgccctggagccatgtagtcatagcctgcacctctgtcagaggaagccctgtctaggatttggtggctgagggcccctgttctgagggccactctggagagcatgccagtgccagcaatcataactcatggagcatttgctaagtaccagtcactatgttaagccctctatgcagatggtctcagctcatcctcaataccttccactatcctatccctatttctacaggtggggaaatgaaggcacagacaccttgggtagcatcaccagtaagcgaccaagattagattcaaacccaggcaatataaccccagagtcagtgttctagtaacttccctggccccttgcctttctacatgctcaggtctgcgtggcccttcatatggaaacttcttagcaaatgaaagtgctttcctgctgtgcattaggtcaacatttcccaaatgtggttgtggaccctctgcatcaggattaccagggctggaccagatttgggacctgggtatctgaatgtctaataaggaccacaacctccccaccacccctccagtcctcccagctgtccccagggcctccacaacagagagggagtcccatttcacagatgtacagaccgaggcagagcaagaacgatgatgaaacactggctcagacttctgcccacccctccccagctgcctgaaccttttcacgctggagtcactgtaagtcctcctcctgggctgcccactgctcccgcagagaggcctgggcctcccgctcagcctgcaccagcttctgggccatcagctccttgtctagactggctttctcctgcgtagctattatttgctgccgcaggcccgccaactcccctgcacgagaggaatgggggaaagggcagggttgggttgaaatttttccttgggccagcagacttaggccagttgagccatatgggcaaaatcccagaggcagagggcctgcctggcatccagtttgggtcctcttgaagaagtggcttgtcctctctgggcctcagtttccctatctgctacatgggcccactggccctgacccctttcctgcctacctagaatggcattaaaggcataaaatgactgatgagaaggcctcccaaatgggacggatgtcaaacatataacaaccctaggccaggtgccatggctcactcctgtaatcccagcactttgggaagctggggcaggtggatcaccttaggtaaggagttcaagaccagcctggccaacacggtgaaaccctgtctctactaaaaatacaacaattagctgggcatggtggcggacgtatgtagtcctagctacttgggaggctgaggcaggagaatcgcttgaacccaagaggcagaagttgcagtgagctcagatcgcaccactgcactccaacctgggcgacaagagtgagactctgtctcaaaaaatcaaacaggctgggcgcggtggctcatgcctgtaatcccagcactttgggaggccgaagtgggcagatcacctgaggtcgagagttcgagaccagcttgaccaacatggtgaaaccccgtctctactaaaaatacaaaattagccaggcatggtggcgcgtgcctgtaatcccagctacttggaaggctgaggcaggagaatcgcttgaacctgggaggcggaggttgaggtgagccaaaatcgcgccattgcactccagcctgggcaacaagagtgaaactccatctcaaaacaaacaaacaaaaacaaacaaacaaacaaaaaccctattactgactcagcacttactatgcgtcaagcacccagctaagtattttagacataacctcattttgtcttcataacatgcctatgtagtttatcctcatccccgtttaacagatgatgaaatggaggatcagaggagatcagcagcaacttcccacagctgcacagctacacataaagcatctcctttaatgactgacatgaacatacctgtcaagcattaactatcagcattaatggaaacgactacagggaatggaaatggtatagccatcatctaaaaaccatctcccgggttggaaacccaccagcatttcccttcctggttctgtctggctcaggtgtacatggacaggaaaattaatttccatgacccaagtaggtgcttagttaatgttagatgagcagaaagaagccctgagttcagagattcgatggggaacggtgcagggaagtggggctcggattctggggccaagagagtcatctgaaaaccacagagaactcagactaacaggcctgatgaccgatgaacagcagttactgttgactcagccaggcaccgtgccacggccttacacgcttttcccatgtcatcctggcaacaggcttagaaggtgggcattgccacctccaatcatcagctgaggaatctgcagcccagagaggaaaggggcttgctcaagggaaggtgagatctaagtggtggcacaggactggaacccaggccagccagactcctactccagtgctcccaacttctgtgagactacagacattgggaggttgcagtctgggctggaacctggtgttccccccaagtccccagccactcgtaccagtcagggtctccttggccagcagcagggcctgcccctcggcttccagctgctcccggcgggcctcaagctgggccagctgccattgcacctcaaacaggctgccctccagggcttccttctccaagctgcagcacatacagtgcgtgaggccctgggactcagcctccctggccccaggaaactgtggatctcagggagtggccaggcatgggccaagtgccaatctacctgcctggccaggcccacactccctggggaagcctgagcccacagctaggacgagttggcaagccagactccttagtaactgcccctgggggcccgtgcctgggtgaggctgttcatggcgtggccccaggaggaccgcccagggcgggttgggcagagcccaaggccttactgcaggtgtgtggcctcctctgacacggtcctgccttcacgctccgcaggccgccagctgcacagccaggccagcgtgctccttggctagcgcctccttctcccgggccacttgccccagcgtctccacctgtcactgggcctcccaccgggcctgctccagctcctgctcccgcctgctcagctgccaggagagctggctcccacccagagactgagtagcactcccagcatcccccagcttgttcatcgtgcagtaccccaactctgggcctaacccagtcctggcagaaggcctgggttcgagcccagggtctgccctgatgtgctatatgtacttgggcaagtcatgaccttctctagatctgcaatgcacgtgtgtacaaaaaccagggcccggccggacacggtggctcacgcctataatcccagcactttggcaggtggatcacttgaggtcaagagttcaagaccagcctggccaacgtggtgaaaccctgtctctactaaaaatacaaaaattagccgggcatggtggtgcacgcctgtagtccctgctacttgggacgctgaggcaggcgaacagcttaaaccccggaggcagaggttgcagtgagcccagatcgtgccactgcactccagcctgggcaacagagcaagactgtcaaaaaaaaaaaaaaaaaaaaaaaaaaagaaaagaaaaatgagggtcctcactcagctttggaagtaacagaacccttgtattactctaagcagagaagctgaatatataaaccagacccaaatgcagctgctcagcaggcctcaaggtggagacttgcaccctgcttcctgcactccctaccccatcctctagaggcacctcccagaaacccaggccctccaggatggaccttgcatgaaggtccctggatccctgaaacattaaggtctcttcgagatgtgaagttcccaaaagtctaagattccaattctaaaaagtctccacctattattaatctgtatcattattattattattattgagacggagtcttgctctgttgcccaggctgcagtgcagtggcacgatcttggctcactgcaacctctgcctcctgggttcaagcgattctcctgcctcagcctcctgagtagctgggactacaggcgcgtgccaccacacccagctaattttttgtagagatagggtttcaccgtgttagccaggatggtcttgatctccggacctcaggtgatccacccgcctcggcttccccaactgctgggattataggcgtgagccactgcacccggctagccccatgttataaatggggcaactgaggtatgggaggttgggcagcttgtccaaggtccccagctaggagaagtgggactggatttaacccagaagcaggctccagtgcctgtgacttaacccaggactggatgcaggaggctgcgagcctggcctgccccacatgctctccagaccaccccacacacagtttggcctacctgtgctagctgctcctgcagccaactgagctcatggtgcagtgtggggagctgttgctccagcgcctcctgggcctgctccgccactcatagggagccctccaggccctgccgtgccacctcctgctccaaccacagctcctccagccactcctgctctgccggcgccactgtggcctcctgctccgcctgccgctgccggccctgcagcatggccttttcttcctccagctgtgggccggaaaggagtggggcctcatgagcagggcgtccctcccaggaccaggacgcctcctccacccacccaccagccacgatagcccaggggaggctcccagggaatgagggacagtgcccttgggtgtgtgggacactggggagggggagatgaggagggcccatggagcgtcggtgctttgactcctagagaggacagacagacagacggagatagacagagaaccagagacagaaagggaggcaggggccaagacaggtgcagggccgggcccagggtgcctcactgagtggggaggacgggtgggcaaggtaggtgggcccgcaggtgcacagtgtacctgggtgacaaggcagttcagatccaacttgtcctgagcaaggctctcgttgagggcgctcagcttggacagggagtcctgcagggaggcctcctctgccctcagcttggtcacggagagctcgagctccatgcggccagcctcaccctgcagggtcaggccccaagagatgaggaagggcagaaaggtcgggaggaggtgaggagagacaagaagagacccagagagatggaccctcggagacaggggaggggagacaaggaggggatacggcgtgagatggaaaaaaaaatcaccgcagaaagcctgctgcttatggagccatttaaaagccatgcaccgcaaagctgtgcaaaaatagctcaagctgcagggcagggccagagttcagaggatcccctgagtaaggtctagggatagcactgctcagagcccaggctgcagcggacagcgcaggcccccccgccaaggaccctctgcgctgtggccacaactctcagactccaggagctgaatctcaggatgaccctgagctataggcactgcccccaggagcatccagaacagcagggatacggccataaagagaggtcagtccacttatggctgggaccagaggtccagaggtctgtggcctgtgacaaagatcagcctgtatccagaaggaaggggtcagtctgtgaccaggctcagaggtctgcctgacactgggaccagtctgtgccagagtgacaaggcttggggctgggggtcagaggtaggtttgtggttgtgcagcagacagggacccaccttggtcagcgcctcggccacctcggtcttctcggcctgcagcatgtcccgttgcagcgtggcgcggctcagcgcctccctcacctccaccagctccttggccaggactgagcgcttcccttccagctgctctagttgtctatggctgtgggacaaagggtgggtgggtggcccatgtcactttcctgcccgaacctcctgtagccagcaagatgctgggccggggaccaggcctgaggcacgagtttggagagaaacagcctgagccacagggcaaccaagcccactaccgcttagctccatgaccctgggcctccgttttcacatctgcaaaatgaggtaacacttgcctcgtgacattgtttgtttttttgagacagagtcttgctctgtcgcccagtctggagtacagtggtgcgatcctggctgactgcaacctctgcctcccaggttcaagcaattctcctgcctcagcctccctagtagctgggattacaggtgctcaccaccacacctgactaatttttgtagttttagtagagacggggtttccccatgttggtcaggctggtcttgaactcctgacctcaggcgattcgcctgcctcggcctcccaaagtgctgggattacaggcgtgagccaccgtgcccagcctgttttaaggatacaaacttcacatgtgcttaaaatagtgcctgacacatctccccaaggaccttcagaaacaagaataacatgctccaccacagtctactaaacatcatcagcgatcacgtccctgagaggtaagcagcgcagtggtgaagaggttaactctgaaggcagaatgtctgggttcaaatcctggctcttctgctaactgtgtgacctggggcaagtgacatggcttctctgtgcctcagtttaccatccacaaaatggagataacagcttctatgtcacagagttatcatggagttaaatgagagaactgaattgcttaaaatggtatctggcacttagtgaaattagtaaggatattattattcttctaactaaatttttaaaatactactactaatattactagtgttattttaattattcttgttattatcatccaagttctaccttttaactagttctctgactccaggtaagtgactatacctccctgagccccagtttcctgaaatgggtctggttagaaaacccgacatcagaggggtccagacggtaggaggcccaggacccagtgggtgtcacctaaccccatgggggcactgtcaggggacccgaggcacatttgaagggtcctggcagggaggtgagatgctgctaacctgcgctcaagctcccggcgaacccgtgcgccattctgcaccgcctcttcctgctcttcctccagccggtcccgctggcgctgcagctcctcctgggcaacctgcagcttctcccgctcctgcggcagctcctcggcctgctgctgggccacctgcaggctgtggaccaggttgctcttctcccttcaggacaaggggagcgggagcagaggggatgctggggctgctctctccagggaaggtggctggctgctcctctagccatgagctacatcctcccgtcttccaaggcacctgcctccaggaagccttccctgaccctgcccatagcagactcatttcactcacacactccagcagaagaacctggctttccttctccccagcccgcccacttagagtggatggaggtgctggcgtgatctctaagcactctaccacgtagaagaggccaggctaggctcctgggacacacaggcaattgtgccaccagttctgctaggccatgtgaccaggaaatgtcccctagaacaccccatgcccctcaattctgggaagcctgatagagctgagtctgcagatcccacagcttcctgctacacaggcacatggtggccacggcaggggagggaggagaagggaacaactaggaccccaaagacttgctgtgagctgccactttccccactggtggtaggtgcaaaaaacttcaagacgtgatttttttttttttttttttttgagatggagtctcgctctgttgcccaggctggagtgcagtggcacgatctctcctcactgcaagctccgccttctgggttcacgccattctcttgcctcagcctcccgagtatctgggaatacaggcgcccgccaccacgcctggctaatttttttttttttttttgagacggagtctcgctttgtcacgcaggctggagtgcagtggtgccatctcggctcactgcaacctctgcctcccgagttcatgccattctcctgcctcagcctcccgagtagccggaactacaggcactcgccacgatgcccggctaattttttatatttttagtacagatggggtttcaccgtgttagccaggttggtctcaatctcctgacctcgtgatccacccgcctcggcctcccaaagtgttgggattacaggcgtgggccaccgcgtccagcaatttttttgtttttacacacagtctcactcttgcctaggctggagtgcagtgacacaatctcactgcactccacacagcttgctgcaatctccacctccagagttcaagcgattctcctgcctcagcctcccgagtagctgggattacaagcgcctatcaccacgcccagctaatttttgcatttttatttagaagtggggtttcaccatgttggccaggctggtctcaaattcctgacctcaagtgatctgcacgcctcggcctcccaaagtgctgggattacaggcgttagccactgtgcctgggcaattttttaaatttttagtagagatggggtttcgccatgttggccagtgcctgcgggacaagaccgacggcgccacgcaggtgttcctctagggcccgccgctcactctcgctgtcgctaagctgcttccgcagggtgcccagcaggtcctggcttgcctcatagcgcccacgcatgttctggggcgtggggatcacagagtctagcgggggtcctttgaggcctccagagcccacctactctcttctggttccagggatacacactagcctacgctaggcggggtccagggcctggacctgccctggggcaggataggggcctaggcctgagagccaggcttccactcccctcctatgtgccctcaccaccctctgaaccctcatctccctggggtcccggacaactcctatcaaagcccccgggatgccagacaaactcccaggcacactcgtctcctgggttctgatcccacccccagggctcccaggctcctcccccttgcatcctggttccactctcacactcctccctaccctggctctgcccctagttcccaagctctcatcctaggctgtgatttcccttgctagaccttttcccagggtcctggctctgtatgaccagggacctgtctccctctctaccaggaccctaacactgtcgcagcctcctccctccaccggctgcccaagcacccacccccagctgcccaagcacccccacttctgggctggcttcagcgcagagccctcgaccacctccttgggggtcctgacaccctcagacactatttctcagggctctggctgcaccccagggcgctcagactcctcccccagacacgcccccacccccacctggagggcgcgagcccctccccctgggcctctggctgcgcccagaaaactcaagccccttcctacctggaccttcagctggcaaaagtgcagggcggagagaatcagggcaagcgagcgtggagtcttctgagcaggccggggaggggcctctgcggggcgaacggcctcggcccggcgaggagcgccgcggtggagacggggtccgctggcccgagagcccccgcaggctgcggtcggacgctgttggacgcaggctgccgctctcagcgtcagacaggacggcctgagggtaagggagggaagcaggaggccgcagagttaggaacttcggggttagctggcaaaaacgaccaggggaggctgggggccgcctcatcccaaatgctcccgcttacaagaagccttctgatttcacctcctccactagctcagtcctcagctcgccgctgaggcatcccatttattgcgaagacatcatttggcattgctcacaggtgggctccgagagggccgtgcctcccctctgagactgggggctccccagggcagaggccgggtgagctagcaggggtgctgagcagctacagcctgggtcccagggccccacccatctgcagttcaatccgaagccaccgaaaggcgaggcgggggagcccaggaccgcctggcagggccctgtcttcccgcctttctgggctcacacctgtgccaggtcccttaggctccgctgtagcccctctccatcctctgtctccagggccgcctgctcctgtagccgcagggattcctggagtgcggtgagggagacaaagagtggtcggggttctgtcttacctgaaacctcccctttccctccctccctggcccaccactgatcaggtggcctctgaagccatgtccataggccagccacctggtagaccccacagcaggcccgaggccctcaatgaacagaccaggcccagagaagagctgggttctgccccaggtcacacagtcgattgcaggagagctggacctagaacccaggccaggccccacacagaggggtgactaaaccaggctggaccctgggggagtgagtgtcccactggtgggggtggacagttgggattccaaaggcagcatctggacctggagagcgtggatgggagttcaagtcccaactctcctgcttactggctctgagactggacaagcatttcccctcttgggcctcagtttcccatccgtgtcattaggattactctacagggctgctgggagggagaaatgggatggaggaagtgagtgtgcttcccacaaagcctgcacacctgtgtgggctgaacctgagtgtgagtgggatgctgggggtggcccaggcagcccagccctaagcctgtgtccatggatctggccggtaccccatcccaccctgccccatctcaggggcagctgaagctcaccagggcctcaagcttctcggtgaggtccttgtcgacctgatccttctccagattctgcttctgtagacgcttcactgccaggcccagctctgtcactctggagttgggggagcaacagaggtgaatacgggaccaccccagcctctcaaatccactagctctgtgtccaccatgcttctccaaacccgaggcagggaccctaacatccacctccctggctgtgtgaccttaaacaagttgtggctcctctccagacctcacacttctcatctgtgaaatgggaatgaggttcccaccagctttatctcatgggaaagcactggaggacttacccaggtggcaggagtaaggggcacaagttgtttttttgtggttttcttttgagacagagtttcgctgtgtcgtccaggccggaatacagtgatgtgatcttggctcactgcaacctccacatcctgggttcaagcgattctcctgtctcagcctccctcgtagctgggattagaggcacacaccaccacacccgactaagttttgtatttttagtagagacagggtttcgcctattgggcaggctggtcttgagctcctgacctcaggtaatctcccaccttggcctcccaaagtgctgggattacaggtgtgagccacagcacccggccacaagttctgtcataggaggctaagctgtttatgataaacactgggcaactgccttcggaacctcagtggggtgcctgggaaggctggctgagctcacagaggaaggccctgctcctagtgaacagatgctcccttctccccaactctccagttttaccttctgcagtgacgcctgcctcatgcagcacccaccagggaccctcctggcactgaggtcagccttgtccaggtcgctttgcatctgctgctgggacaggtccttctcgtggagcaccttgtcccgcagctgctcctccagctgggcctgcttctccagggctggctcgacccggctctctgccagccgcaggcctgtgctcattcccaggccggcctcctggacagctcccctcccagctgcagcgggtcccttgggaagagaacacaggatggggatgggatggggctcactcccaactacaaattaaaactagtctggggctgggtatggcggcccacacctataatcccagcactttgggaggccgaggcgggcagatcacctgaggtcaggagttcgagaccagcctggccaacatggtgaaaccccatctctaccaaaaatacaaaaaattagccaggtgtggtggtgcactcctgtattcccagctacttgggaggctgaggcaggagaattgcttgaacctaggaggaggaggttgcagtaagctgagatcatgccactgcactccagtctgggcgacacagccagactgcgtctcaaaaaaataaataaataaaaaataaataaaactacactgggctgggtgcggtggcatgcacctgcagtcccagctatgcgggaagctgaggcaggattgcttgagcccaggaatttgaggccagcatgggaaacatagtgagactccatctcaaaaactaaagaggaagaagaaaaaaacaacaaccctacactgggatgccatttgtccactatcagattgggaaaaaaaaaaagggacacataatacacaaagagaggctctggggcaacaggccttcccctacacagctggtgggagggtgagtacaatcacaatggagggcactgagggagatcttcgaaaactatgcaggcataggaccttccccaccggctcctcctctaagaatggatcctacagatataccccagcacagaggagatggcttgtggacaaggaggttcactgcagcattgctcatgtaagatatcctggtgacaacctaaatgtctatcaaaaggggactgctactaagtacatgatggtacatcctttaagtggagaactgtggccaagaaaaaccagtggagaagttcttcctggcctgatccagagccacctcccagttataactagtaggtgaaaaaagcatcttcaagaactgtgaagatgaaattttaccaggcgtatatacaaaaaagtgtgtgtgtgtgtgtgtgtgtgtgtgtgtgtgtgtgcgcgtgtgtgatctcatttgctcatataaaataaccctggaaggtcacttaagaaactgataggccaggcacggtggctcatgcctgtaatcccagcactgtgggagaccgaggcgggagggtcacctgaggtcaggagttcaagaccagcctggccaatatggcgaaatcccgcctctattaaaaatacaaaaattagccaggtgtggtggctcattcctgtaatcccagctacttgggaggcggaggtgggagaatcacttgaacccgggaggcagaggttgcagtgagccaagatcgtgccactgcactccagcctggagactcgcagcacagcgagactccatctcaaaaaaaaaaaaaagaaaaaagaaaaagaaactgacaatgcttcttacggtaacttggtggccaaaaaaaaaaaaaaagaaagaaaataattgtatatataaaaagaaaaagaagctgatgatgctgcttgcctccaaggaaggaatgggaatatctggggtcagaggtgggagggagccattttactgtgtacccttttgaaatgtgaataggtgacttcatcaaaagtaaaatataaaaatttgaaaggctacttacaaaatttttttttctttttgtttctttttcagatggagtctcgctctgttgcccaggctggagtgcactggtttgacctcggctcactgcaacgtccgcctctccggttcaagcgattctcctgcctcagcctcccgagtaactggaattacagatgtacgtcacaacacccagctaatttttgtatttttagaagagacggggattcaccatgctggccaggttggtcttgaactcctgacctcaggtgatccacccgcctcagcctcccaaagtgctgggattacaggcatgagccatgacgcctggccttaaaatacattaaaaattatttgtattttaaaaaattaaaatgtattttaaggccaggcgtggtggcccatttcttgagacatagcaagaccctgtctcaaaaaaaaaaaaaaaaattagctgggtatagtggtgaacacttatagtcccagctatttgggaggctgaggtgggaggatcacttgagcctgggaggtcaagcctaacatgagttgtgattgtgccactgcactccagcctgggcgacagagagagactggctcaaaaaaaaagtattttaagtccataatacaggttaaatcctttcctttcctttcctgaatgacctgtaccactggttatccaatagtaaggagggaaagtgcctcattatagaattctaattaatatacacaggagtgactaaatgagaagctcacagttttgcagcctctaatgagtgggttggatcttgaaaagagagacagctggcatagggacatcctgatggaagaacacattctacttatggagtcttgatcaaacgaaaaagcaagcagaagagcctgaatctgacctagctttacatccaacatccaatttacaggaaatacatgggataaagaaatatgttaattgacaccataaggatgcaaccagcaaaatccagaccatgagaatctccaaggacaactagcccagtttcctgaacaaataagttaaaaaggacttcaaagacaaagcatgggccgggcacggtggctcactcttgtaatcccagcactttgggagaccaaggtaggtggatcacctgaggtcaagaccagcctggccaacatggtgaagctcccatgtctactaaaaatacaaaagttagctgggcgtggtggcgcactcctgtaatcccagctactcaagaggctgaagccatagaattgctgaacccaggaggcagaggttgtagtgagccaagatcctgccactgcactccagcctgggcaacaaagcgagactccatctcaaacaaacaaacaaacaaacaaccaaacaaacaaacaaaacaaagcaaccattcgcactttgtgaatgtctatggatccggattcaaacaaattgtaaagaaaaaactaaagcaagactatctgtgactttttatttatttatttattttgagacagagtttcactctgtcacccaggctggagtgcagtggtgtgatctcgactcactgaaacctccgcctcctgggttcaagcgagtctggtgcctcagcctccccagtagctgggattacaggcatgtgtcaccacacctggataatttttgtatttttagtagagatgggggtttcaccatgttggccaggctggtcccgaactccagacctcagatgatctgcccgccttggcctcccgaagtattgggattataggtgtgagccactgcacctggcctatctgtggcatttatgagacatatggaaaatttagacgctggctatttgatgatattaagaaaagattattaaaccaggtgcagtttctcatgcctgtaatcccagcaccttgggaggccaaggcaggaggatcactggggcacaggaattctagacccgtctgggcaacaaagtgagaactcgactctacgagaaataaaaaaatcagcaagcctggtggcatggacccgtggtcccaactgcacaggacctgaggtaggaggattgcttcagaccaggaggccaaggctgcagtgagccataaagaaaagaaaagattactaactaaaagtaagtccttgatatcagccagatgacactaaatcccatccattcccctgagctcacaggggggctgcctagactccagaaaaaaggctgtgcctagtcctagactctggcatgcaggaggtcagaaggctgaattctccactaaactcaaaagtataaccagtccagactgggtgtggtggcccgtgcctgtaatcccagcactttgggaggccgaggcgggcagatcacctgaggtcaggagttcgggacgagcctggccacatggtgaaaccccatccctactaaaaacacaaaaattagctgggcgtggtggcacattcgtataatccccgctactcgggaggcagaggcaggagaatcgcttgaaccttggtggggcagaggttgtagtaagccgagatcgtgtcattgtacttcagcccgggcaacaagagtaagactctgtctcaaaaaaaaaaaaaaaaaaaaagtatgtggccgggtgcggtggctcacgcctgtaatcccagcactttgggaggctgaggcgggcagatcatgaggtcagtagttcaagaccagcctggccaacatggtgaaattgcgactctactaaaaatacaaaaagtagctgggcgtggtggcatgtgcctgtaataccagctacttgggaggcggaggcaggagaattgcttgaacctgggaggcggaggttgcagtgagccatgatcgcaccactgcactctagtctgggtgacagagcaagactccgtctcaaaaaaaaaaaaaaaaaaaaaaagtagccctctctaagtcttaattccttcatctgtaaaaacagaataatgacttatgttagagatgctgtgaagagcccagggaataacaagtgctgtctgcataccacataacctgtccgctctcaaaggtggctgggctgatgatgtctggaagaagaaggctgggagaaatgctggttcccaaagtggtcagtaccaaggccacctagtccaacccttgcccctaggcctgtggttcctttggggcagattccagtctcgccaccacccagccaggggagtctgtgttgaatgggccatgtcctggaagtatgaaaggctcagccctctgagctgctggatggctctgtcctgtacccgccagtccataaatggtcagcagagcacatggcccacctacccgagccaaaggagttgggaaaaatctgtctgggtggccccctcatcctctcaacacacaggcctagagggaaaagggtactgtctaatgccagtcagtgctgtcctgagctcagctgctaagaatagcagggagtgaggtggtggtaaccagcaggactcaggcagaacagaggcccattacacacctggctgcccacaggctgccaccacctgctcttccacctttcatgccagttcctaccctactcatccacacagacagaaagctctggaaggggacgaaggtggcacaaagcaccctgacaaagtagccactacccaggctcagggatcacatattcccccagtgtaagccactcccagccctgagctgtaggagcagagatgcacaaaggcccctccccactgctgctctgtcccaggccaaggccaggtggtggctatgcagtcggggtgctcagctagtagcatagaaggctaaagccaaccccatctctgaataccccagtggaccaaggataaaggagcctttctcaaaagcagttacaggccaagcatggtggctcacacctgtagtctcagcactttgggaggctgaggtgggagaatcacttgagcccaggggtttgagaccagcctgggtgccacagtaagaccctgcctcttaaaaaaaaaaaaaaatttagctgggtgctgtggcatgtgcttgtggtcccagctatgtgggaggctgaggtgggaggattccttgagcctggaactttgaggttgcagtgagctatgactgggacatagcgagaccctgcctcaaaagaaaacagttcttaacaagcccacacttggagtggctactcttgtacctgacccccaaagtcgtgtgcctgatcctgagagcagactgcacatatctgtgggcagtcggcctgagacagccaccactgagtgcctacagcacggcccatttggccaagaccagcaacttccctgacctttttggatctcctaggtcccagttcagggccctgaatccccacaaccactgactgacggccctaccacctgctgtctctcctggcggccacagcagcagcagcagcagcaggaccatctctggtatcacatgaggtagggatcagatggctctgagaacaggccaggactgagtatggggtgggggtgggcaggaactctctgcaagcaggcactttctgaccaccacaattgcttaaatagaacaggtaatgatgctgccttttggacctgcctaaagagcagaagtcgtaaaagacagaacagctaaggctgataagggggtgagagacagggacaaccgtgcctcactgcagggacggagaacctacttgatcctttgaagaagtaatctggcaacagtcttaaaagtgactgcagttcaaacactctagccacacgactccagccctgggcatcctcacagcattgtttacaaaggcaaaagtccttccaaactagggcacttgtatgggccacagcagaccccctggccctaaagatgctcagtaagatacattgataatgtggaaaaatactcacgggataacatttgataataaaaataggatgcaaacttctggaagtgagggacatgtccattaccttgatggtactgatggtttcacgggttttatctatatgttaacacttatcaaattgtacactttaagtgtgtgtagtttattgtatattaatcatagctcaataaaaatgttttaagaaaagaactgaaggtgacaaatttttttaaagttttctatacagcataatctgaactacatacattataagataaacagacatgaagttaaaaagcttctgcatagcaaagtaaacgatcaacaaagtgaagagacagcccacaaatgggagaaaatatttgtaaactacccatctgacaagggattaataaccagaatatataaagaacgcaaacaactatataggaaaaatactaatagttccatcaaaagatgggcaaaagatacgaacagacatttctcaaaagaagacatacaaatagcaaacaggcatatggaaaggtattcaacgtcactggtcatcagagaaatgcaaatcaaaactacaatgagatatcatctcaccccagttaaaatggcttttatccaaaagacaggcaacaacaaatgctggcgaggttgtggaacccctgtacgctgttagtggaaatgtaaattataatagtgcaatcactatcgagaacagtttggaggttcctgaaaaaactaaaaattgatcaggtgtggtggctcatgcctgtaatctcagcactttgggacgtcgaggtgggaggatgacctgaggctaggagttcgagaccagcctggccaacacagcgaaaccccatctgtactaaaaataccaaaattaactgggcgtggtggtgtgtgcctataatcccagctacacgggaggctgaggcaggagaattgctagaactcgggaggcagaggttgcagtgagccaagatcatgccactgcactccagcctgggcaacaagagcaaaactccttctcaaaaaaaaaaaaaaaaaaaaaaaaaaaaggccaggcacactggctcacgcctgtaatcccagcactttgggaggccgaggcgggtggatcacgagctcaggagatcaagaccatccttgctaacacggtgaaaccccgtctctactaaaaagacaaaaaattagctggacctggtggcgggcgcctgtagtcccagctacttgggaggctgaggcccaagaattgcgtgaacctgggaggcggagcttgcagtgagctgagattgcgcccctgcgctccagcctgtgcaacagagcaagactctgtctcaaaaaaaaaaaaattttttcaaaaagaaaaaactaaactaaaaattgagctaccatatgatccagcaatcccactgctgggtatatacctgaaagaagggaaatcagtatatcgaagagatatatacctcaaagaagggaaatcagtatatcgaagagatatctgcattcccatgtttgttgcagcactgttcacaatagccaagatttggaagcaatctaagtgtccatcaacagatgaataaataaagaaaacacggtacagatacacaacagagtactattcagccataaaaaagaatgagatcctgtaatttgcaacaacatggatggaactggaggtcattatgttaagtgaaatgagccaggcagaaaaagacaaacactgcatgttatcacttatttgtgagagctaaaaattaaaacaattgaactcatagaggcaaagtactggatggttaccacaggcttggaacggtagtgtagggcttgtggggagatggggatggctaatgcgtacaaaaaaatcgaattaataagacctgtctggtagcagaacagagtgactgtagtaaataataattgtacatttaaaaataactaaaagagtataactagattgtttataacacaaaagataaatgcttgaggggatggataccccatttaccatgatgtgattattacgcattgcatgcctgtgtcaaagtatctcatataccctataaatacatatacctgctacatacccacaaaaattaaaaattaaaaatgtaacacaaagaaagaaaacagaaaagaatcgcatttgaatagtcatgttaaaataacaagatagcaggtgcttttccttctttttttagagacagggtcttgctctgtcacccaggctagagtgcagtggcatgcagaggccagctcactgcagcctcaacctcctaggctcaagtgatcctcccacatcagcctccctaacagctgggactacaggtgcacaccaccatgcccaggtaatttctgtattttattgtagagatggggtctggccatgttgctcaggctggtcttgaactcctggactcaagcaatctacccaccttggcctcccaaagtgctgcgattacaggtgtgaaccactgtgcctggccctctaagtttctgctaaaatgtacttgtaacttttacactgactacactcaaaagtattaaacttgtaaagaaaaggccctggaggagtttgttctttacaaggtcagtcagaagctacaaggggccaggctggggccaaggtgagggcaggtacatgcaggggcagatgctgggtgtggagtaggtgccaggtgctagctgggcatgaatgtgcacccgctccctgacctctgctccctgactctcacaaggaactagcactgcctggagacaggaagaagcagcgtacggaaggcagactctctggccagagatctcgcagccaggagcacagtgagaacagagcctaagcctatctgtccagagcccaggctccctttccctacaactgcagcctccttattctgctctggcccagcagagtgaggaggggccgcccacccagccatacctgccggtggctgctgggggtgcatggtcagaagaggaaagatgcggttcaggtagtcattcagcagcttctcctgcacaatgcctgagccacaagtcagaagggagaaaagggccacacgatgagtgcagctcctggcccctgctggccccagagacttctggtcctaggccagccacaggtgcagcaaggcctgaggcctttgtcccttccttctcctcccaacaagaggagcctccttccttctctgccagcccttacctgtgaccctggatttctcagcatctgaggtcagcctacagctcttgcgggagaaagacacgccggcccccttggatgccatccttcgtctctcatgggcagccagtggtcctggaggctgaggcagacacagagcctgtctactcagggccagccaggggcccccacacctgacctcagtcctgccatggcaggaagtcttgggagcaggtgaggccaggggcatgcacactaacacataggacaggggaatgcaggggctcccagcttcctacacaggcagggtagccagggtctaggcccatgtaacagggaccacttcttgttctccagtgtccctgtgcccagcacagggctgggcagagagcaggtaccagatatatttttgccaaaccataacaaaatgtctcagctctgtggaaatcagaccaaaatgtccaaagtgaggtgtcctaggggcagagcccctgtattcatctcggttgtaagccatactgagtccagctcacaaccagaagcgacaatcctacacattcccccaagtgcagaccaccactggtctggtcatctctagccataagtcccacttactccccacaaggctggagcctctttcctcagccctgggttcctcccttcttttatccatggtcctgatagtttcactgttcccactcacacatgtggcctcccacctcatccaagcaccacccttgcccagccctcatggcaaactccattggtcctcctagtgcatctatccctcacatcatgttgctgctgcagctgctccaaaacctgcactgagtccctggtgctggcctcactgatgtgtagctgtgctgtccaacacagcagccgtcatccacgtgaggttacttaaatttaaagttttaaaaattaacaattcgatttctcagttgcctcagccacatttcaagagttcaatgaccacatgtggctaacggttactctattggacagcacaaaggtagaacattcccaccatcatataaagttctattagacagcgcaggtctagagtttcgctctgcagcactgccttagccagcactccctactctgccgttcagtctcttatctcgccccaaacagaccctctactcccgccacaaacccctgtgggtctgcaccacgcctgctcctcgggaaggtgattttcccgacctcgggccctcggtgggcctccatgatcggtgccccttcactaccacagtagttgaagatctgattaaatgcagtcattcatttgatgagcagaccttccagacacccactccgggtgtcagttgctgaggacccaggtgagaggcggaccttgtccccgcccggggactccctgtcacggctatcccgtccaacctcgccggggtatccgggctcagaactgaacctactccgtctgggagcccaaggatggctcccccaagtcgcccccgcctggccccaagctccagaggacctgccagaccagcttccgctcggagtttcgcactcagatcccggcgctgcaggtgccctcgcagtggactaaactggaccgcgaagggaatagccggaacccgccaggctcagagccctgccgcccctcactcaccccgagcctcggccgccgcgacccggttcacaacatccgcccaacctctcggctacggcgtccgttcagggccaaatcacgcgcacgctcgcgcgctgagcctccagccgcgcacgcgcaccggcccgcgcccagcctccgctaggggaccccctccgtggcttcccaccgggttgttccaggcctcagcttcgccgaaaggcctcaccacctccgacctccgcctgccccggggatgctcccagccctgctgcggcagaacgcgacgtgctaaccggaatccctaggccgcctgtctcctacccatacttggaggccccgctcagacggtcctgaaaacgtctgaaaggcggttcctgccagagtccctgctacctgttacctccacccctatttagtcctagtggacagcttcgctcaccttccctgggatgacacttctggcggctgagatgagcgagcctctctgggctctgccgccgggcgtgggctgacctgcctacagctggggcctgataaggcagcagcaaaagggtggaggggaggcagtgttgaagctggggcaagtaattttccccaatttacagggaaaaaccgaaattcagaaaagtttaatgtcagccaggggctggaacccagacctctggcagctgtcactttcacaatgcccttgggctgactaggctgcagaggggtttcaccccaaccccagggcacctcaagtggccccaccaaaccttcctaacacctgaccactaagtagggaggcctctcagggggctagctgtgctaggcccttgcaactgacctgtgggacctgaggcctggcccctcatggctcctgtcaccaggtctcaggtcagggtccagcaggccctgagctgacgtgcggagccagagccacccaatcccgtagggacaggtttcacaacttcccggatggggctgtggtgggtcacagtgcagcctccagccagaaggatggggtggctcccactcctgctgcttctgactcaatgcttaggggtccctggtgagtgcccccaaccttgatccccatctgccttcaggaggggcttggccccattctcctattctgggatgagaaaaaagtcagggagccagaggctcagtgggcatggggcagtgaccttggcctcttgagcacagctgggaagccctaggaacacatagacatggcccacttaggcctctattagcacgtctgctctagcactgaagcagtgttaggaccacacagatgcacgcacacagcaggcagtgacccctcctgagcctgatctacccctctaacctagcgtatgcctttgtgcaggtgagagcccagctttggagtctgaatgcctagccagggcccctggctgggtaatgtgatggctctgagccttagcattctcatttgagagatgagatggggcaagctccatcacccactgctctcacagagcgtgtgtgttagatctgagcccggtgcctgggccactacacagaggcaccggtgataactaccaagtctgggcctgcttcccaggggaaattttttgacaagtatctgtgcaggggggctagactggcccttgaaagtgcatacagggtccatcccagaagccttgtagctttgatcccctgaatgaacaaactgtggacatgccaatacacattactgacatgtatgcccacctgacctgcacccactctgcagggcagcgctcgccattgaatgacttctaggtgctccggggcacagagctacagcgccgctacaagcggtggtgcccgggccttggcaggaggatgtggcagatgctgaagagtgtgctggtcgctgtgggcccttaatggactgccggtgagtggccactgggcatagataagactgggggcaggggagcctgggccgtggcgttaccttgtgccttcttctctccagggcgttccactacaatgtgagcagccatggttgccaactgctgccatggactcaacactcaccccacacgaggctgcggcattctgggcgctgtgacctcttccaggagaaaggcgagtgggggtggagaggggcagggtgggagacaggggacctcagcccaagttgatcttctgtctcttgctcccagactacatacggacctgcatcatgaacaatggggttgggtaccggggcaccatggccacgaccgtgggtggcctgtcctgccaggcttggagccacaagttcccgaacgatcaccagtgggacaaacaccttccctccgtcccggcctgggaccttcccccagcacacactatagtgatgctctgggccctcaggtacatgcccacgctccggaatggcctggaagagaacttctgccgtaaccctgatggcgaccccggaggtccttggtgccacacaacagaccctgccgtgcgcttccagagctgcggcatcaaatcctgccgggtgggtaagcggcgccgggtcaagctgggagagtggagggacaagcccacgcccatccacgaacccactggctctttgtctccagccgcgtgtgtctggtgcaatggcgaggaataccgcggcgcggtagaccgcaccgagtcagggcgcgagtgccagcgctgggatcttcagcacccgcaccagcaccccttcgagccgggcaagtacgcgtaggcggtatcggcgccctgggggccgggctagggaaggtccaggactccaggggcagggctccgtgtagggcaactgggcggggccagataagccagagtcccagggtcttcttcacgccccattaccgcccccaggttcctcgaccaaggtctggacgacaactattgccggaatcctgacggctccgagcggccatggtgctacactacggatccgcagatcgagcgagaattctgtgacctcccccgctgcggtaggcggcggggaccaggcctgggagggtacctgggaaccttggggaggggcgtggcttggccggggaggtcagaggggctgggcgtgacctgagagcatatcccgtggagtaccgtacacctgggaaaggcgggtttggtcccagccccagagggatctcagctgtcgctcggggccggacctatctcggtccatctaagggtccgaggcacagccccgccaagaggccacaagtgtcagctgcttccgcgggaagggtgagggctaccggggcacagccaataccaccaccgcgggcgtaccttgccagcgttgggacgcgcaaatcccgcatcagcaccgatttacgccagaaaaatacgcgtgcaagtgaggtgggggggcgggcgttgggacgtgctgctgcgggtgagacgggaggagggtagtcacgggcttagggctggaggctggcgggctagggctgagtgcagcgcctgcttagagaccttcgggagaacttctgccggaaccccgacggctcagaggcgccctggtgcttcacactgcggcccggcatgcgcgtgggcttttgctaccagatccggcgttgtacagacgacgtgcggccccagggtgaggcccaagcttgggggctacagagccggggctggaagcctggaaccggagggccggggcggggtctcggcctgatggctgcccgcaccggccgcagactgctaccacggcgcgggggagcagtaccgcggcacggtcagcaagacccgcaagggtgtccagtgccagcgcgggtccgctgagacgccgcacaagccgcagtgaatccctggtgctcccggccccgccagggccctaaccctggggcggcatgctttgatgtctgggaccagagcctggaaatggttgagactaccctgccacgacttcgctcccgctcccgcctcggttcacgtttacctccgaaccgcatgcacaactggaggagaacttctgccagacccagatggggatagccatgggccctggtgctacacgatggacccaaggaccccattcgactactgtgccctgcgacgctgcggtgagcactagtgacgcttgccccatgaccctgcctcagccctcaccaccaaaggctggctcccttaaccgcagtgaactttgtctttcagctgatgaccagccgccatcaatcctggacccccccaggttaggagttgggccagttatgggtcaggccctttagcccacgacatccacacagtctgggtttcatccagcccaccccatcctacagaccaggtgcagtttgagaagtgtggcaagagggtggatcggctggatcagcgttgttccaagctgcgcgtggctgggggccatccgggcaactcaccctggacagtcagcttgcggaattggtgaggcacaactgcctgtctcccacagagaggagctgaggttgtgtcctctgtggttatgccactgggggctgggaatctatccctgcccccagaggtcctagccagaagatggcaggtctagcatctgtcccaggagtctgttccctgtcctaattccccactcctctaggcagggccagcatttctgcggggggtctctagtgaaggagcagtggatactgactgcccggcagtgcttctcctcctggtgagcctcccttgtgtttggggacccagtctcatcccaccttcccctttccccaggcaagctaacaagtgagccttggggcaacggactgagagtcacaaatgacctagcagagcttctctcccagccatatgcctctcacgggctatgaggtatggttgggcaccctgttccagaacccacaacatggagagccaggcctacagcgggtcccagtagccaagatgctgtgtgggccctcaggctctcagcttgtcctgctcaagctggagaggtatgtggacaacctgggagggtgtgaggtggggctgagccttgtggcctcagaccctgagtgcccccattcttgctaaagatctgtgaccctgaaccagcgtgtggccctgatctgcctgccgcctgaatgatatgtggtgcctccagggaccaagtgtgagattgcaggccggggtgagaccaaaggtaagagcatagtgcacaggactgctggtggccaggaggcccagccctggatcttcctccaggaccgtctccttctccccattcccctcactgcaggtacgggtaatgacacagtcctaaatgtggccttgctgaatgtcatctccaaccaggagtgtaacatcaagcaccgaggacatgtgcgggagagcgagatgtgcactgagggactgttggcccctgtgggggcctgtgaggttggtggcagggccctgggccagccctggaagggtatggggggctagaaatgaactattttatcatgaagcaggctagtcatggctgtggcccagggccctcatcagttctcctacctgccagggtgactacgggggcccacttgcctgctttacccacaactgctgggtcctgaaaggaattagaatccccaaccgagtatgcgcaaggtcgcgctggccagccgtcttcacgcgtgtctctgtgtttgtggactggattcacaaggtcatgagactgggttaggcccagccttgacgccatatgctttggggaggacaaaacttgtaagtacagtcaaggacaagacttgtactcaaggctgagatttaataaaattcatatttttactacttcaccaaggactttcttaaatgaaaatggtttttccccctacaagtaaacagtaataaagaagagaattattcctagtgcagtttgttttcatggtcttaatttttgctaagactccactgcttttgccttatcaatacaagtgccaacacagtgaaaaggcaaatatcatcttagtattactctgaaaatagttctgagctaatggcctactgaaaggaaaagagtggctcctgctattctattagacttattacaattatcttaagtattctttctaccctcctttaattgaatggaaacagggatggattggaggagctgtttttctcctttctttcccccggcaatatttactatttaatgccacttactaacactcaaagaaacaaaaccaaacttctcaattgacagtgcagtgacccaacaaagacacgggttcttgaattcaaagtggagcaggagagacggtaaatacacatttactttaatatatatatatttattatttatgtgtttaaagcacaaattagtttggtaaaaaacatctcatgtctgttttatttccacatccctgagactgacaaggggatgcctatcaattaattcatttagagagccatacaccccaagaaataaattatttgtcctctggagcttgtcacagggggatttttaaaaaaacattaaacagaaagacaactgtgcatcttagaaagataaaaggccaattcttcctctccggctgataggttcttaataatagtgatatctactaataagatgttttacatagtgtaaagcatgttcacatacaaattacttagcctctttgagcctcagttttcttatatgtaaagctggattaatagtacattttgtgtttaaaaagatgatgtatatgaagtgtttaccatttttcttggcatctagttcagttctcagtaactgatgtggtggtggtggtggtcatagtagcagtaagatccgtagtaatagtagcagcagttgttttagaaattagtaactgaggcctggcaaagttaaaggctctttcattaacacccagaggggaagaaatgaagctggtcttcagaggcaggctattttcactctgtgtcccaaattttcccccctagaccgtttttatacttctggggctctcagaaaatattctcagctattctgttagcttgatctcctaccatctgagagtgggcttccttcaaacaaccaaatttccaggtatttctaaactgcccttcccctacaccattctttgattcagtatttcaagacccctaagagaaatggtacatttacgtgtaagcacaggatagtgaagtatttacaacaagtgctttggagccagcaaatatggatcagaatgcagctttcctttcctacatacatgacattgggcagctaatttctaagattttacttctttgtctatgaaagtggagtactagtacttgctttgtgcaactctgatggttgttacatgaggtagcatctagaaacagcttgcacattgccagacacccagtggaaggtcaatgaatgactatttgaggactaactattacagaaatgtttactcttctgagtcctgatttctagtctcctggactaaataggttcactgttttcctcccggttcagtttccagacacatcacagaattataagaatattaaaaactcaggcttatacctacgcaggattttctataaccctctttctgctttgagctcctaaaggtatttcatagaaaaatgaccttatttttaaatagagggggcagttgaaaatcagtgaacggacctaccccctaatgatttttttctcagacataattataataattagcattataaagtgctaattatctttggacacagaggacctgcacaccagagacagaggtccgcattaagtaaagtgaatttcactttcttcagttgtgagatttctcttttttcttctttgtaatgatgcaaagatatatcatccaccaagcctcatttaaaagctttttccagttaaggaaactatctcttggccatccacagccagactccatattgagattatggatattcaaagaaattgtctttcccttgtatattgtcataactttttgtgaaatgttcgttttatagttccaggccagcacctagaaccttgctagaataaaaaactgcagaaatcatgagtttctagtttggatgaaagagcacacctattaacaaatgatagacggctatcctactgtgagtcctgaaaactggtggtgtgattgttgaatgggttaggggtatagcagagaaactcagtgtgggctacatacaatttcagcttgaatcacacttaacagatcctctgttccaaccatttaaatttacaaagaagaaactaaggcacagaactacttgagaagagaagcagaattgaaaactagagctcctgattgttctcaaaataatttttatcatactgcatcgggttctaagtgagagggcttcttatttagtaatgccaaggtcatgtgttaacatgtaaaaaaattagacgaggaatggggcattggtgtaagattatacagagtgtaaagttgggctttctcttatcatctgttgtcaacaacaggatgattgttactgttacccactccttaccatcattcacacagagacattggatattgaggagagactttaaaacagaatattagtaatgcagagctataaagagccacgatcatattaatacaatcctccatacacatagtgacctgtctgcagctccagcctagagaaacccagttattcatttgtagtgggcagccccattatcagaaagcgctattcaattggaagtgctcatctgtgttaggtcaaaaacgacttcctctaaatatccattctgtgtattgaagtataaatgagtcccacttaagaaaaaacaaaacaaaccaacttccaatgatttaaaaatactaacgtgaccctcttacgtttacctaaagctagtgtttctcaaacatcagctgtatcagaatccctgaaggacttgttaaaacaaattgctggtctctactctgagcttctgattcattaaatgtgggatggtacctgagaatctgcatttctaacacgttcccaggtgaccctgatgctgttgctctgagaaccactttgagatccacatctctaagctcatcagtctgtccgttacaccttacaagacatactttcctaatctgacacccttctatttgtctttttttggaatgctttagaaatttagcagttatcttttttatgtattttacatttgttacagctttccttggtggacagatatgagttttctacttgaaaataaacacgtttttctttaaaatatcattaaataagagtgtaattagtgatataaagcaagatgactaaaaagaatctctcattattatgtttgcacagcctgtatagaaattatttgaactagaaaggatttgctaagtaaattatttctatttccctcacttaatagtgaatattatggtgattaggggaaaaaataagctttcttttttcttttgagatggagtctcactctgtcacccaggctggagtgcagtggcgcgatgtcggctcactctgtcacccaggctggagtgcagtggcgccatctcggatcactaagccatctcggcctccccagctcaagtgattctactgcctcagactcccaagtagctggaattacaggtgtccgccaccatgcccagctaatttttgtatttttagtagagatcaccatgttggccaggctggtctcgaactcccgacctcaagtgatccgcctgtcttggcctcccaatgtgctgcgattacaggcatgagccaccacgcccagctaaaagaagcttttctgatagtaactttgttttcccattctggagtttatggcagtatgaaaaagactgaatttataagcagaagatctgtttttgaaatccggggacctgtatttcacaatggctttgatgtgttttgattgtgcacctttagacaacttatcagtttcctcatttttatacagcaataaaatagtaacagctacccattaaattctgtacagaagctagggacagacgcaataacacttgcatatctataaaggctttgtaaatgtgggtattatatctaatgtttatgcacatgctgtttgattattttcatttggaattccactccattaaaggaaaagtaacatacgaattcagattcttgtaagtcttcaggcatgaggcctccattgactaagtacattgcctacataatttctcctaacccaaatgaatctccagttaaaccaagctggtggttatgtactgtctccagaggatgccaagcataaagtccttgagtatattcatcttggatcctctgattggacaactgcggtattgagacttcaagttcccccttgaaggccccagacggtacctgtaattttactcaagttttaaatgtatgctctttgttaagaaagagtgacaatgatttgatttattttccgtgactggggttagggatgggggagactctaggaatgtgacttaccagtgaggttctagttttataaatcataggacaagttttgataggcaaatgttggactatagggctgaggttgttttccaccacaacatatagacttctactagcccttgaaggaaaaaacacgagaaaatcagttgggtcagctgagtattcctttacgagtatggaacagacttacataacaattctgcaggtaatggctctggaaaggtcaaccacttagttttggacaactcttttctattctgtataaccactttttcaccaaaatgatactaaataaatatgctataggaagctatattttgacatgactgttttaggcaaagatacactcaccaacttactccacaagagtttctaatcagagaatatcatatggatctatttgaattgctcccatgcttggctgagcccaaaataatttactgtgcatatgtacaccaagtgagaaggttgaggaggtgtcacttgtacatctctttattcttttttttttgtatgtgtgtgttattttcatgtgttttgaaaggctctcttgcttagcttttattttgccattaaagatttttttctgtgctataactgtatttttaagtctggtttgagttcaagaaatccacaaattcacaaaagattaggaataatttgtgaacaaaatgatgcagaaataaaaaatgcattttccaaataactcccttgcagtccttctcgcccaactaccactttctattaagtttcttcttcctactctatgaagtgccatgagctttcaattcattgtattttaagtataagctatacttactaaccttcacgttattctttgctacttaaataagcttgctttcatagttcaattgacgtattgtttaactgatatttttaattggtatattttgatatatattgataattgatagatacataattcatttgagatattttgggtatggagggttggaaggaatcctttcataatttttctacttaaaagaaatcttttttcatttaacagcttttcccatggggatagagttttcatgaataaagcaaagtcattaaatgaggtatatggtacatcttttaagagtcacagaaagaagcaacaacaatttacccaggcagagggtataagtttagaccttggttgcctgatttgtgggacaagttctttaattttttttctttatattttgacttttttttggactctctcctccccttccaggctccaggtcaaatacttgacacctgaatgatgttcaattatttaaaagatggattggccagctcagctcctgtctcagacagactgtctttaaatgtattttcaacatgtcttcagacagttatttttcctctgttcaattttgttcatcttcttacttaaccgttcaagtgctcctatttcctttttaaatgtagtattgagaagtgcaaacattattggaaaagagagtctcactagcataattgtgcattatcttcctcttatatcgccggcctccctgcacccccatgcccacctcctcctcgcgcctccatgccgcctcccactgctccagctccttgcagctgcgagtccagtcactggtcacctttcgtatctcctcactcagagcctggttggccaaacctgcctggtccagctgttctcagagcatggcattcacctgggccaggctggcactcctgaatggggcacaggggatcagtaggcgctcgcccagggggccatgctgccagccctggccctccctgctgctcctcctccagccagatgagggcactctccaggtcttggctgtgctctgcgtcctgggtggcacagaggttaaagcatcaggctgggcaggtggagggcagggcctgcctctgccccaccctggcacccaccctcagctgctgctgctccagctctccggatctctccaacagctgctccagctccgagaacctcttcttgtactggagaatctggggattgggagctgatggtgagccccaggggtgggggcagggcaaagtgaacacgtgggagggaaagagcaggaatgggtggccctgaccttgccctgcagccgctgcacaagctgggcctgccgctgctggccctccaggtaggcctgcagcttgcgccactaggaggcctgctcctcctgcagctgcctccgcaactccacgctctggagtaccagccccctgggctcttgcgtctccagctcaccagattgcagccacagagcctgctccagctgcagggaagggccctgggtgagagtcctgggcctcctgggaaggcaggctcaggcctctgtagggggtggcaggctgggcccagacccacaatgccttgtaggctgatagcctggcgccctggggagcagcacatgtgggcaagcccaggggcagtgcacgtgtgcatggggtgatgcagccatgcacgggcacgcagatggggcatgcatggacacatgcaggtgagcccacaaacccaaaccatgcaggcaaagctcaaaggtgcacctggggtctacgtcaggggcctcagtacaccatgcgcctctcctccagaacacttagccctgtcgtggtttctgtttattacattgatgcctgtgtcttcccaccatgcccccaccccagtgtgagctcagaaagcctggattttttgttcctcattgtatcttagtgctataatggtgtctgtggaatggcatggctcacgctcagtaaatatttcttgtgatggtgaattaatggcatgagctcatgggaatacattcaaacagaggtgtcaatccgcctatgcatatctgagcttaaaaatatgcacacacataacacatacaggcaacctcaaacatccccagggggacacgaaggactcccctcatatacacagcattaagatttgtaagaggtgcacacagatgttgccctatacggcgcctgcatattaatgcccacttctggctgggtgcagtggctcatgcctgtaatcccagcactttgggaggtcaaggcgggtggatcacttgaagtcaggggttcgagaccagcctggccaacgtgatgaaatcccgtctctactaaaaatcgaaaaattagccgggtgtggtggcatgcacctgtaatcccagttactcaggaggctgaggcaggagaatcacttgaacctgggaggcagaggttgaagtgagccgagatcgcaccactgcactccaccctgggcgacagagcaagactccatcttttatttatttatttatttatgtattcatttatttgtctcatgggctgagcgaggggaccccggctggtggagggacagctgcgccctgcaggccgctgcgtccgggcagaccccggcctcttgtcgtgcccccggcccgcgacaacccgggcaggatgggcagcaggacgcggcggggcatccgcggagcccgtcgggaacgctctcttggcctccggtgccgggcagcggtgggtgcggcacccacagtgcccacagcgcccccagccctgggacgtggctccagcccgcccccaggcaggcggcctccttcgccgggagcacgtcgcctgggcaacatggagaaacttcaactcttaaaaaaacaagacagccaccacaacaacaaaaagaacagatataagccggctgtggtgactcgtgcctctgctactccagaggctgaggtgggaggatcgattcaaccaagatacagtgagactgtctctcagagaaaaagtcaaacaaacaaaaaaagaggctgtgtaagaggtgactctggggacagtggaaaaacactaaggttttcaagtggtgttaaaagccactaggccttggggaccattgagcaatctacaaagcacggaagcctagatccctgagctctgcctgccaagtaccaccacagctaacatgggagacctccccgacagagactgaaatttgcctcccgaggaaacaagtgactacagacatctgtcccaggacagtaaacaagaaagcaaggtctcacaaaaacaaaaacagctgaccacagcatacaatcactgagaccgagcctgcgactataggtgaaaaaaaaaaatgctgtccattattcataccatgaaagaccaggggaaagtgggaacgcagtcccctactactgttgtgggaatcaggagaacagagagaccaatgggtggaacaggaggatttattgactgcactgaggcccagcagatgaaaatccaaaggctgagccccgaacaaagacagggcttaactttatagacacttctgaaagggggtcggctagtttgaatggcgcggcgggaatttgatggcatgaaactcgggggcaggcaagagggcttatagaagcagaacaaaggcagctaatcaaactgtcacaggtcttgcaatgcaagtatagctggtgaccttgcagctgcactgaagggaaatcaagaacttaacaaaacttgaataattagaaatgggaagggggaaagagaaggtagtaaaggcatttgttgttttttcctcttatctttgttggggcttactgtgttgagagagtctccggaactcactcctcgcggctctgacttttcagatcgtgttaccgaggatctactagggctctatctatggcaggtcttggagtcagccaagtacagggaacctgtcttttccttttaacttctgccttattactacaagttgtacagcacaccatgcctggttttcatcagcaatgtttcctgaggttacagaaagatttctaatcctgggaggaaacactcccttgaagcaaaagtgttctcccccaaaaaatgcaaggagctatcttctagatagccaggcagataattctcaggttttgccccacagaatctctatctaaaatacagcagtggtcatgcctagtgaaaagtttgagggaactcgcccagtgttgggtttcttcagagccatatatatagatataaccaaatatcctaaaagacactgcccttcatcattccatgctgttagacatttacaggaccatggatggtgatctcctccagacaaaaataaatgctggtgcagaataggtaagtgtattataatttgaggacatcagcttttgggcattttaaaccatgggtcagacatgttagagcaagaggccaggttgatagcaagagggagtgtttttcttttaatttgtcaatagcaaagtgatgtttgccactgtgatttcagagtgaggtggcaatttgttgttgtttggttttgtgggtttttgtttgtttgtttgtttgtttgtttttgagacaaggtctcactgtcacccaggctggagtgcagtggcatgatcagggtttactcctgccttgacctcatgaattcaagcaaacctccttactaatcctcccgagtagctgggattacaggcacgtgaccccacaccctggggtgtgaactgggatttgatgttttcagttggctctctaatggaataggttcccttactcttgtagaatcagattgtcttcatgattatcattcttgtgtgcattatatttctactaccctgctatttttttttctatttttcttttttctttttatttttttctttgtgagacagagtctcgctctgtctcccaggctgtattgcagtagcaggatctcagctcactgcaacctccacctcctgggttcaagcaattcttttgcttcagcctcctgagtagccacctggctaatttttgtatttttagtggagacagggtttcaccatgttggcaggctggtctcaatctcctgacctcaagtgattcacccgcctcagcctcccaaagtgctgggattacaggcatgaactaccacacctggctctcaaaccattttagttaagcaaagacagatttgtctggctttttagtacaatgctgaattatcctccaatctatatttttaggaaggacctcgggaatggcaacttggagatatttggtgaaaatgtgaacctttcatgttctgcttcagtccctttttgaaaatccttccaatttaccttttgcaaccagttagtggccttcccttcttcaccagcatgtgagttaattgataaagatcagaatatttgggctcaaaggtttcaacagttaagtcaaattttctgccaaagcctacaggatcttggagcctgctttagaaacagaagagtgaaatgtatttaagtttagatcagggaagtcctttataatattcttaattcacgttttggtgaagtggtatacacaacggtaggctcccctcttcctgtgggtttgggttttaccttgaaaggggctgtcagaacagaagtttcagggaagggaccagatccctggggactttccttaggtgatggtgatggaagaagaggcaaggcaggacaggaaggctcaggtaagaaagactatgcaggtgcaggggcaggaggagaaggagcagttggaggtgaaagagacaaagcctcctcaatatttctcaaatcagaaaacatgacagtctacctccttcagcttacttcctcaatggaggcaattttctcagttcttttagaaattttagaaatttagacatttctaggtctcattggaattaagtctcctatttaatttgtctggttcaaaaaccaaatttctctctctctctctgtttttttttttttttttttgagacagggtcacccagactggagtgcagtggtgtgatctcggcttactgcactcaccacttgctgcatgacagccaataagtcgagagttgaggtgtaggggcagggaaggtgactttattccagagagccaccaaactgaacagatggtgaagtaacatcctgaagaaccatcttaaattaatactattttccggctccttgtacattagggaagggaggaagaaggaggcgattgaggtgaagaggtctgacaatgacagacatgggctgcagtgagagcccaaggggatggtgaaaattgttggtcctttgtcaggtcacacttctcttataaatcttcagcataacactgttacttgtgtatacaacctctctatcttctcaggagttagtttggggaagggattattatcatctgtgctttaaagttaaactgtaagctaaatccctcccatagatagcttggcctatgtgcagaaataagaaaaagcagttagcctggaagatgtcaccacacggtaggaagggttaggagcaaaatgcagtcagtcatgctaggcctccttttcattgccatatatttaatgtatttgaacacgtaagtttaattttttatactttatttttatttatttatgatttttttgagacagagtctcactctgttgcccccccaggctggagtgcaatggcgtgatcttggctcactgcgacctctgcctcctgagttcaagcaattctcctgcctcagccttctgagtagctgggattacaggagccccccaccatgcccggctaatttttgtatttttagtagagacagggtttcaccatgttggccaggctggtctcaaactcctgacctcgggctcccaaagtgcttggactacaggcatgagccaccatgcccagcctaaccaagattattaaaccattctaatttgtcaaaagagtcacactgatttttaaaaaataatgtaatgggccaggtgcagtggcctatgcctgtaaccccagcgctttgggaagccatagcaggaggatcatgaggtcaggagttcaagacagcctgaccaacatggtgaaaccccgtgtctactaaaaatacaaaaattagccaagtgtggtggtgtgtgcctgtaatcccagctactcaggaggctgagacaggagaattgcttgaacccgggaagcagtggttgcagtgagccgagattgcaccactgcactctagcttaggcgacagagtgagactacatctcaaaataaataaataaataaataaatataataataatgtaatgaactttttcatgtctttatataaaaaatattacattatttaaattgttcaaaagcatcaaagattcctctctgctatcaacttcatttattttattgtaccaaactaccaggaccattaatttaatctacagctaaatctattattttttcatgttagaaattcaacaagaaaatttttccctaatgaaacctcacatttcaagcataaggagcctgggcgagttggctcacacctgtaatcccagcactttgggaggccgagacaggtgtatcacttgaggtcaggagtttgagactagcctggcaaacatgatgaaaccctgtctctactaaacatataaaaattagctgggcgtggtggcgtgtgcctataatcccagctactctggaggctgaggcagggaaatagcttcaacctgggaggcagagcttgcagtgagctgagatggcaccactgcactctagcctgggctacagagcaagactctgtctcaaaaataaataaatagataaataagcataagtagtaaaaaaataacataaatttaaaaataaggcacagggtcttgctctgttatccaggctagagtgcagtggggcaatcatagctgaccaacttggaacttctgggctcaggcaatcctcctggctcagcttgccttgtatttttttagagatgatgtcatgccctgttccccaggctggtctccaactgctggcctaaagcaatccttccgcctcagcctgttgagttgctgggagtacaggtgcaagacatgcagcctagcattgtagtaaaacaattttcaacaaattcttaattttctttccttttttttttttttttgagttgggagtctcattctgtcactcaggctggagggcagtggcacaatcatagttcactgcagcctgagattacagtcatgcattatcatgcccggccaactttaaaaaattagctaatacttaaaaatttgtagagacaggggtttcactgtgttgcccaggctggtctccaactcttaaagtgctgggactgtagctatgagccaccatacctggcttaattttcttattttaattttatataagtgagtattattgttcctaagataattggggcagtgactcctttacaattttagagatctaatttgtctattcacttcactgaaagagtatgccaatttgtttcatgagaaaatatcctatatttgaaaagaaggaaaattccttccaccaaactagggtgcattctaaagaaacgaattgttctaagtaacatcacttaaagtgcaaacagaggcaatggtatctattaacaatgtttatcagtgaaggaaataaactgaaaatatgaacatcattagatcctcggagggccttcattgctgaaaatctgagtaatattgtgatactcttttgagtctggcaggacattctctttccagggcatgtaacagtgggtgaataatttcttttcattcatttccattaagggctgaacttccttaatgttctggagattattaaatttgatttgtatagttgtgaaaagtactcatattgctgattccattgcttatatgtgatcatataaatcttttctctttctgtagtgtggtttaaacttaatccttaaagggcatgtatttgaatttttcagctggttagaaacctgaatataccaatcaaataaaactgctccttacatgctacagatttagttttcttcctgtactaagatgtcttttagatacagtaaattcgttaaagccaagagcccctaggaaatgaagttgggtgggaggggggacatcgagtagtaagatcactcttgtaacagagatgccactcttgcagatattgacaaaaattgggcctataaaatgtttaccaaacattggaaagacaagatctgaacaacttatcattgctgcagtctcaaatatcaggaaatgccattattctcaggacaataaatagacaataaagaagactcacagaccagattagctgtcatgtatcaccaaacagggactggatccttgttaacacgacccaacagagattgtccccagaaattcacttcataacctcaaaaccaaaaacccacactgatggcaaaaaataatgatgcaaagaatgagagagaaagagagagagagagagagagagagagagagagagagacctgtcctatagccatactcagtgggtaaaagccaaagagctcaatttctgctcatgatacttaatagaacatagggaacatgagccaatagctcaatgggttcagatctgcaccaagtgcctgttggacgcaggattctactgtctccaataatatgtctcagatgcactaattttttttctctttttgagacagagtcttactctgttgcccaggctgcggtgcaatggcgcgatctcggctcacagtaacctccacctcccgggttcaagcgattctcctgcctcagcctcccgagtagttgggattacagacacacaccactgcgcccggcaattattattattatcattattattattattgtgcgtgtgtatgtgtttttagtagagacggagttttgccatgttggtcaggctggtcttgaactcctgacctcagctgatcaaaagtaggtgaggtcagaaaacataccctgggagaggctggcacaatgcccagaaccgctatcgctaggcctggggttttcctctgtagtggaatactagtgttcatgtagtgcagggacaaaaccaattagatagttctgggagttaaaaagagatgatttacagtgccatttgagaaggggtattaaggaatttgccagggcactgatgcgtgtcaggtgtaaacctcaggttgagagagagctaagtattttctgtccatgaaggtgataagcgagggcctgaagaaagagggactggggaggacactggcaccagaaataggaaagggcttcttgggggtgggaaggatgggtcacggtgctatctataaagttggctggcagtggatgtaggatgtgggagtgagacatcaaacatgaagcagtcgcttaaagtctaaagaaacactagatatatgaactgcaggagatagtagggaaactggaccggctcctcataaaacttcccgccttctatctccgggaggatcgcagggcatttccgccaagacaggtgagactgcggttctgacctgcgggcctccatgcatatgcgctagggcacctgggggccggcagagccgttcccctacgcaaagtaagagtgttatgtctacaacccaacggggacactgagagccccaaaggccctgctttcttcccagagaacagcgcccatctgcataatttctacctggctctatgaggtgagaacacactccccgctagcacagaaatcctacaaactcctgtgggggctgcgcttggaagcagaggctgtgtaagaggtgacttggggggtagggaaaaacacgaagattttcacacagggtgagaacccaagagactggagaccacggaccaatccctgcaaaaagcagccagggtagaaatggaagagctgagcggacttcacgatagctaatttgtgttacaaagccgatacggctgatgctcgctttttctcctatggcgtgcaggccacatgttacttcttattccccaggcctccactgtaggattaacaactaagacacaaaccaatacgaaaaaagacatgacccttggcgtacggtctgtttttgaaactccagaaagtcaggggaaagcgcgaacgcagtcccccactaccacaaattatgcagtcgagtttcccacatttggggaaatcgcaggggtcagcacatccggagtgcaatggataagcctcgccctgggaaaaccaccttcgtgatcatggtatctcccctgccaggtaagtatgagatcttcgggctctgccccgacacagcctcatacgcctcactctttacacacacggtcacttgccccgcgcactcccgagccctttccagccctgacacacagctgggattctcacttccgatccgcggtcctgaacccgctcccagggcacgggaactccttcgtggcgaagcagcaagtggcgaagcagcagcctctgcgctgcctcatctacatagaagtcgccctgtccgtgatgtcaccgacagtgccttgcccagtccccgtctgcctttctgccactcaaccgaccaatctgctgccagagccgccaaggggaagtgacgtctgcctctccctttttccctcccgcccctgcgtctgttctctcccaaagaagctggtccttagcctgtgttaaggagcaacctttcggtggccagatggagccggggcatccttcttcaaataatggcttttaattcgcagactagaatgtttcggattacaaaagaaaccggttctcttcacatccttatccttgtgatgcagcattccgcttgcaattggaagccgtttaatatcagagagaaaccatatttatgaaagtaaagaggctgcttagatgactgcaaaccagccgtccttactggttttatcactggtaatgttataaagacagttgtccagtttcatgaatcttgtaggtttttttttttttgatgttgttttttttttcaaaaatccgtattgtagaaaaatatgctgtcccagaagagatgattggacactctcaagcgtggtgctggactttgtcatctcttgcacagccatctccacaccttagtgcttacctcatgttagttttttatattctgcaaagacgaaaccaaaataatccaaatttgacacaaatacctgggctacatcttatttgagatgtttaacaaatgtctggatcatcttttcttatatattacgcaggaaacactgtgaagtaagcaaagttggaatgcccaagtgaaagaccatttgaatatttacaagtagatttcagacaggaatactacagggtggtcacaggataacaaattctaggcagcagatttacatgacttgaggctgtgggctgttaagacgctgaaaaaccagggtgtggaccaagctggctaaggctgagtggacccaacgtggtgctggattggatggaggttttacctaggccctcattatatgctcattaacatactaaatcacacacccgccagtgccatgacagttctgagaccagtgtttgatgtaaaaatggcaccacagttccaagaaatctccacctttacccaggaattttcgtgaatattccaattcttggttaaagaaacccatcaagatgaaaccccagaacccattattctctcttgggtatgcccaagctcccctttcttgagtgtgtactttttgctttgcaataaatctcttctttcactatctgctgactcatctttgactttgttctcacgatggtgtcaagagcctggacaccacggctggggtcgagatcccaccagtgtccagggacctcccccagcccaccagtatcagattctattccattgctcaaatcacaaaacatcgagtggagagttctccttggagatcataaagtaaagattctgtggcatggtggccagttaggccactggaagcatggcaaaatattgaaaatgagggattaggtgacagtgtagtaactgctgaatactaaatacttgatccaggccccattccctggagattgacagggagacacattgtccaggtagtagtggagaaatgttttctgggtatctgaccagcctttgtggaaagaactggcaccatcctgcagatgtaaccgcctgatgggttcttcctgaccaatgtacacaaaaactcaattcatggagaccatggcactgcaggaaacggtttcattgacacaggccagccacgacatgtgggagacagagttattactcaaagcaatctcactgaaggcttggaggtaaggggtttttcaaagatagtttggtggggagggggctagggcttgcgtggtgctgattgttggggatgaaatcacaggggcgtggaaaatggccctcctgcatggagtcagcttctgggtgggggctaagggactggttgattttcgggccagatggtgccttccagcagtcagaaatgcaaaagcctgaaaagacatctcaagaggccaatcttaggttctacaatagtgatgttcttcacagcagtaattggggaagctgccaatcttgtgacttctggaataatggctggtaattatttaacgaggcatacatcttagtagaaatcaggcccctttcatccttctaacttggtggcctttcattcattttacaggggtaatttagttttggggaaggttatcatttaaagcagcctttttggctgtcctcaacctttttgtcaccagggactggtttcatggaagacaatttttccatggaagggggtggtggatgttttccatatgaaactgttccacttcaggtcatcaggcatcagttacagtctcataaggagtgcgcaatctggatcacgcacatgagctgtatcaccactcagctctcactccagcctcaggtatcagcaagacctcaccaaagattactgtttaattgtctctgtgtgtgtttttgtttgtttcaggtaacaactaatgttggaattatgaaaagctcttctctacttttaacaaagcttagtcacaaacagttccccagttgatgagaaaaactaaaacaacagaacaattgaaagtccgaatctgcaagttcatctctgagaaccgaattttacagccactccagatttgtactccaaatggatagtttgattgtagaaatcacttcccttcagtctgccaatgtgataactgcccaagagaaagtgatgcctacattcgtagataatcccctttcccccatcctatatataactggagtcaacagtagctggaggaaaatggcaagaacttggaatcaagattaggttagaataacactgctgtagacagtttatcagctcttcagcatatgtccattttccttgaaggatgagcctttagaaacctctgacaataaagtttattttacatccattcccttgcctatgattttttcatacaaatcacaattataaaactttcttgctccagctaaaagcaagaaactcaatcatgaatgtgttcactaaatatataccacagaatgatagcaaccagtctgaatgcatcacttgattccaaaattaaatgttagccctcagtggtgcaactacatgtatctccaactctggaagccacaggcaacatattcctgtttccttgcagggaaacagatctataagcagggcggcagtctcacacatgtacattcctgggaaacccaaggaaacaatgatagtgacgcagggcaggcaagcccccaaactgaaagagttttgctaatgtcgcgattggctttctatgttatttgaagactgagatctccatgaggaatgaagacaggtaatgcctaaggctgaggcatgacctcactgggtcaccttagctgtgaagtgaggtcagttgtcaccttgcaaaccttttggtaatccaaatcttggaatgatttctttaagaatttagacacttccagtacttttcctgtccttgtggggaaagcttctatccacctggtgaaagtgtctataaatactagcaaatcttgtagttccctgtaaggtggcatctgggttaagtctgtctgccagtcttcaccatggtatgttccttggtgttgtacaggtttaagcagggatcggggtatggggtggcttcctgagtggtaaccctttttatagtttagaacagtcccttcccgaagaatatttaggaaactaatttgaatggaaaatcccgtcccaaatgtgaggaatcatgaaaatgtttaattatttcccatctgtcagcctcaggaatagagtttgttcttttgtagcaaccatccagaggggtctccctggaagccttttactcagtccctttaatttccttaggggtatagtatggtgtcactgacacggatgcagtacctggtagtagcgcagcagcttgaaataccagggtttccttagttgtggccttagctgctctttccaccagggaatttcctctaataataaaagtgtctcccttctggtgtcccctgcagtgagtaattgttatttctttgggagttggacagcatctaaaagttccaagatctgagtaaagtcgtatgggggatcccttggctcttgatagtcccctttccttccctatggctgcatgagcatggagcaccaggaacccatatttagagtcagtcaacacattgactcttgagggttcatcctccccgcaggcaactggagatgtattgtccccagagggtacaatagagaatcttccgtcacaagtcagcaaccagcatatgtgagtgacagcatgtgtcccactcagaaatgagagtgtattagtccgttttcatgctgctgacaaatacataacagagtccaggaccaaaaagaggtttaattggacttacatttccatatgactggggaggcctcagaatcatggcgggaggcaaaaggcacttcttacaaggcagcagcaagagaaaatgaggaagaagccaaagcagaaacccctgagaaacccatcagatagtgagacttactggctatcaggagaatagcacaggaaagacccgcccccatgattcaattacctcctcctaagtccctcccacaacacatgggaattctgggagatacaattcaagttgagatttgggtgagggcacggccaaaccatgtcagaaagggatgaagtgacagcatatcctgatgtgtgtgatggtttcatgagttattatctatttcaaaatttattgcaatgtgtggaaaagaacaaggacttgtactatctgactttaaggtttactataagctatcagacacaaggcatcaagagtgacaaacggataaacagcctgagttagaaaacctgaaattgatccacagctatacggtcaataaatgggttttcagtaaaagcagttcaataaaagaaaataaatcatttcaattaatgaacttctatatggatgtggggagaccaacaatgttattctccctcacgttacacacaaaagtaatttcagccgcattacacaccaaaacttaaaagttaaagatataaagcatttcaaggatactttgtgacttgttggcaggcaaagattagcctaccaacaagcaggacacagaaaaaatacatatataagaaagacatgataaatgagacttcatcaacattagccacaccttctcatcaaaagataccactaagaaagcgaaaaggcaagcaagccacagacagagagaaaatacccacaaaacgtatctgacctccacatcctgcaattataattatagtggtctggtacactgcacccagtttctgctggatggagtattttctgggtgtctctaatgagtaagagagggccccatgggatattccttcagttcccagatgaacagtgggaaagactccacattgaccaacctcgggggcctgaaaacccaggtcctcaaggagggtagagtatacctggaccctgacccagacccctggatgggctgtgccaagagacccagcaagggaagggatttcctcctgcctcaggttctctgttcttctgtggttagaccacctgaacccaactccctccccaagcactagagatgggcttttccaagggctggggatcttgctgtcctgaggacagctgagcaagggggtcgaggaggagcttgggttgtggaggagaggaaaccgggtaagatgcgtgaagcagttggctataccaggcacagagaggacccgctgggacccaagagcctgcatgtgaagccaggccttgggccaccttgtctgtcaagggggtgcctacttccatggtgtcttcaaagggactgtggaaagagaggccttcagcccacacctctgaatgcttttccaccacagcatgccctgtggcctttatcctgctggtgtggaacagtcagacccctgcagggctgcagagcctctgtactgggcggcatcccagcctgagtgccagagctcagagggcaggcccccgagcaagcagagaggagggcaccttttggacagaacgtgtgggacaagagcgatggctcatccgttcaggttcctcacaaaatgagagtcaggaagatcagggcgccggcctgatttcccaggcagggctgaaagcagacaaccggagggagagcagcacctgggccaatgaggtagaagacagaagaccacagtgtactcctgccctcaacctcaccccctcccacccacatcctccacactccctgaccaccttcctcagaagtgtaataggaatccagattccccctggcctggttgctgcaggaggcacagtagcctgatggagcctgaggcaggtgtgggaagatgtggattgtctaactggaggttgggagtccagggtgtagaagcagcttggagtgcaggatttggtggtacgtgtgtggcagtaggcaaaagaaagagacaactggccgggcgcggtggctcacgcctgtaatcccaacactttgggagaccgaggcgggcggatcacgaggtcagatgaagaccacggtaaaacctcgtctctactaaaaatacaaaaaagtagccgggcgtggtggcgggtgcctgtagtcccagctactggggaggcagaggcaggagaatggcgtgaacccgggaggcggagcttgcagtgatctgagatcgcgccactgcactccagccactgcactccagcctgggtgacagagcaagactctgactcaaaaaaaaaaaaagaaaagaaaagaaaagaaaagaaaagaaagagacaactgagccacttgaaataccaagagaattcaaatttagaaaattcccagggaactatgcgtgcaggcactcaccagatccacaaaacagctgctgcataactgcatgttgcaagcaagccctaaattgctgattttgaaacagcctgatgggttcacaaagacaatttctgaatagtcgtaagagcagaggtgcactaaagccactgtgccccgcaggcccggatcccagtaagttctttaaggagtaagtcttacttccatttatggaagatttttggagttgtccttggtcacccccaggaatgttttggttaggagtagaattttagatgtcatcaatttaaaaattaaaactaaaacgctggaactcatagagagataaaattaagagaatacattcactatcctgagtagaaagatttcttatagaacataacaggctttaaaaataaagaaaaaaggccgggcgcggtggctcacgcctgtaatcccagcactttgggaggccgaggcgggtggatcctgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagattgcgccactgcagtccgcagtccggcctgggcgacagagcgagactccgtctcaaaaaaaaaaaaaaaagaaaaaatatggcaaaatttcatctaattaaatgctttgagaactaaaattaaaatccaaagccactggacagactgcttcttggccaaggagaccccagagaagtcttaaatactgagttcctgcccagtagttggaatctcagacacctctccttatactctctccctttgtggtttagacacaactgaccagcattattgttaaaatagagatcctaagactgacagaacagactccttgcagtaggaagatacggtatgataaacgagacctaaggccacgccaggcaaggtggagtcatgcgcccctcaacttaaagaataaactatgttctaattgccacaggtctttttcttcttcctttttttctctagctaaacaagcactggccttgagataagcaatgctgaagcacttgcagctcacccattaccataaactgactgagccctccctacacaagccataactacagctttgattggacaagagactgatttcagtaacttccccttgataagagagcactggctgtggacgggttctggacggtttacagaggctgtgcacttgactgcctttgtgtccctgcttccccttttgaagcatagggcctaattataatgtatttaaatgttgtctccaccccaaagtgaacatgggttgcatgtaacaggcatgtttactcagcatgcatgcagcaggatcccttcatgaatattcagagctcctcctattccctgttgaatatgtatatgtggcccaccacatcaacataaatccctgttcccccctcccctccctggaaacgtacttttcaggtttcagcagcaagagggtatgcctccctgtctgtcagaatggccaccttgcaggctgtaaccctttataaaaaataaaatctcccttctaaatttataaattgtgtgatttttcagttgacagctttcagtcagacttttcactgactgggaaaagtcatttgcaatatatttattttaaaaatgactcctcaggatacaaaattcttgtgcaaaaatcacaagcattcttatacaccaataacagacaaacagagagccaaatcattagtgaactcccattcacaattgcttcaaagagaataaaatacctaggaatccaacttacaagggatgtgaaggacctcttcaaggagaactacaaaacactgctcaacaaaataaaagaggatacaaacaaatggaagaacattccacgctcatgggtaggaagaatcactatcgtgaaaatggtcatactgcccaaggtaatttatagattccctgccatccccatcaagctaccaatgactttcttcacagaattggaaaaaactactttaaagttcatatggaaccaaaagagagcccgcatcgccatgtcaatcctaagccaaaagaacaaagctggaggcatcacgctacctgacttcaaatgatactacaaggctacagtaaccaaaacagcatggtactggtaccaaaacagagatatagaccaatggaggagaacagagccctcagaaataatgccacacatctacaactatctgatctttgacaaacctgacaaaaacaagaaatggggaaaggattccttatttaataaatggtgctgggaaaactggctagccatatgttgaaagctgaaactggatccctgttctcattgcttgcacctgggagacacaggttgcagtgaactgagattgagccatggcactccagcctgggtgacagaacgagactacatctcaataataataataatagtaataatttactgttctcataaaaattagcggatggggaatggaggcaagccggtgcaaaccatgacaactagtttagattttattgtcaactcatgaaaaactcgttctcattttgtgtttttaaaaaattccactgatacagccgttttctctaccgaaaaagactataaccgcattatttcatcactggaagctacagacagagggcccttgagaggcggcatcttcacctacgggaatgtttcctgctcaattgtgagacaaagagcatgtccaagttttcctataggccaggccgccccctagtttctgcgctgtgggctaaactccagaagctggcgcccttcagggccagaggtttcctgtgctctctggaggctgctaggattaaaggcaaagcaaacgacaggtctattagccacagttgcaggatagaaaacactactgtgactcagattagaacagaggttgtggcaaccacaactacaagtattaaccactacacgaccacaaagtctgctgacaaccattgcacttcttctatttttttaatgtaaaaacactcacactattttatctggtttattctaggacgtccgcagatttttgtgcttttctgtctttcatgtgcttctccctttctctccccattctgctacataatttaaaaaaaatctcttctctcaggatccagccactgcctctacaacaagcctcctgggaggtctctttgtcccattgacatctctgccttctttcgctgcttttttttttttttttttttttgacggagtctcgctctgtcgcccaggtggagtgcagtagcgcgatcttggctcactgcaacctttgcctcctgggttcaagcgattctcctgcctcagcgtcccaagtatagcgtcccaagaatagcaggtgcatgccaccacattcggctaatttttgtatttttagtagagatgggatttttccatgttagccaggctggtcttgaactcttgacctcaagcgatccatccgccttggcctcacaaaatgctgggattacaggcgtgtgccaacgtgcccggccaaatttcaggccaacacctgttgacacacattgccagacacacggaatccctcgcggaacaccgatgggcccacaaaacacgcgggggctgcggtcgctgatgatgtgagcaaattcgattcacggtgtctggggtacagccctgagggttcactggccacctctgcgcaaggaccagtctccgccgctcccctcatctccacgcagattcttgcccacacacctcccctttctttgggccgatgacaactcttggacctctgaggtgactgtcctgcccgcagcttctctccttccaagagtgtcatttcttgatcctctccatagtggctcaacggtaagcccaaggtccagcacgcgaatcaggaaactgatggttctttgggtttgcagggatccttccagtgaataaatgaaagtaacaggtaccagtatcaaaactgcagtgactcaccagagacacttcatgcttgccagcttgctaagctgtttgagtccaacaactgcatggggtcctgggttagtctcctgccgctactttggtgagtgttgttgtcactttaccttgtggtggccaagcccctaaatgcactcttgggttatgcagtataattttcagcgtaaaagacaagtaaagagccatagcgaagtgaaaaacaaccacgtgcagtggccgggaattgaacccgggtctcccgcatgggaggcgagaattctaccactaaaccaccaacgcctctctggaactaccccctggaggataacagaaaagagtaaccacaaagatttagaaactgttctaagcggttttttcaagtgtcgactaaaagctaacaaagacatccaaaccaaatgtgtttttataggaaacttttattagacaacgttataaatatcaaaatagctcatttgtcggatcaaactcttaactctgaaaaaggtctttctacctgcattacaaacccctataataaaacatcagaaattcattcatgtttcttttttctaatcctaaatcttccatcatcaacctcaaactgctgccttagaggttctgagaaggtaacctaactggtagtttaggtaagtaaagttcaaatccagggaggaaataagaagcagaagcagaattagaagaaagacgaaataaaaggacagaaccacggtagagataatgaagaaacaaaggttggtccactaagttagtcttttgtcgttggttttttttggcaaaagagtaatgatcggtctcgtaatcattataatactattatttgtctgcttgaagatgtataaagcatttgaaggaaatgtgatgtgaaaagatgaagaacgcttgccgtcaatgtttcattgtttgggagaatcccatttcctaagttaatatgctttgatgtgttagctatgtaagcagtagactagtttaaggaaatattgacggtcaaatattaacatattagtcttttgatgaagttcaaatattagagagatttctttcctcaattttcaatggagacattcaactgaagagacaaatccagagttttctccacatgttgggtctgggagtcattatgactttttcaaagacaggagctgtgacatggaatcatgcttcttctcaagctgagaagccaagctaggtccaggctgagtcataaacttgagcccaccaaggaaatcatccttcacattgacctcgcagagctttggctgttctctgttctttgcccaacacccaagacacacaccagctctggccaacaaaccttaacatatgatctatatcaaccaaagctacatttattcccaaatctccttctaaaatacaaacctgtactttctactctcaacttctaaatctaccaaggcctcatatgcatctgagtcacagatgctaaaacttaaccggttttctgaggattatttgaggaaggggtatgcatgcaaatgtatatacataattcatgtgatttaggaatatggactctatgacttccagatgcagatttagaacctttttaaaaaatattttgtttttgttgtcttgcaaatcagccagatctgcaacttaccagagtaaagccaaaccaagcgggacccttaggaaatgcgctaagatgtcatccactttcagtgtcagcctgtgaaaattcaggcgacagaagagaataaagagaatcttaaggaatttctggaaccaaagctaatattaagcaggcctcttgctggcagaccagtggaaattgtacctggtcaacaatctgtctagattgaggaggtctaaaatgtagccacaggttcaaatacttttctgtttgtttcccaacctcgattaaactcacaaaatttagggaccaaaaaaacaaacaaacaaacaaaaaaaaaaacaaaccacgacgttcccacccagtctcgaatcagggacttttctcgtgtgaggcgaacatgataaccactacaccacagaaactgcatatgcaccaaaaaaggcaaaatatcatcatgaaaatcttagatcagccatttctattatcgtttccaaagtaagaaattcaactgcatttcgaaattcgactgaaaaaagcccaataagcaccagccatcaagaagactatggctcccaataggcccaggcttagcgttccgcgcccacccccaacacgaaaaccatggggacccacacccgggcttcggggacacatacccgggcttcgggctcccgcatcctcccctgggtatgcagttccagaactaagcgccgtgtgcgggatcctcccggctgacactcttcggctcccagaagctgcaggagccggcgggctttgagcctccgagccctgggcgccccgtgcctctcaggagggtggacgccgcccttccagggatgcggaccccgcctcggggccttttccccggcgccggccgtcggggctcttggctcttctcgtcctcccaggaaccgtagaaccctccttgccctccctcccgtaggccgaggggcgtgagctgcgcctgtttcctcacggaccctttggcctcagcgcctcgatgtcttgcaattcttagctcacggctcttcctcctataacaaggcccttccatgtcatgtcccctactccctcttagcaccagagagatgtctcccctgccccacaggtcacattccatgagtggtgaagtttctagagttgtaaccatggcatctccagccctgtgtgttcctctccatgctccccattgagcagtcttgatcctatattagccccaggaaatgaaatagaaacaggaccctacgttaaaaagttgcagtggagatgtggtggccaccaggggctggaactgtggggtgactgagagtatccaaagccctgtggccaacttactggtgctgagtgtgctggtgagcctctctgtcagctggcttccccgggccagttgctcccggaagctctgtcccaggtagtagtcaatgtcattgctccttaggagatcctcaaaagattttactgtatcttttgcatgctgggtgagaagataacaaacacctctcccttctcgtattttttgccgtaggtaagacagttcccgggcctgatcctgaatcagggaatcatatttcctaatgcaggacagaagaggaaagggtggatgataagttatgggggcttctgtagagatttctatgagaacatctctaaggaactcccccaaactgaattctggcacataagccataggaggcatttaacagcaaattctaccctgataaagtatcgcactaaaaattttagtatgggccgggcgtggtggctcatgcctgtaatcccagcactttgggaggctgaggcaggcagatcataggtcaagagttcgtgacaagcctggccaatatggtgaaacccctcctctactaaaaacacacacaaaaattagctgggcatggtggcacatgcctgtaatcccagctacttgggaggctgagggaggagaattgcttgaacctgggaggtagaggttgcagtgagccgagatggcaccactgcactccagcctgggtgacagagtgagactctgtatcaaaacaaaacaaaacaaaaatttaccatgccactgttcttcaactgttatatatatgttaattatatgtccctagataaattttttgggagctgggcctccagctgggatactctctggaggagactcttcaggtcctttttggcctgaagtcctggagagtagaaagccccagtgccatcagacagccacaactcatcctcatcagtgacactatgaggtgaagacccctccagggtgtcaggagctctcagcttccagggtctttccagactagatgaataatcacttgtaaccaagagggactggacccggttcttgaggttttgaatgaccttgttggcattctgcagctgggccttcagatctttgatgtcctttcataggacccagatgttttctgactttccatatacccagaactcttcctgcctccctagttcattctccaagggcttcctctcagaggaactagccagcgttcagccccggcgcccctgctcagagcacagcccctccaccaggaccatttccttgcggctgctgtgctcctcatgctctgaaaaaagacaaagatgtcttcctaaataaaagttggatgtgctgttgtggccactgcctttgagaggaggcaggtttggtcatgaggacaataattactagggaataaggtgaagtcgtactttattcaaccctgacactgtactaggcattcaaatacagtatttcttatcctccttatacccacaagttaggtttcaccactttctattttactgactggggaaaccaaaacttaaagagaggtggtaaaccagcttgttctagatcactcaaactagcacatggcagagcctgaattcaaatcctccaacgtcctgtgttcattccacacacactgatgtttctcaagccattaacatggccttatctagttaggatagccacaagaacgcaggacaagctatttctgcatgctgcaagtttaatgctctctaaagtttactataatttaaaagtttattgggttaccactgtgtgaaaaataggcataggaaaataagacttcgaataaatatatcagcatgttaacatcagtgtattggggcagtggtagtcagaatgagaactaatccacagcattttacctgatgccagacactgttctaaagcattttataagaatttactcatttaattcacattagtatctgatggggtaggtagttcctttattactattttaacatatgaagaaactggggcataggaaagtttacaaattgggatttgaagcaacaagtctggccccaggatcttttctcttaactgccacactacacttcctcaagaatgagagagactgtgtttttcttctcttctggttttctttttttttttttttagtttgtaagcaaacatttatagccatgattccacagatgtggtaagtaaaccaacagccattcctaaataaaatacaagaatttccatcatgcatagtttacaggcttggtaagaagcagtctctttaggggctagatgcttaagaaatattcaacaaacaatgaaatcttggcttttttttttttttttacacaaatgtttggttatttagccacattagtgataaaacatattcatattctaactgcaagtggaataaacattgcaacaaaaatgcaacccaatcaaaatcattagtaataactattactccctcttagcagtaagaaccattattcttggatttcaaacattttattttctgtgcatagcttatagcactgtattataggaatcagagtgtataagcaaaaaaatgaaataaaacttcttgaagaccatttccattatttatgattaaatcaatgaaactatacaatttccacattaaatacaaattagtaaaagaattcctccaagtagtattgcatataagctacaactttaccccaactattttaatcactatgattcgagatttcctaggatttaacagcccaagattgggctgttactacctcagcaagaacaatcaccagtaaatacatgaactggggttatagctgaatttttagaaactctccagacaaaccacgtgttagaggaggtaagtagaaaaactaatgtttgagctgtgctattcctaccaggaactatgtcaaatatgcaaagttcaaacattcttagtaaaataatatgaaaggatctatatatactgtaaatttagcaaaaacacttttatgtacagaagcctaaatatcttaggaggtttagaataccaatgaagagaattgttaattcttcaaggctggtttcttatgaggattaaaaaccagcccttagtctcagatgcattccacctagatgtgttcacgaactccatagagtaagaaatataaaccatgaatatgtactcttaatttccattcttcaacttaatgttctatagtacttcagatttttaaatccagagtttggtgtacacttaggaaattatagtaagagtagattagagaagatttgcttgttttccttttgaagccatgtgaaggtttattaccctgtgtattttcatcactgaaaagttccccggtgactaataaaataaaagtgtcacaagctacatgatggatctcttcttttaatgttgcatacagtttcagtttggctagtgagggctaactagctcagccctagtttcattttattagagttgaccactaaaaactaaataaggaagttaccagtaaagctaattcccaatacaagcaaaaaacaaaaacaaaaaacaaaaacaaaaccattcgcataataaaatatatccttaacacaaaataagggtataacatattctgcagcatgacattttattttatttctcagctgtagctttttcattcagaaattggagaccatcttttcactgagttgttattccttcctcttcccttagcttagggatatgttgaaaaaggcttttcaacaagtattttattttttacaagttgctatgaaattaaaatttatatatatatcttaagtgtttataaagcactcaaaattgtagcttacatgtatatgacttctgaaaataaaaatcacacttctaacataatctttctgctctgcaaaaatattctacatacatgcatatgatcaaaacaatcttttcatgtttggggtatttcttacacatagtaaaagaaaagtcaacaattatatcagtacttcccctgttaagataactgagtgccacctagtgttcaatttctgcaactactaagcttacaaattcaatactgctattaaaacccaggttctgaaaacggcattttggaaatcttttttttttttttttatgtttacggtggcaaaatacgactatgaaaagaacatgatatcaaaatcagtataaaaatagccacaggctacttaaatatgacaaacagacttattttttttcttcaaatgcagacttctgcctccctcaaattgtatcaaaatctcaagggaatatctaggtaactggaatatacacaatgactctatacaatcaagaggccagggcttaatcagattccgtgaggacaaggcaaatgatttcttcaaaacacccattttcttactggaagtggtaggaaaagcagcaatgcatggttttttttttttttttttttgtaattagtagacatggtcttctacccataagctccattacattaaaagaacaaagtgggcttaacatctcacttaagataattcagcattattatcagttttaaaaaaaccaaaaatatcttagaaacaaatcagtctgctttaacaaattgcattcatgctaatgaaattttaatcttctttgtcatgatcaaaatccaaattgtaggacaatcttcagaaaagatggaatgtaaaatgttgagttcaatttagatgtcatcaatatcttcatcatcatctccaatgtcatcaaactgaatttcatcatcatctccaggaccaaatgtatcagtttcattgattttagcatgctctggaagctcgccgtatgcctgcagacttctagcttcgtctgcattgtattttaaaattacatcagctttgttatcctggtagtctcggagaccaaccaaaataatgtccgaggtatttatccaaaccttttttctcaattttcctctgatgtgacataacctctttacaccatcgaaacacattgcttctagccgtccatttcccaacattttgattacctgagcatactcctgaccatcctctttgaataccagttctcttttttcagattcattctcattcttacccctgcgtctatttttacctcctttacctttattcttgggcatggcggtggcggcgacctcgcggcgtctctgacttctttccgggtagcggcgaccgcggcggctgctgctccgaggggcgacacgagggagcgcgcgggaccaagtaggtgctggaggccaggcaacgtgcgcgggagaggctggcgacccagctcttcggagatccgcctgcgtccacgctcggcggcagcaaaatgctcttctggttttcaatgtggtgggtggccctatggttgtagtccttttataatgcaaaacaaaattatttttaacttacggtttgcatgtttccaaaacctcatgtggtctctaagtaggccttagtatttctataataatcagttggctagaactttatattattattattattattattattattattattattagcagtgtgccacaaactaattgtagaaattcaaacttatacgcagcctcattttgggtaagagttctcctattaacctcctgtcctcctcttccccactacttgtcaggtgtggaattggccaacagcacccaaatgtgatagctgactccagggagggaaggtgagccccacaccctgtgctcttaccgggactggtggtttcctcctgttcagcctcattcttgctttggccacaagtctcatagcccaggtcctggaggtccacctggacctgtttactgtcctgcttcagcaagggttcacctgcgtgggaagagacagcaggtgttacagaatgtctgaatttcccacatatgccctcagcctcaatggcacataccctaaccttgtggggcagggagggcagatccacagtgcgagagaagcttctttgaactggtgggagaagagaccaccagctccaggaagcagaatttctttccacaggaggagcctgcatttgccattgataatctccccttcagataacctaggccttagttgggacaaggtatctgtaagtcagggattgtgtactctcatctctagcagccccattgaagctggcaagtgctttatcagcaggggttcaataaatgttgaatggagctgaactaatttagagtcccaagacacctagacctgcactgtccaataaggtagttagtagccacatatggccactttatactaaattaactaaaattaaataaaaccaaatgtccaagttgcactagccacacttcatgtgctcaataaccacgttatgtctgtatagaacatacagagcttataagacgtacaggctagttctttactagtaagtcatagttacctactaagtataactctgtatttctccagctcgttcgcctgagcaaagacagtggcttctgatagcagcagcttctcctggagatcttgatagcgttgtttgcattgtgacagctgggagcgcaggtgctgggtggaccctggtgggctaaacgctgattgggcccagtgtcacaaggctgggactggttctccaactgtgaaaggggccaagacaaggatcaggacagtccgaggccacccccatgcagtgatgaccacggcccgttgtgaaccccgtggactttactcaagtctgtcacagcacttctcatgccatttggcagtgacttgctttccagatggagctcctggagtgctgggataatgttttcttcatatctgtatccacagcacacagcacagcgccaatcaagtctacagaggagctcttaggaaacgttttctcagtggtcaaaaagagaaggggtggaaccctccactcatctcccctcacattctgtgccatcgattctctcagaatcccctgtattccccattttactgaatcttcagcatggctcctcccctaaacaggatcccaataacccatctgaggtccaggaacagacacctgtgatgagctgtgaccaaaaaaaaaaaaaaaaatggcattgataaggaagggatgtcattacatactacttgtctgggctgcctcataacctgatgcatccctatgttacagcagttaccccctcctattaaaattacctgtttatgtgccatctttccttaccatattaagtatctcaagggcagccattggttttattgccccatgccaatgcctagtgtgttatctgaaaaattaagtactcaagaaatatttatattgtaaaaggctttctaaaggctgaatgtaggctgaatattattactgttgtttgtggtacaaagagacctttctcttggtacctcttgattcacatgggagaacgttttaaagtaaacactgtcatctcgagcccttctccagtggtttttcattccatctaagcctacattgacttggtgggcatccactgtgaaggtagccccaaggtcaaggctctggggtctggggcaaggcctcacagtcacattcccctcctcttggtgttggtgcttcccaggagaaccaaccagttctgtgtttattctgtcgatggtgctggtcagatgcacaaggagctctggagtaagtttactattcccttctttgctactcagcacaagttgttcttgaggaggttgatgatattgtgggcattcttcagttttccctggagctttctgaactcagcctgaagactactctcactcagaccctctttggcaaccacagtctcaaccaccaccttgcccttctccttgtcttcctcaatctcccatccctcagacatttctgctctttcagctctgcattctcaaggcaaagatgggttctgggtctccacagttgccagacttttctccaaagccaccttgaggaactaaaagaaaatcatgctttgaagaagttaggccattaaagagggcccaagagaaacatgagattgcaaaggtagtttttgatgagaacaaaaacaaacaaaaaaagcagatctaaaatgaactccctacccagaacctccttagtcaggcaataagagcaataagatctcaagactaagttttattattattattattattattattattattattattattatttgagacagggtctcgctctgttgccggggtggagcgcagtggtgagatcatggctcactgcagccacgacctcctgggctcacgtaatcctcccacctcagcctcccaagtagctggaaccacaggtgtgtgccactacacccagctaatttttttttttttaatcgagacggagtctcgctctgtcacccaggctggagtgcagtggcacgatctcggctcactgcaacctctgcctcccaggttcaagcgattttcctgcctcagccttctgagtagctgggattataggagcgtgccaccatgcccagctaatttttgtatttttagtagagacggggtttcaccatgttggtcaggctggtcttgaactcctgacctcaggtgatcattctgcctcagcctcccaaagtgctgggattacaggcgtgagccactgagcccggcccacccagctaatttttttttttttgaaatggagtctcactctgttgcccaggctggagtacaaaatggcgtgatcccggctaactgcaacctccgcttcccagattcaagtgattctcctgcctcagcctcccgagtagctgggattacaggcatgtgccatcacacccacctaatttttatatttttagtagagacggggtttcaccatgttggccaggctggtcttgaactcctgacctcaggtgatctacgcgcttcagcctcccaaagtgctgggattacaggtatgatccactgtgtgcagccccgtgcagctaattaaaaaaaattttttttcgtaggcctggtgtgaaggctcatgcctgtaatcccagcactttgggaggctgaggcgggtggatcacctgaggtcaggagttcgagaccagcatgaccaacatggcaaaacccggcctctactaaaaatacaaaaattagccaggcgtggtggcaggcgcctgtaatcccaactacctgggaggctgaggcaggagaatcacttgaacccaggaggtagaggttgcagtgagccaagattgtgccattgcactccagcctgggcaacaagagcaaaactctgtctcaaaaaaaaaaaaaaaaaggccaggcttgatggctcatgcctataatcccacaactttgggaggccgaggcgggtggatcacttcaggtcaggagtttgagaccagtttggccaacatggtgaaacccatctctactaaaaatacaaaattagctgggtgcggtggcacatgcttgtaatcccagctacttgggaggctgaggcaggagaatcacttgaacccaggaggcagaggttgcatgagcccagatcgccactgcactccagactgggtgacaagagtgaaaccccatctcaaaaaaagaaaaaaaaaattttttttttttttcagaatgaggtctcactgcattgcccaggctggtctcaaacttctggactcaagtggtccccctgccttggcctctcaaagtgctgggattacatgtgtaagccaccatgcctggccaaagacttacttttacaggaggagtataaaacatctcattagtaattttcataattgattatgtgtcgaaataatatttttgatattttgtgtcaagtaacactactaaaattaagctcacctatatccttctacattttcactgtggctactagaaaattttaaattacatctgtggctctcattacatttctattggacagcactgggctgggtgagatgactaggggcagaaagtacattctgagggccagacaatcaaggtgattgatactggggttaggttaactgaagggtagaaaaggccaggttaataggaggcagggactgagtaaccgggaacaaagttatcagagcatgagagagagattctgggggtcagccgtctgggatattatagggaggaaggaggctgtgctacaagggccaagagacaggaggatgcactcaagttggcctggatgaagggacgaccctctgcgacttgggtgggggtaagggtggcaggctggggccagccctgcactcaccgcttctgcttcctagaaggagaaacagtgtcacttggtacctccacctcaggggcgcagtcaagacccgctgccaggccagcctctgcctgaccgccggctcacctctcttcttccagcttcttccgcaggaggtcccacctccaggcgggcatgctggccagccgggcctcctcctcctcctgaaacacaaccacaaagcttcagagcctgcaggggctgggagatagggggcaccctcaacctggggacctgaaggagtcagggtcacaggaagtgaccctttggatgcatttctgtgggacaagtggatggaggtgcctggtcacaccccctcagagctggcctcctttctcctagtaacccagacccttgtgtcctacaggaggcaccagagagatcagagctgagtgggacagaagcagagaaaaagtagccgggacccagaggtcctgagcctgattccccacaggggcaggtggccaatggccacaggtccaagatctctgggcagacgcagatgcgggcccccacccagcctcttggctcagggagattcaggctgcccctggctcccctgagaaggaccttcagcccatggttgccctcttcccaacagagtggatacgtgctctacaatcgtggggctgcaatgacatcaggggcaggtgtggtgtccaacataggcagtttacagcaaacagttttatttcctgaatattacagaggagaaagggtctgtacaccgcacacttcacacagaacactgcacacgtggctcccttgacctcagccaaggaggtagctgtgaactccagtggaaaaccagagagcaggccacactgccccagggaggagccgcagcccctcactcagaggggcttcttctgctgcctggctccacacagagctcagcaagaccacggggccagagggggacacctggtttgttctgtgcctgccctgcctatccgaccaacgccccacacaacctgctcacgatgggacctcagaggctgaggcagcctggtcctgggccctccgggctgctcaaggccacagtcctgggttcttcccgctgcttcacgcctctggagggcgtcagacaggcgtccaggcccacgttaagacgctcgagggtgaactgcgaattccgaattccgctgctcagatgtcaaacagctctgcctccttctccttccagaaggagaagctgcggtcgatgtagcggcagatgtcctcgttgctgaattcgcccatctcagacactagttccaaagggtcttcggcgggggcttcggaacccggagagtctgagatccggggaggcgcggcggggaggcgcggcgggccggcgggcgggcgggcggtggcggcggctgcggcacaggggccagggcctcgcgctgccccttgggcgggtcccccttctgaaccggagcggcctcttcggtccgctcctgttctttccccttctcttcctttttcttcgcctgttcttcgggggccggcccagcctccaggccgtttccgaagaacctgtgcctgaggtcctcgaagccgtcgctccagccgcgccggccggcctccacctcctccagcaccacgcggtggaagaggcggatgcgctcccacgggtggctgtccagccggtggaacatctcgtagcacagtaggtggcggaacttgcgatcctcgcggctcaggcccatctccggtagctggaagtagccgagcatgaagaggtcgagcgtgaggctttcgtagcgcgggggtgcgccgccgtctaggggcgacaggaagtgctggggccagtacacgccgtgcgccaggcccgggcttggcggcacgtgccgccgcaggctccgccagtggtgcagcagcttgcccactgcctgccgctgcctcagcagctgccgcagccgttcgttggggctgtgggcctcgcccttgctcaccggcagccggggggcgtccgtggcctccagctccggccagcacgggcggccgtcacgccagggagcagtctgcctaggcgcgcctggtccgcggaaggcccggtccgaggaaggcccagaggcgccagtgctccaggaagaggtaaacgatgcgctccttgcgcaggtcgaggtagtcctggacgccgcgcagttccgtgcagaggggcggccggcgcgccagctgctcgggctcaagtagcgccgcctggcaatcctgtgcctcaggcgggcccagggtgtccaggggctcccagtcggccagcgggccgtgggcggcggcggcgctgggctggccagagccggccgccacgtagtcctcctacaggatgggctcgcggaccggggcgccagcggactgcgggggcttgcggcgcggacagcgcgggggcgccgcgtccagtgcgcgcagctcgtaggtggcgcggtgatgctgcacggagacgccgcactcgaggatctcgcgcgccacagcctcgcggcaccagttgagccagtgcgagcggcccaggcaaagcggccccggcagtcagggcgcctcaggcagcggcgccagcggctggcccgtgtcagcggtcggcagctccgccaggtgcgcaggccggccgcccagcgcggctagcagcgtggccatgctcttgagcagcgtggagatcttgctgcaccaggcgggcaggctggcggcgcggccatgcattcggcgcgggtcgacggtgaagcgcggctccacagggcgacggagatgggcagcagctgctcagctccagttgctccaggcgcgcctccagcttctgcgccttgtgcagcacctgcaggttctcgattgctgctcgatgcggaggatgtcggcctcggtcatgagctcgccaaagggccagaggatggcgttgtgctcgcgggagtacctccagccctcgcgggggtacctccagccctcgcgggggtagcagcacgagctggcggccgtcagctaaggcggggaagacaagagaggggagggaggcgcgtctccctctggcccagctcccgccgtggcgccaggaaccttttgcatgtcctgggtggtgtaatggctccgcggggctgcgtctgcagggagggaccgcgtctggccggcggggggtgacgctggggtgaggcttcggcctgagccgccgctccaggctctgggcagtgtccactttggtcgctggcggggggcacggccggttgctgctcgctgctgcggcggcaagaacaggccagcagacggggtctccatgcctggcttgttcgctcattacaccacccaaggaacttgccaaaggccttgaagctgagaggcgcggtggcccgccccaacccatccgagggcggctattgtgaggcctctcctcccagactcatgaccccttctccagctcccctgtggcccaagccttccgctccctgtggtcaatgttttatgtgcagaatgagaggccactcctctcttaaagaggctgcagctgcagcttccactgagctgcccacccttcccctcccttcgtcgtgctggacagctgggcaccgtaatattctcatttgctcacttttctccacctctgatgtccagttttcccccctgggcctgccatcgcctccacagaggtccctgattcatcttggccctatgggatccactccccacatacaaataggaagcagcctcttccctgcttaacactccccgcacccggctccccagtgctccaggagaaagtccgttctcttctgggcctctggccaggtcttggtaacctggcccccactgaggtctctccagctcagcgacccccttcctccaggacagtcagggccacatccactctcacttccagactgccctgtcccacctgcggctcttcagccccctctctgcctggccacccctcactcgtcttccaagtgttaccttagacatcacctcctccttccctaacacaccccccagcccacgtataaggtggccggttagggctgccccagtcccctgcgttccccattgcagctggctgtgttgcatcagcccaggtacttctctccactgccacccactctctcacactgccccattttgtgtgcttggtgactcgcacacatgtccgcagccaccttagagcaggccttgatatgttcaccatgaatccccagaggctacaagcgtgtggggcacataaatggcactcgggggccaggcgtggtggctcacgcctgtaatcccagcactttgggaggccgaggcgggcagatcacttgaggccaggagttcaagaccagcctggccaacatggtgaaaccccatctctactaagaatacaaaaattagccgggcatggttggcgggcatctgtagtcccagctactcgggaggctgaggcgggagaatcacttgaacccaggaggtggaggttgcagtgagtcaagatcgcaccactgtactccagcctcagtgacagagtgagaccctgtctcaaaaaaataaaaaataataaaaataaatggcattcggggaatagtttttggatgaatggaaagcaactcatcctgccagctggtgctgatcagctcaccttacagagaaggaaactgaggctggatgaggctcagtatcggcagctggaaggcggcagcgcagcaatggagaccaggtccctaagactgagaccaaagctctcttggctactcagtgtggtccttggaccagtgtcatcagcagcctcacccaggagctggctagaaatgcagaacctcagccctgcccagacctcctgaatccgaacaggccttttaaccagatcccaggtgctgggcaggtgaaggagagtctgagaaaggctgctgtctcactccaaggacaagctgctgggggtgtgtgtggagactgggacaagccccaaacggggtcgtgccaccctgatttccctaaagaagatggccgggcacagtggctcatgcctgtaatcccagccctggccaacatggtgaaaccccgtctctaataaaaatacaaaaaaattagctgggcgtggtggcatgcgcctgtaatcccagctacctgagaggctgaggcaggagaatcatttgaacccaggagacaaaggttgcagtgagccgagatcgcgccactgcactccagcctgggcgacagagcaagcctctgtctcacgaaaaagaaaaaaagaaaaagaaagaaagaaagaaaataggaggtcccgaggttggtgttgggggtggcgtgggggatgggctgtgcatccagatgcagaccccagggctccctgggcaccccgccccacccactttccacctctgctcctcctcctcctccatcttcagctgcatcttgcccaccatcacctggcgcttccactcgggcttgggacggccctgctcatcgtgcgtggggatgagcgcctccacgtccagctgcacccccggcgcaggagtagtgggcggcaccggaaccaagcttccgttgagcagcggctgaaaccccgcagctggcggtgtggggctccggactggtaacagtgcaggtgacacagacggcagcggccaatcgggctgcagggagaagcggtggggctgagcgcctggtggcctagggccagggaagccgggtcgcaggctcctgctgggcccgcctacctggaaggccggctgcctgctgcctgagaacactgtggtcagccccttgctctgtggcgtcggcttcaggctcttgcctgccttaatctcagccagtagctccgagttgtcgcccatcgggaacatcacgttgaaagacttggtgcctatgcagaggcaggagatgaggcactggccagggtggggctgcatccctgccacccctcacccgcccctctgcagcccccttcccaactccagattggatgggtgcccatcctcggggccagcgggcagctctccagatcccaggtcctgcaggcagctttcagggcccccagaggcaggcccttggttccccgactgtggcaaccccaccatcctcccccaccctactcacgggatggagggcccctgcctggagacccctgggagttcatggtggctcttgggcatatattcctgcccagccactgactgcccagccccaaaacactacctggaatcagccaccggacctttgtcccaggtttcctggctcagcccggctgggtggagcctccctctggccctctccctacatcagcaaagcctcagtgacccttgagctgagtcaattggggcctccatggacatgcagagtccagaccccagagtgccagtaccacctgctcccctccctcgccaccacacccacagacagacgcacaagcagacacattggttgcaagccgggagcacatttatggcaaagcacggctcagctctaggggaaagcagagcccttactaaggccacaggaggcacccaggaagaagggcagcaggtaatatgcaaacacccagggcagagggtgcattttctggcttagccggaggaggcgaatggagatttggagagataggtctcttgagtcccgatgaaggggtcaggtctgggagggaggaataaaatgggccgacagctcttggattcccaggctggggatcccagagtgcagtcaccgggaggagaagagtaggagaaagggaaaatcggtgtggcttactcatttatttaggcaaaaccatcagccaggcgcagaatgcttgggtgcatatgtgggtatgagggtaggtatgaggtgcaaggccccacccatgcatcgaggttctctcgcctgccagcccctgcccctgccctttcctcaaggctgggcccctcctcccgtgcttttcctgcctcttccccccaccccgcgcctcagcctcagccaggagccgcgcacgcagctactcactcttcctgtgcctcaggactctcacttctagggaccaagaggagagaagtgacagcggagttaggagggaaagggggccaggatgagactgggatagcaggggacagggagcgggccagggagagcaggaggggggaagtggagaagagaggaggagcatttctgcccatctgaccctggctcaggctgctctggggccccatgagggtggtccatcgagttcctggtttggctggtgcccctgagggctgggcagggcagggccaccagtggctctagcccccagcaagggcctccaccttggcactgggttggggtagggcacccagccctggctgtgctgggtgggggtgtctggggaagcccagagtatatttttctctgcccttagcttcagccctgctgcagactgtggagggaaggagaaggaggctcggcaggtgctggacatgcttccatgggctctggtctgcaggggctggggctccataggaaccatagggggacaagctctgctctgcactcctagtcagggagatgaagctttgaggggtgccactaagcatgatctctgccctgagtggctgggtgatgaaggcaccccagccaggctgggatgggagcaccacatctaggcaccctgtcctgggccttctaggtgtcctggcagggggacactgtcccaccctacagaaaagaagcccaggaatcctgcgccagtctagctcttaaaaaggatgcctagggaagtcaccggggagggagggggaaacatggtgggtcacagctttgcccccatagccaggctctggctggcccagggcccctggcaggaactggctaggaagagttcctggcatatctaagaaggcttcaggtctgtgctgcttggaaagacaagagaaagacgtggagagaggaagagaggctcaggatagacaggggcagggggaagggtggccagctgcggggcctctctgaagctggttcgacttcaagtgtccctccagtaccagctcatcagaaacaccagcaccagctcatgggaaacaccagcgccagagctggaaggccctttctagcccgtgggaggcaggcccagagaggggaggggacttgtccaggccacacagctagagggtgggaggcaggcccagactggggaagggacttgccccaggctgtgcagcccggtcctgctttggcaggacctcaagcaacccagagccctctcttagggtcaagtactcaatgcggtaggggtggccggaagaccatgtagaagaggaaggacccgggcagtgacagctggggagggggtggtgtctagatttccctcccctttcagggctagcgccgccccccacccctcaacctgcccctactcactgccggtgggcgaggaggagcggcgctgcccgcagccagggccagcgccctcgaggggcagaggcgggaccggcggcggcgaactcgcggcctcgggcaggggcggcggcggcggcggcggcggcagctgctgctccctggacgccttggggtccgcggcgcagccgttaggcacgtggttcccagggagttccgcctgcggggatgaaggtgggggctcacctcccagcttagggagaggctgaggggtctgggtcacatctggccgggggcgcgtgcagagccgcggtcaggtgtggcagagcagttggggcccacgtagcatccgcgacggctgcgccgcctgcgggggagcggaggggccttcgagcgagccgcgggcggcagggccgaggcgcgggcagccggcgggcgcgggctggcgggcacgcacctcctcgcggtgcgccatgcccgggcgtgcgaccagcgtctcgccggggcagcggcccagctgccggtagtagtcccccgtgctgggctgcttgctgaaagcgcggggcttgcggctggagtcctgcctccgtagcccgtcgtggccgtcgcaggagctcggctgcgggaagacagtgaccggtggggctcgggcaagtgcccggtaggcgccccccacgcctccccacccagctcttcacctcctgggaactcgcggccagcggccgtcggggggtgcagcagccgacttcctagaccccctgttctcacggtgggcagcgggcgaggttcatgggggcctcggtggaagggcaggctccgcccgccttacagggaggggttctgggcaccggccaaggggcacagggtcccccactgaggccagaaggggcgggcccaggggcgggccggcccagccccgacgccagggggagctagagaaggggcacctcccagcttagccttcactaggccctcggccgcactccgctctcggctgtcagaaggactgcgggtccccagggctccgcggagccctgtctttcgggggtcccgggccggagggagccccctccagagcctgtgctctccgaggctccggcttgccccggaccccgcttgtccgtctaggggctgctccaacctgccacggtgctggtggtcctgctgtgcacctggcggcgggggcggcaggacccgacacctgctttacgtgatacttcctctcaggttacagacgcccgcgcacggccagcctatgggctccgacggcctgacatcacccggggcccgccaatcccaggccgaaccccccccagccgtcgcggatgccacgggggcgccaactactctgccacacctggccgcggctctgcacccgccccgggccagatgtgaccccgccccctgcgcctctccctaagctgggagctgagcccccaccttcatccccgcccgagaggagagagggctgaccgtgggcagagggggcctctcatatttggctgccggctccgggtcgcgtccccaccgtttccctcctgcatctggaaaccatcgccatccacgaaagcgacaccgacacccgcgctcaagcctcggatttcaggggccgtaaggcggggtcgggtgacagcgcggcttcccgccccgtcgcagctgcccccaactaggcccagctcagtgagggagagtgaggcggccgggccaaagactgagtgaccgggtgggggctgtcccctgccccactctccagcccatgcgtccctgcggtggcctcagacccttcaccccgcccgacctggctcacgttgcaggaaacgcgacaccgcaggattcgttttctgggccagcccgccggctccgcgccccctgcagcccggaggctccgacgccacgaccctgctcccacctgcggtcaggcacccgcgcgggaggcgccgcggcgacacaaagagccctttgtagagcttcccggcccgggccctggcgtctgcggcccagcacgcacacagccgggagggacgcacacagccgggagggggctcgcacagccaggaggtgacctcacagacctggcacttgggctcagcggtggagagggggcactggctgggccacctgtcctgtggatttgggcggggcccacagtctgcgccgggagctcaacgattccagggcccctgcagccctacccgcccggccccctctgcctcccagagatgaaaggggaaagccactgtgggagcttggtctaaggtggcgtgaagagggcagctactggagctggcctgcaggtttggtgtccctcccatgcctcccttgcccactggccttgtgacctgagtcaccttgtatgaattggccctggggtggctttgccttgggcttaagagagaactgcaaggtcccaggctccagcaggaccccagggagctgccacaccacatctggccacctgtgacctcaggctgtcccctcacctcttagaccatccttgctctgttcctgtggccagaacgccagtgttccccagggcaccctgccgaggatacccgcaattgctcagaccagacctctgccccaatccctgctccagagcctcagccaggcgcctgcaggccccagacatccctaggcacctcacacttcacctacccaccctgccctcatcctctccacacaggctcgcttccctccagggctcccagctcaggcctggccctttcccccaggagctcaagccctaaactggaaccagccacagcttcacttcctcccagcccctactgccggtgggcgcccagccctgctagtgcctgctcaccttcctccctccctccttccagcccttacctctacagccatgccactggcaccttccacctggcagccacctcccttgggtgacactctccgactgagcctggggctgtgggggtgggggggcatgcttggggaggggcagtctccatgcattctctgtcaactccatgacaacccggccactcctgtgcaagaggtggcacaggcccagttcctggtgaggaacagctgtctggacctgcgtccttcaccccccagctcccatggagggcagtgacctgctcttactctcctcccagtccagtgtccagccctgacccctcgtgggactcgccaggagctttgactcttgaatatgccatggacccagggacccccaccctgtgcccactagtgaggccaggcctttggcctgactggcccccatcagcccagtacccctgctgggaggcaggcagtgggtgagggctcactacctccttcttgagggcctctgtctccacgtggcggagtttgttcttggtctgcatgtagatgtcagctgcctgtggtcccacaggaggcttgggagatgggtagctaggtgggggtgggggcagttgggtgcctgggggcgggggtggcggggggaagctgggtgggggtggtgggggtatgggcttcccaatcgtgccccaaggcaggcccagctctgggttcagcatgtccatgtagctctgtatgtctgcagctctagtgctggaaagccctggggaggcagaaggaagggccagatttggaagcatgcagacagcctttcccccaagaatgagactctccaccacctggaaacaacttgccgagggccaaggtgggctccgggcaccacttggtacacctgttgtggcccctggcgttgctgggcttcctctccctggccctgccctgccccagcccagcacttattgggggaagaccaggcactccggtttggaggggaagcactggaggctttggtgtgtctagagggcagggtcacctggaaggggagggtctactccttgggagtacagatggccacatccaatctttgcagggcaccctgccaggtctggaggccaccatctggtggcgtgaagcaggcattgcaagtggatggacgcccatgctcagggcacggtcagggtgtgtgtacacacaagcctgcagtctgccgaggcgattgtgaatttgtgtatgtttgagtgtgtacgcatttgtgcacatgcttctttgtattgatgaatgtgtgtgcattgctctgtggacatggtgtgtgtgtgtgtgcatatctgtagtatggaaatagagcattgtgtgcttgtgtgtaaggtgggtgtgtgcagatattagcatggctctgtatgtgtgttcatatctgtatgctgtgtgtacacatgtacaagtgtgtgcttttgtgtgtgagtagctaagaataatgaatggtgggtggcacacgtggattttgtgggtggggagagtacatgtggatgtacatgtatgtctgtgatgagcacacacaagtatgagtgacatctgtctctcaccagaaagggtgtcgcctccccatgtttaaaagcaagtgataagagtagtctccgatattggctgtggcaggctggcccaaggccaaccctcacagcccagcagtctggcttcagtctgctctccctccccctcttcctcctgggcacactcaccacgtggagggtgctggcccttgatgctggagtggctggaggagcaggagtcgtagttggagagggtgctggtgggcgagctgaggtcaaagttcagaggctggaccgacaccgtggtgttgggtgaggacatgcctgaatccggctgcttcgcctccagctccacggatggatcccgggagagcacgcagtgctccatgctctgaaggggaggcagggaggccatgaaggcaactgcaccccaagatgcgttgctctccaggccagggtcctactcagccatgcctttgccgtgggatcttggccaagccacacccctctctggggtctcttccccatcgctagagggtctttcaggttcctccgggttaagattcaagcccagccccgccaggcagaggacccaggttcctgggaaactccctcccctggctcctccctgattaggagggtggagagatcgacgaggagggggccttgagctgcaccccagggggagaactgccaggagatcggccttctccctcacagatcggcacaggctccatggggaagggcacagcacaggcccatccctagtgacctggctggcaagccagctctccttgccagacctgggacctggagcagactcccaacaccagcccggcctgtctcctgatggggcccttggggtaagggtagggcctggatggccagctgagcagtgatgggcagccagagctcaggctgccaggcctgccattcccccgccctgcccggtctgtgcgtctgaccacaggcctgtcccctcccggtgcagagggggctgtggtaggggccctgcttacattgcccatgctgcccctgctgccggcaagcccgcttgctccgctgcctcctgcccaggcctgctcctccttgccccgtgccccctccctacctaagaagtgtcacaggcaccctgggagagagaggcaggcctggcaccaggtaacggctcagcggccgcgctcattggccccgtaattaggggctctgctggagtgtttgccttttctgggccagcgtcttctgtggcttgggtctgtccctgcctcagctgggcctgcttgagtgaggggaccagggcacacacaccccacccattccaggggaccaggccctgttacctaccgcaggagtcaggggagccataggaggtggcatgggcagcacccaaaggtgctctttacctgggcaacagcagtgggtgctgagggcaccaagccctgacccctgtaggcagcagataagaggctgggccacagcaggtgtactgcgcctggcctgagccacccagctctgcagtctgggactgtggcttcaaactttccctccccgacttactagctatttcaggcgagtcacctgtgctttttgtgcctatgtttctttatctgcaaatgggggtaacagcactacttgctctgctgagctccaggacatggcgcccagtaaatgccatactgtcaaatttttttttttttttttttagacggagttttgttcttgttgcccaggctggagtacagtggcgcggtcttggctcagtgcaacctccacctcctgagttcaagcaattctcctgcctcagcctcccaagtagttggaattaaaggcacccgccaccacacccagctaatttttgtatatttagtagagatggggtttcatcatgttgaccaggctggtctcgaaccctgacttcaggtgatccacccgcctcagcttctcaaagtgcaggcatgagccaccacacccggcctgtcaacttttttattttattttattttatttttagacggagtcttgctctgtcaccaggctggagtgcagtggcgcggtcttggcttactgcaacctccgcctcctgggttcaagcgattctcctgcctcagcctcccgagtagctgggactacaggcgtgtgctaccacacctgactaatttttttttttttttgtagttttagtagatacggggtttcaccatgttggccaggatggtcttgatctactgacctcgtgatctgcccgcctcggcctcccaaagtgctgggattacaggcatgagccaccgcgcctggcctgagccactgcacccagccaactatttttttaatgtactgtgaagagtaactgagattacacctttaaggcactcggcagggtacctgcctaagtcagaatccaatgaatagtgtttgctgtcctatgaccactagcagctgcatccagacaggccctcaggtgccctgggctctggtgccaccccccatggtccctcgacagagtcacaggctctcttaactgatggggacccaccactgatgcagaaatgtccttccctgtgtccatcccggcttatataccctagtgacagagtgctgactacctgctgggccattcattctcttccagagactctttctcggggggaagttcaccctcaggcccacctgcagcctctggcctctgggccttgctgtgttctgcagcccccagagccaggaccatccccctgtgctggcagggacgacagatggacagacggtgctcagggcacagaccatctgccttcttccctccgggcctcatttcacagccactccatggccaggctgccccatggagttggtccgcatccttttggggttggctgtgaggcccactctcttccctgcctattgcctcaaagcaggcattgtaccagatggtgcagagccctcacttggagacatccacagctgagttcaagtcccagtaggtcacttcgtggctgtctcaccataaaaacataatttaaaaagagtagcatgggtttccagttatgacccagccatgaagtcagctaatatatggtgcaggggcagagaggtggctcctggtcaggccatcaaggtaggttctccactctaccacttactggtgatgcgatcctggtgccccgcagactccctttacccatatgtggaacgggacacttacactctcttctgcagagggtggctgtgagttatacccaagctaatgtctatgggtaggtgaatgagcctgcctgttcccaatggggcctgtcttgtgatttctccagccttaccccttggggtgaccctgttcttccctgtcctctttccgttaacctttgtgcctctactccctcagtccccagcaggcagtggttctgggctgacaggtcgtgtggggtagcgggcttcacgtctctgaacctcagcttcctccttggtaaaaggggtgacgacacccaccactggggtggaggggcgagaagagagaatgcaacaggagcagcgcagggatcgtaccaggttctccaccgtgcgcaggcagtgggtgcagtggctgtggccgttgaagtccgacaggtcagcggccgcgtacccgtcgcggtcgcggacttccagctccgcgccgttcactaccaggatctggcagcactgtgggggcacgcagtgaggacccggccgcggccacgagctgggacccccgcgcccgggcagggccgtgcggagagcgcggtgccagcagagggcgcgcgcccccaccccgggcccgcgctgacctctagctccccgttctcggcggcgtcgtacagcgcggtcccgccccacaggtcagccgagatctccccgccgtgcagcagcagccagctgagcaccttgctgtggccgcggctcgccgcgaagtgcgtggcggtggcgccgtctttgtcctgctccgacaggctcacgtcggtgcagctcacctgggcgggaggggcggggagagagggccgggggatgggggccaggcccctgcaggccccgcccacggtcctccgccccactcctgatggccccgctccctccactccccgccctgccggctccgccccgtctcccctccgcaccgcccgggcccggagctcaccaaccacacgatgaccgggctgtggcccatctgcgccgcggcgtgcagtggggtcatgccgtcgtgggcgcgcgcgtgcgggtccgcgccgcattcctgcaccaggtactgcgtcacctccaggtggccctcctggcacgccaggtacaggggcgtggcaccgttcttggtttgggcattcactcccctgcggagacacagcgcccaccgtgggctttcagcgcctcaccccctccgaggcctccttacccgcccccctcccctcccggggagccctggacggcagggagagtgggcgggagagggccctgtcaccggcccgctgccgcccggggggctccgcctggactgagtcctgagccaccctccctcagaggcccctgagggcgtcccacccagcactgccctgccctcagtcccacttttttttttttttttttttttttgagaagaagtctagctctgtcgcccaggctggagtgcagtggctggatcttggctcactgcaatctctgcctcccgggttcaagcgattcttctgcttcagcctcctgagtagctgggattacaggcatgcgccaccacgccccgctaatcttttgtatttttagtagagacggggtttcaccatgttgaccaggctggtctcgaacttctgaccttgtgatccgcccgcctcggcctcccaaagtgctgggattacagagccaccgcgcccagcctcagtcccactttttaaccgaggtctacaaagatgtggtgagctggcctttcctcccctctcgcccactgtcaccatgagtccccacaactgctgtgtctgacctctatccctttcatcgtgtgccccctccatctggaatgtccttccatcctcctccctcttgaagactcagtacccatccctcctccatgagggccaccctgatttatttcccccttgctggcctccgccccacactgcccagggccactatgagcatgacctgtcatgcttggttgaccataactgattttgacctttgcctcccccagaagactgagttcccagcgggcagggtggtaagggttgccagacaaaatgcagttcacacagttcaaccggaatttcggatgaacggataatgctttagtattctatatcccaaatattgcatgggacatacttatactaaaatacaacttttttatctgagattcaaagctagtcaaacatcccgggttttgttgttgctgtttttgttaatctggcagccctcgggatgtccactatgtactgaatgcttctgctgtgctagctctgggctacggcactggcaagcaggttcttctttttttatttttatttttgagacggagtctttctctgtcatccaggctggaatgcaatggcgcaatctcagctcactgcaccctctgcctcctgggttcaagccattctcctgcctgagcctcccaaacagctgggactacaggcatgtgccaccacgcctggctaattttcgtatttttagcagaaacccagttttgccatcttggccaggctggtctcaaactcctgagctcaagtgatccgcctgtctcggcctcccaaagtgctgggattacaggtgtgagccactgcgcccggccatcaactattactgtgaccatcaactgagattacaccggtaaggcacctagcaggggacctgccagaatcagaattcagtcaatggtgcagctacagctggggaggctcacaggtggggctgggactctgtgccatcacccatagtcccacaacagaggcacagactcagctctctcctcggtcacacagttggtaagtggcacttgaacacccatctgtctgtgcatgcagggcctggctggcaatatgggcatgcagggagtgaagagatggaatgtgtctcaggggctcctcctagggcctagttttcggctgtcactgtcccttatccttgctctgccagcccagagggggcctacctagggaacagcagggctgtcctggctgctgggctgttgggtgtgaacagcccagggtgcagttgccaccaaaggacactaggtggagccacaacctacccccagacccaggagaagttccaggttgggggccacgacctattgggttccagttcaccttttgtgcctaggaggccaattcctcacaggacttgacatcctgcccatctacctcccccagtctttcaccccgtagatcaaccacatgctccaccctgcattcatccctcgttcacccatccaactgcccatccacttgttgcctgcccatcaacgtgcaccaggctacccccctttgcccacccaccctcttgttcccaacacgactcagcccctcttctgacccctgtcacgtgtgccctctccctccctctcacacacatcctgagcccctcccagctggcatctccctgtccctaaagccctggttctctgtccacttccctgactcctgagaccccaaggctgactctgactgagacccctgactctgcagcccccatggacccccactcactgatttctcctccctccccactccctagacacagggctgccatttgctggggctgatgctgagccgggcacttcatgatggtgcggggagcaggcaccatgcctggtgatccagagggggtcccgtcaacacagatgagggagacagaagacccagctacgtatctatcttcagaaacatgctggctcgtggctgccagcctccacaccccagcgccagcgtcacccccacacacactcacatactgctgcatcagaacaggctgttgaatatttcatgaccgacgctcagcggcctaaattattcaccccgtaaccaaggcacagtgagtgccggggtctttgggatcaggggctggtgggggcccactgggttctttctgcagaggcccacggcggtgtacacagcgggtggggggccagacctgcagtgagctctgctctctcagcactccctacttggcagagatccatgacccaggggtgcccagccagccagagaaggtctgagaagctggcatcaagcaggatctgagcagcagggggaagtggtacccacggcctcctgcagggccgctggctggcactcccagcccaagttcctggcacggaatgagccctcagtaagtgctggagctcatcaccattctcattagtattccaccatctgcactcatgcgccccattatggagtcagagcctccagcttggaataccccagaacatgaggcagatatgctgttgggctgggtgggaaggggtcctggctcaacatccccttccaccttggcctgaggacaagaagaacaatgggcactctcacagtcactggggagtattacaaagatatggatgagcataaggaccaaaatgaaattcccatcacacacctggaatccaagcacctcgggaggccaaagcaggaggactgcctgagcctaggagttcgagaccagcctgggcaacatagagagacctccgtctctacaaacaatacaaaaatgagccaggtgtgttggtgcacacctgtagtcccagccactcaggaggctgaggagggaggatcacttgagtccaagaagttgaggctgcagggaactatgatcataccgctgcactccagcctgggtgtcagagcaagagcctatctctaaaataaataaataaatgagaaaataaacaaaattcccatcactagagagaggaattaataaaagtaataatagtaaataataataatagtgatagcagccaccatttactgaatgattactctgtctcaagcactgtgatgagtacaacacacacgttctctcagctggtctttgtaacaaccccacaggacaggtgttagcattgttcttctggtacagatgaggaaactgaggcacagagagctaagatcactctgtgagaaagaggcagagccccgatttgaggctgtgtctgatgcagagcctgcttctgactccaaatgtgccacgtctacaccccttctgctcttggtcggtctgtccctctgcctccctccctccctcccactgcacagaccactgcccttccccacagacctcactgctgggaactcaggaacactctttgacagctgctggggcacagccccgcaggaggacctggctcgagtcccgtgcctttgagctgtgccacagtcttgcttcttgtctctttgtgttcccaaacccatccatgaaatgggggcaacagttgtcatcctgacctcgtgcagagtgcctgagaagtgcctgcagagccctgagcacaggcctggtgcctggcgcacagccattgctgaactttaggatccttccctgtgcctgggaggaccagccaccaggggggtctatggctggcctggcctgtccgggtcctgccaagtacgggccaggctgggcatcatttctgctgtggggaacactacctagaggggagaggatgggtcttgggggagacctctgactcccagacccttgccagctctagccctgaccacagtgacagctgcagaaaagtgctcccagaccaagcccttgccctttgccccggctttgacccaaaccctctttgtaggtcagaggcgccctggcgatgatcgtataaatcatgatttgttttctttctcctgggaacaaagatgctatggatgaactgtaactattcatcaagtcacctctgattacacaaaagaaacatgggtcccccgtgtgggctgtgggaatctctggcggagactggtgccagctgactgccagcaccgccgcagggagtgagctgcccatggagccagagtcgggctgcagaatgattcccgcagcccgccccactgccagtcacgcctccccagagggaggccaggaagaggctgtccctccgaggatcagtctggttgtggcccgtgactgctttcaattgaaattcacggagcctttggtggatctacggctctcggtgtcctccagtcaaacttcccggcctatgttaaaagattcccaagtaggcctggcccagggaagaaatgcagccccgatttgagaaaggttctacaccccagcccatcagctagcatggaatagttccagaagcctacagttgcctgcaactctcccagcctcccaggtcttcctcctggcccgtaattaggccaaatttgaccccccctgaggcctctacacctccccacatcactgccagttccaccatggcagggctgcgaggccgaccctcttttcattaggttctcagctctcctcccctcaaagatgcctggcttccctgacccctcaacttaaagaaccatccccatcgcttcctaccaaactcctcatttcactatatagcacttgccactcctgaattatcttgttctcctattcctcagacccatacatgcgtggatagaagaatgtgtggctgacgtgatgacaggccgggcagttgagtgcacccacttgctgtttgttgaatgaataaatatgagaagggacatccaggccaggagtaggggatgtctcttcactcatggccgcagcctggtagagcaggttagatccacttgccagataggctcggaaatgcccagaggggagttttgtctagggtcacatgcaatgagctgtaggcagagtggacaagtccctgggattccatgccccactcattcagcagatgtttactggagtcaggctctgggcatacagagccgggaagacaaagcccctggccttattagtcacggacagacgggatgaaaacacacatctgtctgtgtgatgcagggcccagccagaaatccgggcatgcagggagtgaagagatggaatgtgtctcaggggcttctcctaggggttagcttccggctgtcacgcaggatgcacacagaacgcaaagccaggcaaccatagggcggctgggaggccaggtgcagtggctcatgcctgtaatcccagcactttgggaggccgaggtgggcggatcacctgagttcaggagttcgagaccagcctggccaacatggtgaaaccccatctctactaataatacaaaaattagccaggtgtggtgccatatgcacctataatcctggctactcaggaggctaaggcaggagaatcacctgaacctgggaggtggaggttacagagagctgtgccactgcactcaagcctgggcaatagagcaagagtcgagtctcaaggaaaagggcagcagggaacaaggtcagcgggaaagtgagtgggcatcatgggcgcgggtgacaatttcagcgaggctcagggttggccttgctgaggtgaggtctgggcaaagacttgcaggaaggcagggagcaggcggggatctctgatccctgcagagggatcagcctctgtgaaggcaggggtgctggcctgttggaggggaccacagcccggaggagggacagcctctgggccattgtaaggaagtgagcagcattccctgtcagtggccagaagcctgtgacgggaggtgctcttttttttttgtgaaacggagtcttgctctgttgcccaggctggaatgcagtggcacaatctcagctcactgtaaccgctgcctcccaggttcaagtgattcttatgcctcagcctcccaagcagctgggactacaggcgggagccaccacacccggctaactatttttccccctgagatggagtcttgctctgtcgcccaggcttgagtgcagtggcgcaatcttggttcactgcaacctccgccttccgggttcaagcaattctcctgcctcagcctcctgagtagcgggattacagacacccaccaccatgcccagctaatttttgtattttttagtagagacggggtttcaccgtattggccaagctggtctcaagttcctgaccttgtgatccgcccgcctcagcttcccaaagtgctgggattacaggcatgaaccactgcaccagaccaggacttgcattgtcttttcttttcttttctttttcttttttgagacggagtcttgctctgtcgcccaggctggagtacagtggctcgatcttggctcactgcaagctccgcctcccgggttccagcaattctcctgcctcagcctcccgagttgctgggactacaggcacgtgccaccacacccggctaatttttgtattttttagtagagacggggtttctccatgttggccaggctggtctcgaactcctgacctcgtgttccgcccgcctcagcctcccaaagtgctgggattacaggtgtgagccaccacacccagcaggacttgtgttttcaaaggctgcgggtggacatggacgggtgaaggccagggcctttcaggcttactgaggacttccccttttccgttctgtagtgcacagcctcacagagccttgggcccagctgagcccaaggggttcaggtagcccccacgtgaggcagaaagggggtttctcagaagccctgggatgccccagcagcgtgctgcttacagagccccagggtccaaggctcagctctcccccttagaagggtagggcaggagcactagccccggttagatgacagctgggaccaggagctgctggtggagacacgagatggtctcctgctgtgaggggcttccccggactccaccaggcccttcctttcccagagcctccacgtgggtcagggagtcaaggacggcagccacctcctcagtgtggacacaggccccgcccccacgccctgcagccaggtgaactgacagacaccaggggtagatctggggctgctgataaaaaggaatgagcccccacggcctgtggcagaatcagggaccaccccaggcagagcctccagccttctaagggggagagttgagccctgggccctggggctctctaagctgagagttgctaggggcttcccaacaaactccctttctgtcccaggtgggggctgcctgaacccctgggccgtgggagcagccagactccgtgaagctttgcacaaaggaagggaaaaggggaagtctgcagtggacttgaaaggccctgagtgattaggacctggaccaggagtgggagagagacccagagaggaggtacagcctgctcaaggccacacagcaagccagtgatgaccacagctggtgaatcagcctctctaaaacaccatttctgtacctgtcagctccaccaggcagggacgcttgtctggttcaccagcatatcactggcatttagaatattgcctggcacatagaagatgctcaataaacattagttgaatgagtccatctgtaaaatgggctgattacatagctactgctcggggtggttgtgtgactcagatgacactgggtggtgccagacccctagaagatactcagcaccaggttctttttttctttcctttcttttctttccttcctttctttcattcgttccttttttttttttttttttttttggacagagtcttgctctgttgcccaggctggaatgcaatagcatgatctgggctcactgcaacctccgcctccctggttcaagcgattctcctgcctcagcctccctagtagctgggattacaagcatgtgccacctgtacaggcatagcccagccacacacccagctaatttttgtatttttggtagagacggggtttcaccatgttggtcaggctggtcttgaactcttgacctcaggtgatccacctgcctcagcctcccaaagtgctgggattacaggcgtgagccaccatacccagccccaggtactttccaatcccattccagtctagtctggtcaggggtaggggaggctttgggggaaggaggcacctgctgaagttgataacatctctgggctaactggttttccagcttgctgtgactggcagcacccacgagcccaggggaagagactggagcctcctcactccccagcctggaagctcaagcctcagggtcccagctgatccccagctccccgacccacacagccctgtccagctgctcaggccctgggacagccagaagcaggtgtgaggggggcagagtgagctcctgggccccaggaccctcctgggagggtggccactggccttggggccacctgctcttcgcccctcctcactctgccctgaatgggggtctggaccccttgttcccctccatcagccactggagctcctgctgggagggccaaccctcccaactcaatctccctgagacccagagcctgggacttgcccagcccagctcctgccagccccgtacctcccaactgagaggtcctttttctttttcttttttttccccacctggagatggagtttcactcttgttgcccaggttgtagtgcaatggcgcgatcttggctcactgcaacctccgtctgccgggttcaagcgattctcctgcctcagcctcctgagtggctgggattacaggcacgcgccaccacacccggctaattttgtatgagagatcccttttctacaagggctcagagggagggtcccacgtggcagcagccccgaggtcactgtgacaagtcctctgcttctgggaagacttggccccatgaacgggatagacagggaggtgtgggggatgtgcaggacattcctgcaatctcaagcactttctattataacaccccaaggtgtagccctggaattagctgagcctccccgaggctgtccagccttccagctcctctgcagcgtgtcacttccatgtctcatggccacccacagcccctccctgggcaggatcgagtttcccaccagcaggtccgggagcccttcctccctcagcactcacccacgcgccagcgagagagctgagccttgtgaataattcacagcaattcacagcaggccccagaggctcgcaagatcatgaagctgggccacctgggtgccctgattgggccctgtggcctggggcagctcaagcctctgccctacccagctcccagccttcatatccacagcctcggtgagcaggaatccctacccgcaagataggaggttaagtgggtaccccagcccccaaccccaattcccagctgctcttcctgcataagcccagcctggcaaccacagaaagacaccttcttatcagtcgagtcacatgctgctgtggggaacggagcccaagccctctgtccacctccctgagattcatggtgactcctggggggctggcagctcatcagtccaggccatctggccactgggtcggcaccagcgcccaatcacacacagcacctggcatggcctgggagggggtcagggttccccagccccggagccctggagggcgttccacagcacagccagtcttcctaacacctgggatccagcccacggagggatcgtggcttctcagtgaggaaggcttaggggccggcggtccccaccagcacttgcataaggcgggctcagcgtcttccagttcacacttgggccatattggtcccgccatcaggggcacctgcccctctcaagacctgtccttctcctctgcttgaagtgagggggtgggacaggtgcatcagaatcaccgccatgagggtggggacatgtcccaggtgtggctcccaggccccaacctggagagtctaactcaggaatctgggacagcctccaagaggtgttgacaggagccagttggaaccctctactcaagggtccctgggtccctcctagtctaaatcccactgactttgacatgatccaaaccctagtttgtttggaagtagtgaattcataccaaagcagccaccaagaaggcctggcagggctggttgtgaagcaccccttcctccgggtgctgcctgttgggtctcccactaaccaaaccagggagccccttcttagcaaggatggaaccaggcccagctcccttgtcctgggctgaggggaccactggagcccggcctggtgggtcctagggccaccctacatccacgccagtgtgcctgggcccaagaggctgcagctgtggctaccttgccacatggccatatggccagaactggcctccagcttgctccctggtggccaggggccctgcaggcacacccagaaactgaccagtggtggggacaggccagaccctctcacctcgtagctgctctcgtcctgaggctgggtccacattcacatttccatctcaggctcccacttagactaacgagggtcacccatcagagtaacccactccccgctcagacccctgtggcatctggcaccctaccctctcagacagggcctgggcagcttttcccaggatccctgcctccccaggcgcacctaagacctgagtctcttcctccctccccaagactcacacatgccacctgctctgttcgaccccccaccccacccgggggagctcccagaccactccccaggaggtttgggatccccatgcttcccttgatagtgggaatgggctgaggggccacaggagataacaagttgctttctggatggcctccagccaggggctctggggtcaggaggtggggtgggggttggggaggggcctttctcccttaactgcttggtaactaatggggttccctttctgcctgtttgactagggcctaggaggcgctcctgcccttgctgcccccaactccattctgaacagtcttgcaaatgagcacagcctgagccagagagagcccctgcggcagaagcagcccaaggggaacaggtgaccttggcctgtgtgcccagcctcccaggtccagctgcgtgcggccgggcagctgaggatgttgggagcacctgcttgcagggctctgggggcagccccagaaggggttttccaggaggggaagatttcatgttgagtgggagccatttctctggcctggccctctggccccaggatggctactggagggatcattgccctggagtgccagagaagtgtggaaaatcccaggcatcccccaaagccctggcccggcccacccagaggaccccttaagaggagtgatcttactcagggtagtgcctgacgagaagcctcagggaggggaagtctcctttggctgcagcgtagtggataggcagggcgcccatgtctgtggccgcggtgggatccccaccgccatgatgcaagagccagttcaccaccttggggtggccaaagcgggcagtcagatgcaagactgtgggaccagaattgtctttgtcctgtgggaggagagcgggttcaagtcctaaagcctgttgctgccccgcccctggcttgggccgctcccagactcccacaggcctggaaggtagctctgtgctctctgtcttccctggaagaattggccaggcctcactcagcagtggtttttttgggtcaagcggatcctgggtttgaatcctgcttctgtccttgggcaactaattggccctctctgaaccgtacgtagccaataggcagcaccgtgcagggttttcagaggctgcaggtcctgactgcgagctgcctacacgacaggcacctggttgtcatggcaggagactggctccaggcccagggccacagccctgactcccaggggctcagggaatgcctgaaggagtgacacagggttactgggctgagcagggccaggaagggtggctgtggggctgtaccaagctagcatcaggattggggggcagcccctgcatccaacacttgccccctctctctccacccttcctaggtgtcacgtgggaacagagacctccaccttggtgcgcctccagcaacccaacctcagtgccttagtcaggcaataagggccctggggactggtttgggtaggaaggacacaccaaatgagcaggaggaatttccccatagaggcgaagagaatccagagatggtgagggagaaaagcacataagaaattaaaaacaaatgcaaacaaacaaggttgaaacagggctggagggtgtgaatgtggtgattcttctcttcctgaggagacagggtcctgcgagttttgtcacaagtcaggaagctccatcagctctgcaacacctgagtcctggatggcgggagatgatggcttaagatatctgggcgcaaagcctgaggccctgcctgtaactccgactccctcaagggcagctgagagggaggactcagggcactggggaaagtcagcagacccagtcacagaattagaataaggtggagctacgcagggaagacaacaccaactatttcctttttcttattttattttattttatttatttattttttttgagatggagtctcgctctgtcgcccaggctggagtgaagtggtgcgatctcggctcactgcaagctccacctcctgggttcacgcctttctcctgcctcagcctcccgagtggctgggactacaggcacctgccaccgcgcctggataatttttttatttttgtatttttagtagagacggggtttcaccatgttagccaggatggtctcgatctcctgacctcatgatctgcccacctcagcctcccaaagtgctgagatcacaggcgtgagccaccgtgccctgccaacaccaactatttcattggcagtagaagaatcacactctgcagctactgagaggtggaggtgaagccaccctgccgagcagccaacctcactttttggttattatccttgtgccgatgctgccggacaaactctctctacaaatctcagcatgtggaagaaacagaggcaggaacaattgcccagcacctttctatttctcgaggacactcttgaagttattcatcaatgttttaattaaagcagatcttatcgcttttcctcaaatgggaacttgttcacttttagactttgttattgttcattttgggcttatctttggtcttttcctgtgctcttaaaagggtgcaaatcaaaatctgagttatgataatccacttatcatatgactaattacttcagtacaaggagttcctgcctgtctgtccaatatgaatcttactacgtcccaatgtcacattggcttcttttccttctcggtggcagcatttggagcttttacttaacttagggtcaatttcgacctctgaattttccacccctcccccacagctgttgctgggtcatgctgttttcttttatctctataaatattgtgacttgtaattgtcacttataaattcattctggctatactgaatcattcccccattatccaagtcatccaaatattcgatgtgcatttccacaaatcatgtagtggccccctgattggggatgatttgtagaattaattatatgctttagatctccattcaggtcttcaggtcaccaatacattaagcagagcagggccctgaacagcttatatggatcaacgattgacagagctgtcggggttgctgcaaagccactgactttttgctgttccccgtaacaaagtatgttcaaatctaggtcacaggtttgtggtagggtcgattcacagtatacatgtgcaacggcgttcagtagcatagcagttgaggttgtgaagacatgtgcacccaggtcaaagaagaaagatccttagacaaagccgctcaattcccaggcacccaatcttccttgggctttgtgaacctgagatttgacaggctcttgggaatgtctgtctctaagactctgttggcaggcttaatcaggctggtggccatctccatatgtgcccccccagcatttgtgacaaaataagggaagggggacccaataaagctacttctgaaagcttatgatcccacccctcatttaaactatgtgatgttgtcattctatataaactctttccaagtaacttaactaaaacacactttgccattagtcttgagtgtgggcacagcattattcttttctaggccttaagggttccttctgcttaaaaataatgtctaactttcatgaagtttacccatgattaaagtgccttctgaatatatattatcttgttctattggtttcaatatacctattttctttaaaaagaaaaaaatgatgaaccatgagtgttaacaccagaaaaaccttaaggtacatctgatctaatttcccactttaaagtgagaaaatcaaacagtgcctaggggtttgatttttccccaggctaattcgggttttcatatttccatctcaaagtggactttctttggctaactttaagttttaaacgtaaaggcctgaaaagtaactcaggatctagctttttcattagttttgatcgtgtatgaaagcaaatatttctttcccccaaatgaaaccccagggcttccagtatttgtagtgatagtgtgaatccattaggtctatttttaattatatctctcttattggttatttttttcacatttcctaactcatttgtgatattgcttccatataattcaactttttgtgcgctgggttcccatttgccccacaaaggcctatgtgcaaatctgatatcctgtttgaatgacattgttttgtttttaccttattgcttcctatctttcacaacaatgttgtcagttctcaacattaaggcattaaaaattagcttttctcaaatgctcagcatcattaatcattagggaaatgcaaattaaaaccataatgaatatcatctcacacctgttagagtggcatttgtcaaaaaggtgaatgatgtgttagacataatgcagagaaaagggaacacacacattgtgaataggtatgtaaattagtacagctggtgtggaaaacagtatggagtttcctcaaaaaactaaaaatagaatctaccctatgatccaggaaccctatttctgggtacatatccaagagaagcttcagagagtgctttgttgggttttctggaacccggcagggctcaggtgtgtggggatgcgctctgtgagcctgtgtttcctccgccgtgagggctcctcccgctcctgtaggaaaaggcagtgcccattttgtcttgtccatgtgggactccaaagggtccagacgcgacagaaaggcggcgaatcctctcagagtgggcaggggaggagatgatagaatatggggaggagatagaatatgggaatggggcagtagaggggtgggatttcatgaaatttcctgattcaaggctatcatgaagtaggcctctttgggagctcggccctccagtcgctggtgagggtaacatcccaccagtctctggtgaggtccagtcgcctccgccgactgcattgaaagccaaaagcagaactaggccagcaccgcggcctggcgtccagtgacccagcggtctgcatattccccagggtggaagcactcggacttcaggtttgaaggcaatgcggtcaccactgcaataagaaaagcaactagggaaaatggcaccttcttctccaaacttttgagacactcttgctctgtcgtccaggctggagtgcagtggcacgatctcggctcactgcgacctctgcctcccgggttcaagcgattctcctgcctcggcctcccaagaagctaatttttggcatagagagagagaggggggaagggggggggagagagattgattttaatgtcttcaagcaaaaagagactctttctgcctgttggccatctgctgccaggtgaacgtgaaaatccatcgagacgctttctgtgaaaaccgcctttatctctttgtccctcttaggttaaaatccgcactccaaaaccttattgaacagaaaaattacaaaaagcacatataagacgtttcagttttgtaaagggtaaaatgaaactgcccttcaggaagaatcagaagaccgacgagggagagaggagcgatcgtgaaatctaagtgggctgcccccgggtcttccagggttttgtactcggtggcttggcctgagttgatgtgcccatattttcaaacagccaagtgccctgagacacagcctttgctacggtacctgctgaaatctggaagtgtgattaactattacttaaattgagtggggcagactaagagacagcagcagtgaaggatgccctttgggagaaagacgtcgaggcgctgaggccaaagggtccgtgaggaaagagcccgcagctcgcgcccctcggcctgcggaagggagggcaaggagggtcctacggttcctgggaggacgcgaagagccaagagctctgacagctggcgccggggaaaaggccccgaggcggggtccgcatccctggaagggcggcgtccacactcctgcgaggcacggggcgcccggggctcggaagctcaaagcccgccggcttctgcagcttctggagcttctgggagccaagagtgtcagccggaaggatcccgcacacggcgcttagttctggaactggatacccgggggaggatgcgggatcccgaagcccgggtgtgggtccccgtggtcttcgtgttgggggtaggtgcggaacgctaagcctgggcctactgggagccatagtcttcttgatggctggtgcttattgggcttttttcagtcgaatttcaaaatgcagttgaatttcttactttggaaacgataatagaaatggctgacctcagattttcatgattatgttttgccttttccagtgtatgtgcagtttctgtagtatagtggttatcatgtttgcctcacatgtgaaagacccttggctcgagactggagggaaacatggttttttggtttttctttttgtccctaaatttagtgagtttaatcgaggttgggaaacaaacagaaaagtagttgaacctgtggctacactttagacctcctcaatctagacagattgttgaccaggctacagtttccactggtctgccagcaagaggcctgcttaatgttagctttggttccagaaattccttaagattctcttcattctcttctgtcgcctgaattttcataggctgacactgaaagtggatgacatcttaatgcatttcctaagtgtcccgctgggcttcgctttactctgataagttgcagatctggctgatttgcgagacaaaaacaaaatatttttttaaaagattctaaatctgcatctggaacttgtagagtcaataatctgaaaccacacgaattatctacatacaaaagattttgaatgcataccccttccccaaataatcctcagaaaaccggttaagttttagcatctatgactctgagatgcatatgaggcctttgtaaatttagaagttgagagtagaaagtacaggtttgtattttagaaggagatttgggaataaatatagctctggtggatatagatcatatgttaaggtttgttggccagagctggtgtgtgtcttgggtgttgggcaaagaacagagaacagccaaagctctgcgaggtcaatgtgaagggtgatttccttggtgggctcaagtttatgacgcagcctggacctagcttggcttctcagctagagaagaagcatgattccatgtcacagctcctgtctttgaaaaagtcataatgactcccagacccaacatgtggggaaaactctggatttgtctcttcagttgaatgtctccgttgaaaattgaggaaagaaatctctctactatttgaacttcatcaaaagactaatatgttaatattttgaccgtcaatatttccttaaactagtctactcctttcatagctaatacatcaaagcatattaacttaggaaatgggattctcccaaacaaggaaacattgacggcaagggttcttaatcttttcacaccacatttccttcaaatgctttatacatcttcaagcagacaaataatagtattataatgattacgagaccgatcattactcttttgccaaaaaaaccagcgacaaaagactaacttagtggaccaacctttgtttcttcattatctgtacattgattctgtccttttatttcgtctttcttctaattctgcttctgcttcttgtttcctccctggatttgaactttatttacctaaactaccagttaggttaccttctcagaacctctaaggcagcagtttgagattgacaatggaagatttaagattagaaaaaagaaacatgaatgaatttctgatgttttattataggggtttataatgcaggtagaaagacctttttcagacttaagagtttgatccaccaaatgagctattttgatatttataactttgtctagtaaaagtttcctataaaaacatttggtttggatatgtttgttagcttttagtcgacacttgaaaaaggcggttggaaggttctaagtctttttggatactcttttctcttatcccccaggccgtgggtgtgtagaggccttggtggtgcagtggtagaattctcgcctcccacgtgggagacccgggttcaattcccggccaatgcagcaggtacttcttcatttcattatggccttttacccgtcttttacgctgcaaaattatactgcataacctaatagtgcatttaggggcttggccaccacaaggtaaagtgacaacattactcacgagagtagcggcaagagacattcaggacactaacccaggacccatgcaattgttggactcaaacagcttagcaaagtggcaagcacgaagtctttccggtgagtcactgcagttttgatattggtacctgttactttcatctattcacggggcggatccctgcaaacccgaagaatcatcaggttcctgattcgcgtgctggaccttgggcttactgctgagccactgtagagaggatcaagaaatgacgctcttggaaggagagaagctgcgggcaggacagtcacgtcagaggtccaagaggcttcagcggcccaaagaaagggaaggtgtgtggggaagaatctgcgtggagatgaggggagcggcggggactggtccttgcgcagaggtggccagtggaccctcagggctgtaccccagacaccgtgaaccgaatttgctcacatcgtcagcggccgcggcctccgcgtgctttgtgggcccatcggtgttctgcgagggattccgtgtgtctggcaatgtctgtcaacaggtgttggcctgaaatttggccgggcacgttggctcatgcctgtaatcccagcactgtgtgaggccgaggcggatggatcgcttgaggtcaagagttcaagaccagcctggctaacatggaaaaatcccgtctctactaaaaatacaaaaattagccgaatgtggtggcatgcacctgctattccggctacttgggaggctgaggcaggagaatcgcttgaacccaggaggcagaggttgcagtgagccaagattgcgctactgcactccacctgggcgacagagcgagactgcgtcaaaaaaaaaaaaaaaaagcagcgaaagaaggcagagatgtcaatgggacaaagagacctcccaggaggcttgttgtagaggcagtgggtggatcctgggagatgagatttttttaaaattatgtagcagaatggggagagaaacggagaagcgcatgaaagagagaaaagcacgaaaatcggcggcgtccaagaataaagcagataaaatagtgtgagtgtttttacattcaaaaaatagaagaagtgcaatgcttgtcagcaggctttgtggtcgtgtagtggttaatacttgtagttgtggttgccacaacctgggttctaatctgagtcacagtagtgttttctagcctgcgattgtggctaatagacctgtcgtttgctttgcctttaatcctagcagcctccagagagcagagtaaacctctggccccgaagggcgccagcttctggagtttagcccacagcgcagaaactagggggcggcctggccgataggaaaacttggacatgctctttgtctcacaattgagcaggaaaaattcccgtaggtgaagatgccgcctctcaagggccctttgtctgtagcttccactggtgaaataatgcggttatagtctttttcggtagagaaaacggctgtatcagtggaattttttaaaaacacaaaacgagaacgagtttttaatgagctgacaataaaatctaaactagttgtcatggtctgcacaggcttgcctccattccccatctgctaatttttatgagaacagtaaattattactattatcattatttttgagacgtagtcttgttctgtcacccaggctggagtgccgtggctcaatctcggctcactgcaacctgtgtctccgaggttcaagcaatgagaacagtaaagaagctacagttcacataaagtgcacaaatctttagtgcaatttgtttagttttgatcaatgttatcaccacccagctcaagttatagaaaattgccatcatctgagaaaggcctgttagagcccctgtccaggtgattcccaccctgtgtcctcttagttatcactattctgatgtctattcccacaggttacaattgcctgttcttaaagttcacatgagtgaatgtacatatgttttgtgtctggcctttttctccagttacattcattatactcatgagatatatccacgtagtttcatagatcacttctcaattttggggttattgatttcttgtgctgaatattcttataacagtctttgtgtgcacttgagattcatggaagtccttcaattgctgggtcatgacctgagtataagtttaacatcagtataaattgccagtcttctagaatgctttttcgccagcgatgacagttgaagtggcaccaaattcttgtcagcatttggtgtactaactttgttaaatgtagctatgctctcagaccaggctggccaacatggcaaaaccctgtctctactcaaaatacaaaaattagctgggcatggtggcatgcacctgtagtcccagctactccggagggggatgttgcagtgagtcaagatcgcaccattgcactccagcttgcgtgacagaatgagaccctgtctcagaaaaaaaaaaaaagtagccatacactggtgagtggttagtgctatctcagtgtggaattaatttgtatttgcctaatgagcaatcctatgaagcatattttcttatggcttccagcatataagaaactctcctttgcaaaggcctattcgaatattttgccctattttatttggcttagctctatattactgacttacaaaagttctcttatatattcaagaattgagtcttgttttgacgttttttaaattatactttaagttttaaggtacatgtgcacaacgtgcaggtttgttacatatgtatacatgtgccatgttggtgtgctgcacccattaactcgtcatttacattaggtatatctcctgatgctatccctccccctccccccaccccacaacagtccccggtgtgtgatgttccccttcctgtgtccaagtgttctcattgttgaattcccacctatgagtgagaacatgcggtgtttggttttttgtccttgcgatagtttgctgagaatgatggtttccagcttcatccctgtccctacaaaggacatgaactcatcattttttatggttgcatagtattccatggtgtatatgtgccacattttcttaatccagtctatcattgtgggacatttgggttggttccaagtctatgctattgtgaatagtgccgcaataaacatacgtgtgcatgtgtctttatagcagcctgatttataatcctttgagtatatacccagtaatgggatggctgggtcaaatggtatttctagttctagatccctgaggaatcaccatactgacttccacaatggttgaactagtttacagtcccaccaacagtgtaaaagtgttcctatttctccacatcctccccaacacctgttgcttcctgactttttaatgatcaccattctaacaggtgtgagatggtatctcactgtggttttgatttgcatttccctgatggccactgatgatgaggattttttcatgtatcttttggctgcataaatgtcttcttttgagaagtgtctgttcatacccttcgcccacttgttgatggggttgtttgttcttttcttgtaaatttgtttgagttctttgtagattctgatgaaactacagatgagtagattgcaaaaattttctcccattctgtaggttgcctgttcactctaatgacagtttcttttgctgtgcagaagcccttaagtttaattagatcccatttgtcaattttggcttttgttgccattgctttcggtgttttagacatgaagtacttgcccatgcctatgtcctgaatggtattgcctaggttttcttctaggctttttatggttttaggtctgacatttaagtctttaatccatcttgaattaatttttgtataaggtgtaaggaaaggatccagtttcagctttcaacatatggctagccagttttcccagcaccatttattaaatagggaatcctttccccatttcttgtttttgtcaggtttgtcaaagatcagatagttgtagatgtgtggcattatttctgagggctctgttctcctccattggtctatatctctgttttggtaccagtaccatgctgttttggttactgtagccttgtagtatagtttgaagtcaggtagcgtgatgcctccagctttgttcttttggcttaggattgacatggcaatgcgggctcttttttggttccatatgaactttaaagtagttttttccaattctgtgaagaaagtcattggtagcttgatggggatggcatggaatctataaattaccttgggcagtatgaccattttcccgatagtgattcttcctacccatgagcgtggaatgttcttccatttgtttgtatcctgttttattttgttgagcagtgttttgtagttctccttgaagaggtccttcacatcccttgtaagttggattcctaggtattttattctctttgaagcaattgtgaatgggagttccctcatgatttggctctctgtttgtctgttattggtgtataagaatgcttgtgatctttgcacaagaattctgtatgctgaggagtcatttttaaaataaatatattgcaaatgacttttcccagtcagtgaaaagtctgactgaaagctgtcaactgaaaaatcacacaatttataaatttagaagggagattttattttttataaatggttacagcctgcaaggtggccattctgacagacagggaggcataccctcttgctgctgaaacctgaaaagtacgtttccagggaggggaggggggaacagggatttatgttgatgtggtgggccacatatacatattcaacagggaataggaggagctctgaatattcatgaagggatcctgctgcatgcatgctgagtaaacatgcctgttacatgcaacccatgttcattttggggtggagacaacatttaaatacattataattaggccctatgcttcaaaaggggaagcagggacacaaaggcagtcaagtgcacagcctctgtaaaccgtccagaacccgtccacagccagtgctctcttatcaaggggaagttactgaaatcagtctcttgtccaatcaaagctgtagttatggcttgtgtagggagggctcagtcagtttatggtaatgggtgagctgcaagtgcttcagcattgcttatctcaaggccagtgcttgtttagctagagaaaaaaaggaagaagaaaaaaacctgtggcaattggaacatagtttattctttaagttgaggggcgcatgactccaccttgcctggcgtggccttaggtctcgtttatcataccatatcttactactgcaaggagtctgttctgtcagtcttaggatctctattttaacaataatgctggtcagttgtgtctaaaccacaaagggagagagtataaggagaggtgtctgagattccaactactgggcaggaactcagtagttaagacttctctggggtctccttggccaagaaacagtctgtccagttggttgagtggctttggattttaattttagttctcaaagcatttaatttgatgaaattttgccatattttttctttatttttaaagcctgttatgttctataagaaatctttctactcaggatagtgaatgtattctcttaattttatctctctatgagttccagcgttttagttttaatttttaaattgatgacatctaaaattctactcctaaccaaaacattcctgggggtgaccaaggacaactccaaaaatcttccataaatggaagtaagacttactccttgaagaacttactgggatctgggcctgcagggcacagtggctttagtgcacctctgctcttacgactattcagaaattgtctttgtgaacccatcaggctgtttcaaaatcagcaatttagggcttgcttgcaacatgcagttatgcagcagctgttttgtggatctggtgagtgcctgcacgcatagttccccgggaattttctgaatttgaattctcatggtatttcaagtggctcagttgtctctttcttttcttttcttttcttttcttttctttttttttttttgagtcagagtcttgctctgtcacccaggctggagtgcagtggctggagtgcagtggcgcgatctcagatcactgcaagctccgcctcccgggttcacgccattctcctgcctctgcctccccagtagctgggactacaggcacccgccaccacgcccggctacttttttgtatttttagtagagacgaggttttaccgtggtcttcatctgacctcgtgatccgcccgcctcggtctcccaaagtgttgggattacaggcgtgagccaccgcgcccggccagttgtctctttcttttgcctactgccacacacgtaccaccaaatcctgcactccaagctgcttctacaccctggactcccaacctccagttagacaatccacatcttcccacacctgcctcaggctccatcaggctactgtgcctcctgcagcaaccaggccagggggaatctggattcctattacacttctgaggaaggtggtcagggagtgtggaggatgtgggtgggagggggtgaggttgagggcaggagtacactgtggtcttctgtcttctacctcattggcccaggtgctgctctccctccggttgtctgctttcagccctgcctgggaaatcaggccggcgccctgatcttcctgactctcattttgtgaggaacctgaacggatgagccatcgctcttgtcccacacgttctgtccaaaaggtgccctcctctctgcttgctcgggggcctgccctctgagctctggcactcaggctgggatgccgcccagtacagaggctctgcagccctgcaggggtctgactgttccacaccagcaggataaaggccacagggcatgctgtggtggaaaagcattcagaggtgtgggctgaaggcctctctttccacagtccctttgaagacaccatggaagtaggcacccccttgacagacaaggtggcccaaggcctggcttcacatgcaggctcttgggtcccagcgggtcctctctgtgcctggtatagccaactgcttcacgcatcttacccggtttcctctcctccacaacccaagctcctcctcgacccccttgctcagctgtcctcaggacagcaagatccccagcccttggaaaagcccatctctagtgcttggggagggagttgggttcaggtggtctaaccacagaagaacagagaacctgaggcaggaggaaatcccttcccttgctgggtctcttggcacagcccatccaggggtctgggtcagggtccaggtatactctaccctccttgaggacctgggttttcaggcccccgaggttggtcaatgtggagtctttcccactgttcatctgggaactgaaggaatatcccatggggccctctcttactcattagagacacccagaaaatactccatccagcagaaactgggtgcagtgtaccagaccactataattataattgcaggatgtggaggtcagatacgttttgtgggtattttctctctgtctgtggcttgcttgccttttcgctttcttagtggtatcttttgatgagaaggtgtggctaatgttgatgaagtctcatttatcatgtctttcttatatatgtattttttctgtgtcctgcttgttggtaggctaatctttgcctgccaacaagtcacaaagtatccttgaaatgctttatatctttaacttttaagttttggtgtgtaatgcggctgaaattacttttgtgtgtaacgtgagggagaataacattgttggtctccccacatccatatagaagttcattaattgaaatgatttattttcttttattgaactgcttttactgaaaacccatttattgaccgtatagctgtggatcaatttcaggttttctaactcaggctgtttatccgtttgtcactcttgatgccttgtgtctaatagcttatagtaaaccttaaagtcagatagtacaagtccttgttcttttccacacattgcaataaattttgaaatagataataactcatgaaaccatcacacacatcaggatatgctgtcacttcatccctttctgacatggtttggccgtgccctcacccaaatctcaacttgaattgtatctcccagaattcccatgtgttgtgggagggacttaggaggaggtaattgaatcatgggggcgggtctttcctgtgctattctcctgatagccagtaagtctcactatctgatgggtttctcaggggtttctgctttggcttcttcctcattttctcttgctgctgccttgtaagaagtgccttttgcctcccgccatgattctgaggcctccccagtcatatggaaatgtaagtccaattaaacctctttttggtcctggactctgttatgtatttgtcagcagcatgaaaacggactaatacactctcatttctgagtgggacacatgctgtcactcacatatgctggttgctgacttgtgacggaagattctctattgtaccctctggggacaatacatctccagttgcctgcggggaggatgaaccctcaagagtcaatgtgttgactgactctaaatatgggttcctggtgctccatgctcatgcagccatagggaaggaaaggggactatcaagagccaagggatcccccatacgactttactcagatcttggaacttttagatgctgtccaactcccaaagaaataacaattactcactgcaggggacaccagaagggagacacttttattattagaggaaattccctggtggaaagagcagctaaggccacaactaaggaaaccctggtatttcaagctgctgcgctactaccaggtactgcatccgtgtcagtgacaccatactatacccctaaggaaattaaagggactgagtaaaaggcttccagggagacccctctggatggttgctacaaaagaacaaactctattcctgaggctgacagatgggaaataattaaacattttcatgattcctcacatttgggacgggattttccattcaaattagtttcctaaatattcttcgggaagggactgttctaaactataaaaagggttaccactcaggaagccaccccataccccgatccctgcttaaacctgtacaacaccaaggaacataccatggtgaagactggcagacagacttaacccagatgccaccttacagggaactacaagatttgctagtatttatagacactttcaccaggtggatagaagctttccccacaaggacaggaaaagtactggaagtgtctaaattcttaaagaaatcattccaagatttggattaccaaaaggtttgcaaggtgacaactgacctcacttcacagctaaggtgacccagtgaggtcatgcctcagccttaggcattacctgtcttcattcctcatggagatctcagtcttcaaataacatagaaagccaatcgcgacattagcaaaactctttcagtttgggggcttgcctgccctgcgtcactatcattgtttccttgggtttcccaggaatgtacatgtgtgagactgccgccctgcttatagatctgtttccctgcaaggaaacaggaatatgttgcctgtggcttccagagttggagatacatgtagttgcaccactgagggctaacatttaattttggaatcaagtgatgcattcagactggttgctatcattctgtggtatatatttagtgaacacattcatgattgagtttcttgcttttagctggagcaagaaagttttataattgtgatttgtatgaaaaaatcataggcaagggaatggatgtaaaataaactttattgtcagaggtttctaaaggctcatccttcaaggaaaatggacatatgctgaagagctgataaactgtctacagcagtgttattctaacctaatcttgattccaagttcttgccattttcctccagctactgttgactccagttatatataggatgggggaaaggggattatctacgaatgtaggcatcactttctcttgggcagttatcacattggcagactgaagggaagtgatttctacaatcaaactatccatttggagtacaaatctggagtggctgtaaaattcggttctcagagatgaacttgcagattcggactttcaattgttctgttgttttagtttttctcatcaactggggaactgtttgtgactaagctttgttaaaagtagagaagagcttttcataattccaacattagttgttacctgaaacaaacaaaaacacacacagagacaattaaacagtaatctttggtgaggtcttgctgatacctgaggctggagtgagagctgagtggtgatacagctcatgtgcgtgatccagattgcgcactccttatgagactgtaactgatgcctgatgacctgaagtggaacagtttcatatggaaaacatccaccacccccttccatggaaaaattgtcttccatgaaaccagtccctggtgacaaaaaggttgaggacagccaaaaaggctgctttaaatgataaccttccccaaaactaaattacccctgtaaaatgaatgaaaggccaccaagttagaaggatgaaaggggcctgatttctactaagatgtatgcctcgttaaataattaccagccattattccagaagtcacaagattggcagcttccccaattactgctgtgaagaacatcactattgtagaacctaagattggcctcttgagatgtcttttcaggcttttgcatttctgactgctggaaggcaccatctggcccgaaaatcaaccagtcccttagcccccacccagaagctgactccatgcaggagggccattttccacgcccctgtgatttcatccccaacaatcagcaccacgcaagccctagccccctccccaccaaactatctttgaaaaaccccttacctccaagccttcagtgagattgctttgagtaataactctgtctcccacatgtcgtggctggcctgtgtcaatgaaaccgtttcctgcagtgccatggtctccatgaattgagtttttgtgtacattggtcaggaagaacccatcaggcggttacatctgcaggatggtgccagttctttccacaaaggctggtcagatacccagaaaacatttctccactactacctggacaatgtgtctccctgtcaatctccagggaatggggcctggatcaagtatttagtattcagcagttactacactgtcacctaatccctcattttcaatattttgccatgcttccagtggcctaactggccaccatgccacagaatctttactttatgatctccaaggagaactctccactcgatgttttgtgatttgagcaatggaatagaatctgatactggtgggctgggggaggtccctggacactggtgggatctcgaccccagccgtggtgtccaggctcttgacaccatcgtgagaacaaagtcaaagatgagtcagcagatagtgaaagaagagatttattgcaaagcaaaaagtacacactcaagaaaggggagcttgggcatacccaagagagaataatgggttctggggtttcatcttgatgggtttctttaaccaagaattggaatattcacgaaaattcctgggtaaaggtggagatttcttggaactgtggtgccatttttacatcaaacactggtctcagaactgtcatggcactggcgggtgtgtgatttagtatgttaatgagcatataatgagggcctaggtaaaacctccatccaatccagcaccacgttgggtccactcagccttagccagcttggtccacaccctggtttttcagcgtcttaacagcccacagcctcaagtcatgtaaatctgctgcctagaatttgttatcctgtgaccaccctgtagtattcctgtctgaaatctacttgtaaatattcaaatggtctttcacttgggcattccaactttgcttacttcacagtgtttcctgcgtaatatataagaaaagatgatccagacatttgttaaacatctcaaataagatgtagcccaggtatttgtgtcaaatttggattattttggtttcgtctttgcagaatataaaaaactaacatgaggtaagcactaaggtgtggagatggctgtgcaagagatgacaaagtccagcaccacgcttgagagtgtccaatcatctcttctgggacagcatatttttctacaatacggatttttgaaaaaaaaaacaacatcaaaaaaaaaaaaacctacaagattcatgaaactggacaactgtctttataacattaccagtgataaaaccagtaaggacggctggtttgcagtcatctaagcagcctctttactttcataaatatggtttctctctgatattaaacggcttccaattgcaagcggaatgctgcatcacaaggataaggatgtgaagagaaccggtttcttttgtaatccgaaacattctagtctgcgaattaaaagccattatttgaagaaggatgccccggctccatctggccaccgaaaggttgctccttaacacaggctaaggaccagcttctttgggagagaacagacgcaggggcgggagggaaaaagggagaggcagacgtcacttccccttggcggctctggcagcagattggtcggttgagtggcagaaaggcagacggggactgggcaaggcactgtcggtgacatcacggacagggcgacttctatgtagatgaggcagcgcagaggctgctgcttcgccacttgctgcttcgccacgaaggagttcccgtgccctgggagcgggttcaggaccgcggatcggaagtgagaatcccagctgtgtgtcagggctggaaagggctcgggagtgcgcggggcaagtgaccgtgtgtgtaaagagtgaggcgtatgaggctgtgtcggggcagagcccgaagatctcatacttacctggcaggggagataccatgatcacgaaggtggttttcccagggcgaggcttatccattgcactccggatgtgctgacccctgcgatttccccaaatgtgggaaactcgactgcataatttgtggtagtgggggactgcgttcgcgctttcccctgactttctggagtttcaaaaacagaccgtacgccaagggtcatgtcttttttcgtattggtttgtgtcttagttgttaatcctacagtggaggcctggggaataagaagtaacatgtggcctgcacgccataggagaaaaagcgagcatcagccgtatcggctttgtaacacaaattagctatcgtgaagtccgctcagctcttccatttctaccctggctgctttttgcagggattggtccgtggtctccagtctcttgggttctcaccctgtgtgaaaatcttcgtgtttttccctaccccccaagtcacctcttacacagcctctgcttccaagcgcagcccccacaggagtttgtaggatttctgtgctagcggggagtgtgttctcacctcatagagccaggtagaaattatgcagatgggcgctgttctctgggaagaaagcagggcctttggggctctcagtgtccccgttgggttgtagacataacactcttactttgcgtaggggaacggctctgccggcccccaggtgccctagcgcatatgcatggaggcccgcaggtcagaaccgcagtctcacctgtcttggcggaaatgccctgcgatcctcccggagatagaaggcgggaagttttatgaggagccggtccagtttccctactatctcctgcagttcatatatctagtgtttctttagactttaagcgactgcttcatgtttgatgtctcactcccacatcctacatccactgccagccaactttatagatagcaccgtgacccatccttcccacccccaagaagccctttcctatttctggtgccagtgtcctccccagtccctctttcttcaggccctcgcttatcaccttcatggacagaaaatacttagctctctctcaacctgaggtttacacctgacacgcatcagtgccctggcaaattccttaataccccttctcaaatggcactgtaaatcatctctttttaactcccagaactatctaattggttttgtccctgcactacatgaacactagtattccactacagaggaaaaccccaggcctagcgatagcggttctgggcattgtgccagcctctcccagggtatgttttctgacctcacctacttttgatcagctgaggtcaggagttcaagaccagcctgaccaacatggcaaaactccgtctctactaaaaacacatacacacgcacaataataataataatgataataataataattgccgggcgcagtggtgtgtgtctgtaatcccaactactcgggaggctgaggcaggagaatcgcttgaacccgggaggtggaggttactgtgagccgagatcgcgccattgcaccgcagcctgggcaacagagtaagactctgtctcaaaaagagaaaaaaaattagtgcatctgagacatattattggagacagtagaatcctgcgtccaacaggcacttggtgcagatctgaacccattgagctattggctcatgttccctatgttctattaagtatcatgagcagaaattgagctctttggcttttacccactgagtatggctataggacaggtctctctctctctctctctctctctctctctctctctttctctctcattctttgcatcattattttttgccatcagtgtgggtttttggttttgaggttatgaagtgaatttctggggacaatctctgttgggtcgtgttaacaaggatccagtccctgtttggtgatacatgacagctaatctggtctgtgagtcttctttattgtctatttattgtcctgagaataatggcatttcctgatatttgagactgcagcaatgataagttgttcagatcttgtctttccaatgtttggtaaacattttataggcccaatttttgtcaatatctgcaagagtggcatctctgttacaagagtgatcttactactcgatgtcccccctcccacccaacttcatttcctaggggctcttggctttaacgaatttactgtatctaaaagacatcttagtacaggaagaaaactaaatctgtagcatgtaaggagcagttttatttgattggtatattcaggtttctaaccagctgaaaaattcaaatacatgccctttaaggattaagtttaaaccacactacagaaagagaaaagatttatatgatcacatataagcaatggaatcagcaatatgagtacttttcacaactatacaaatcaaatttaataatctccagaacattaaggaagttcagcccttaatggaaatgaatgaaaagaaattattcacccactgttacatgccctggaaagagaatgtcctgccagactcaaaagagtatcacaatattactcagattttcagcaatgaaggccctccgaggatctaatgatgttcatattttcagtttatttccttcactgataaacattgttaatagataccattgcctctgtttgcactttaagtgatgttacttagaacaattcgtttctttagcatgcaccctagtttggtggaaggaattttccttcttttcaaatataggatattttctcatgaaacaaattggcatactctttcagtgaagtgaatagacaaattagatctctacaattgtaaaggagtcactgccccaattatcttaggaacaataataatcacttatataaaattaaaataagaaaattaagccaggtatggtggctcatagctacagtcccagcactttaagagttggagaccagcctgggcaacacagtgaaacccctgtctctacaaatttttaagtattagctaattttttaaagttggccgggcatgataatgcatgactgtaatctcaggctgcagtgaactatgattgtgccactgccctccagcctgagtgacagaatgagactcccaactcaaaaaaaaaaaaaaggaaagaaaattaagaatttgttgaaaattgttttactacaatgctaggctgcatgtcttgcacctgtactcccagcaactcaacaggctgaggcggaaggattgctttaggccagcagttggagaccagcctggggaacagggcatgacatcatctctaaaaaaatacaaggcaagctgagccaggaggattgcctgagcccagaagttccaagttggtcagctatgattgccccactgcactctagcctggataacagagcaagaccctgtgccttatttttaaatttatgttatttttttactacttatgcttatttatctatttatttatttttgagacagagtcttgctctgtagcccaggctagagtgcagtggtgccatctcagctcactgcaagctctgcctcccaggttgaagctatttccctgcctcagcctccagagtagctgggattataggcacacgccaccacgcccagctaatttttatatgtttagtagagacagggtttcatcatgtttgccaggctagtctcaaactcctgacctcaagtgatacacctgtctcggcctcccaaagtgctgggattacaggtgtgagccaactcgcccaggctccttatgcttgaaatgtgaggtttcattagggaaaaattttcttgttgaatttctaacatgaaaaaataatagatttagctgtagattaaattaatggtcctggtagtttggtacaataaaataaatgaagttgatagcagagaggaatctttgatgcttttgaacaatttaaataatgtaatattttttatataaagacatgaaaaagttcattacattattattatatttatttatttatttatttattttgagatgtagtctcactctgtcgcctaagctagagtgcagtggtgcaatctcggctcactgcaaccactgcttcccgggttcaagcaattctcctgtctcagcctcctgagtagctgggattacaggcacacaccaccacacttggctaatttttgtatttttagtagacacggggtttcaccatgttggtcaggctgtcttgaactcctgacctcatgatcctcctgctatggcttcccaaagcgctggggttacaggcataggccactgcacctggcccattacattattttttaaaaatcagtgtgactcttttgacaaattagaatggtttaataatcttggttaggctgggcatggtggctcatgcctgtagtccaagcactttgggagcccgaggtcaggagtttgagaccagcctggccaacatggtgaaaccctgtctctactaaaaatacaaaaattagccgggcatggtggggggctcctgtaatcccagctactcagaaggctgaggcaggagaattgcttgaactcaggaggcagaggtcgcagtgagccaagatcacgccattgcactccagcctgggggggcaacagagtgagactctgtctcaaaaaaatcataaataaataaaaataaagtataaaaaattaaaattacgtgttcaaatacattaaatatatggcaatgaaaaggaggcctagcatgactgactgcattttgctcctaacccttcctaccgtgtggtgacatcttccaggctaactgctttttcttatttctgcacataggccaagctatctatgggagggatttagcttacagtttaactttaaagcacagatgataataatcccttccccaaactaactcctgagaagatagagaggttgtatacacaagtaacagtgttatgctgaagatttataagagaagtgtgacctgacaaaggaccaacaattttcaccatccccttgggctctcactgcagcccatgtctgtcattgtcagacctcttcacctcaatcgcctccttcttcctcccttccctaatgtacaaggagccggaaaatagtattaatttaagatggttcttcaggatgttacttcaccatctgttcagtttggtggctctctggaataaagtcaccttccctgcccctacacctcaactctcgacttattggctgtcatgcagcaagtggtgagtgcagtaagccgagatcacaccactgcactccagtctgggtgaccctgtctcaaaaaaaaaaaaaaaaaaaaaacagagagagagagagaaatttggtttttgaaccagacaaattaaataggagacttaattccaatgagacctagaaatgtctaaatttctaaaatttctaaaagaactgagaaaattgcctccattgaggaagtaagctgaaggaggtagactgtcatgttttctgatttgagaaatattgaggaggctttgtctctttcacctccaactgctccttctcctcctgcccctgcacctgcatagtctttcttacctgagccttcctgtcctgccttgcctcttcttccatcaccatcacctaaggaaagtccccagggatctggtcccttccctgaaacttctgttctgacagcccctttcaaggtaaaacccaaacccacaggaagaggggagcctaccgttgtgtataccacttcaccaaaacgtgaattaagaatattataaaggacttccctgatctaaacttaaatacatttcactcttctgtttctaaagcaggctccaagatcctgtaggctttggcagaaaatttgacttaactgttgaaacctttgagcccaaatattctgatctttatcaattaactcacatgctggtgaagaagggaaggccactaactggttgcaaaaggtaaattggaaggattttcaaaaagggactgaagcagaacatgaaaggttcacattttcaccaaatatctccaagttgccattccccaggtccttcctaaaaatatagattggaggataattcagcattgtactaaaaagccagacaaatctgtctttgcttaactaaaatggtttgagagccaggtgtggtagttcatgcctgtaatcccagcactttgggaggctgaggcgggtgaatcacttgaggtcaggagattgagaccagcctgccaacatggtgaaaccctgtctccactaaaaatacaaaaattagccaggtggctactcaggaggctgaagcaaaagaattgcttgaacccaggaggtggaggttgcagtgagctgagatcctgctactgcaatacagcctgggagacagagcgagactctgtctcacaaagaaaaaaataaaaagaaaaaagaaaaatagaaaaaaaaatagcagggtagtagaaatataatgcacacaagaatgataatcatgaagacaatctgattctacaagagtaagggaacctattccattagagagccaactgaaaacatcaaatcccagttcacaccccagggtgtggggtcacgtgcctgtaatcccagctactcgggaggattagtaaggaggtttgcttgaattcatgaggtcaaggcaggagtaaaccctgatcatgccactgcactccagcctgggtgacagtgagaccttgtctcaaaaacaaacaaacaaacaaacaaacaaaaacccacaaaaccaaacaacaacaaattgccacctcactctgaaatcacagtggcaaacatcactttgctattgacaaattaaaagaaaaacactccctcttgctatcaacctggcctcttgctctaacatgtctgacccatggtttaaaatgcccaaaagctgatgtcctcaaattataatacacttacctattctgcaccagcatttatttttgtctggaggagatcaccatccatggtcctgtaaatgtctaacagcatggaatgatgaagggcagtgtcttttaggatatttggttatatctatatatatggctctgaagaaacccaacactgggcgagttccctcaaacttttcactaggcatgaccactgctgtattttagatagagattctgtggggcaaaacctgagaattatctgcctggctatctagaagatagctccttgcattttttgggggagaacacttttgcttcaagggagtgtttcctcccaggattagaaatctttctgtaacctcaggaaacattgctgatgaaaaccaggcatggtgtgctgtacaacttgtagtaataaggcagaagttaaaaggaaaagacaggttccctgtacttggctgactccaagacctgccatagatagagccctagcagatcctcggtaacacgatctgaaaagtcagagccgcgaggagtgagttccggagactctctcaacacagtaagccccaacaaagataagaggaaaaaacaacaaatgcctttactaccttctctttcccccttcccatttctaattattcaagttttgttaagttcttgatttcccttcagtgcagctgcaaggtcaccagctatacttgcattgcaagacctgtgacagtttgattagctgcctttgttctgcttctataagccctcttgcctgcccccgagtttcatgccatcaaattcccgccgcgccattcaaactagccgaccccctttcagaagtgtctataaagttaagccctgtctttgttcggggctcagcctttggattttcatctgctgggcctcagtgcagtcaataaatcctcctgttccacccattggtctctctgttctcctgattcccacaacagtagtaggggactgcgttcccactttcccctggtctttcatggtatgaataatggacagcatttttttttttcacctatagtcgcaggctcggtctcagtgattgtatgctgtggtcagctgtttttgtttttgtgagaccttgctttcttgtttactgtcctgggacagatgtctgtagtcacttgtttcctcgggaggcaaatttcagtctctgtgggggaggtctcccatgttagctgtggtggtacttggcaggcagagctcagggatctaggcttccgtgctttgtagattgctcaatggtccccaaggcctagtggcttttaacaccacttgaaaaccttagtgtttttccactgtccccagagtcacctcttacacagcctctttttttgtttgtttgactttttctctgagagacagtctcactgtatcttggttgaatcgatcctcccacctcagcctctggagtagcagaggcacgagtcaccacagccggcttatatctgttcttgtttttgttgttgtggtggctgtcttgtttttttaagagttgaagtttctccatgttgcccaggcgacgtgctcccggcgaaggaggccgcctgcctgggggcgggctggagccacgtcccagggctgggggcgctgtgggcactgtgggtgccgcacccaccgctgcccggcactggaggccaagagagcgttcccgacgggctccgcggatgccccgccgcgtcctgctgcccatcctgcccgggttgtcgcgggccgggggcacgacaagaggccggggtctgcccggacgcagcggcctgcagggcgcagctgtccctccaccagccggggtcccctcgctcagcccatgagacaaataaatgaatacataaataaataaataaataaaagatggagtcttgctctgtcgcccagggtggagtgcagtggtgcgatctcggctcacttcaacctctgcctcccaggttcaagtgattctcctgcctcagcctcctgagtaactgggattacaggtgcatgccaccacacccggctaatttttcgatttttagtagagacgggatttcatcacgttggccaggctggtctcgaacccctgacttcaagtgatccacccgccttgacctcccgaagtgctgggattacaggcatgagccactgcacccagccagaagtgggcattaatatgcaggcgccgtatagggcaacatctgtgtgcacctcttacaaatcttaatgctgtgtatatgaggggagtccttcgtgtccccctggggatgtttgaggttgcctgtatgtgttatgtgtgtgcatatttttaagctcagatatgcataggcggattgacacctctgtttgaatgtattcccatgagctcatgccattaattcaccatcacaagaaatatttactgagcgtgagccatgccattccacagacaccattatagcactaagatacaatgaggaacaaaaaatccaggctttctgagctcacactggggtgggggcatggtgggaagacacaggcatcaatgtaataaacagaaaccacgacagggctaagtgttctggaggagaggcgcatggtgtactgaggcccctgacgtagaccccaggtgcacctttgagctttgcttgcatggtttgggtttgtgggctcacctgcatgtgtccatgcatgccccatctgcgtgcccgtgcatggctgcatcaccccatgcacacgtgcactgcccctgggcttgcccacatgtgctgctccccagggcgccaggctatcagcctacaaggcattgtgggtctgggcccagcctgccaccccctacagaggcctgagcctgccttcccaggaggcccaggactctcacccagggcccttccctgcagctggagcaggctctgtggctgcaatctggtgagctggagacgcaagagcccagggggctggtactccagagcgtggagttgcggaggcagctgcaggaggagcaggcctcctagtggcgcaagctgcaggcctacctggagggccagcagcggcaggcccagcttgtgcagcggctgcagggcaaggtcagggccacccattcctgctctttccctcccacgtgttcactttgccctgcccccacccctggggctcaccatcagctcccaatccccagattctccagtacaagaagaggttctcggagctggagcagctgttggagagatccggagagctggagcagcagcagctgagggtgggtgccagggtggggcagaggcaggccctgccctccacctgcccagcctgatgctttaacctctctgccacccaggacgcagagcacagccaagacctggagagtgccctcatctggctggaggaggagcagcagggagggccagggctggcagcatggccccctgggcgagcgcctactgatcccctgtgccccattcaggagtgccagcctggcccaggtgaatgccatgctctgagaacagctggaccaggcaggtttggccaaccaggctctgagtgaggagatacgaaaggtgaccagtgactggactcgcagctgcaaggagctggagcagtgggaggcggcatggaggcgcgaggaggaggtgggcatgggggtgcagggaggccggcgatataagaggaagataatgcacaattatgctagtgagactctcttttccaataatgtttgcacttctcaatactacatttaaaaaggaaataggagcacttgaacggttaagtaagaagatgaacaaaattgaacagaggaaaaataactgtctgaagacatgttgaaaatacatttaaagacagtctgtctgagacaggagctgagctggccaatccatcttttaaatcattgaacatcattcaggtgtcaagtatttgacctggagcctggaaggggaggagagagtccaaaaaaaagtcaaaatataaagaaaaaaaattaaagaacttgtcccacaaatcaggcaaccaaggtctaaacttataccctctgcctgggtaaattgttgttgcttctttctgtgactcttaaaagatgtaccatatacctcatttaatgactttgctttattcatgaaaactctatccccatgggaaaagctgttaaatgaaaaaagatttcttttaagtagaaaaattatgaaaggattccttccaaccctccatacccaaaatatctcaaatgaattatgtatctatcaattatcaatatatatcaaaatataccaattaaaaatatcagttaaacaatacgtcaattgaactatgaaagcaagcttatttaagtagcaaagaataacgtgaaggttagtaagtatagcttatacttaaaatacaatgaattgaaagctcatggcacttcatagagtaggaagaagaaacttaatagaaagtggtagttgggcgagaaggactgcaagggagttatttggaaaatgcattttttatttctgcatcattttgttcacaaattattcctaatcttttgtgaatttgtggatttcttgaactcaaaccagacttaaaaatacagttatagcacagaaaaaaatctttaatggcaaaataaaagctaagcaagagagcctttcaaaacacatgaaaataacacacacatacaaaaaaaaaagaataaagagatgtacaagtgacacctcctcaaccttctcacttggtgtacatatgcacagtaaattattttgggctcagccaagcatgggagcaattcaaatagatccatatgatattctctgattagaaactcttgtggagtaagttggtgagtgtatctttgcctaaaacagtcatgtcaaaatatagcttcctatagcatatttatttagtatcattttggtgaaaaagtggttatacagaatagaaaagagttgtccaaaactaagtggttgacctttccagagccattacctgcagaattgttatgtaagtctgttccatactcataaaggaatactcagctgacccaactgattttctcgtgttttttccttcaagggctagtagaagtctatatgttgtggtggaaaacaacctcagccctatagtccaacatttgcctatcaaaacttgtcctatgatttataaaactagaacctcactggtaagtcacattcctagagtctcccccatccctaaccccagtcacggaaaataaatcaaatcattgtcactctttcttaacaaagagcatacatttaaaacttgagtaaaattacaggtaccgtctgggtccttcaagggggaacttgaagtctcaataccgcagttgtccaatcagaggatccaagatgaatatactcaaggactttatgcttggcatcctctggagacagtacataaccaccagcttggtttaactggagattcatttgggttaggagaaattatgtaggcaatgtacttagtcaatggaggcctcatccctgaagacttacaagaatctgaattcgtatgttacttttcctttaatggagtggaattccaaatgaaaataatcaaacagcatgtgcataaacattagatataatacccacatttacaaagcctttatagatatgcaagtgttattgcgtctgtccctagcttctgtacagaatttaatgggtagctgttactattttattgctgtataaaaatgaggaaactgataagttgtctaaaggtgcacaatcaaaacacatcaaagccattgtgaaatacaggtccccggatttcaaaaacagatcttctgcttataaattcagtctttttcatactgccataaactccagaatgggaaaacaaagttactatcagaaaagcttcttttagctgggcgtggtggctcatgcctgtaatcgcagcatattgggaggccaagacaggcggatcacttgaggtcgggagttcgagaccagcctggccaacatggtgatctctactaaaaatacaaaaattagctgggcatggtggcggacacctgtaattccagctacttgggaggctgaggcagtagaatcgcttgagctggggaggccgagatggcgtagtgatccgagatggcgccactgcactccagcctgggtgacagagtgagccgacatcgcgccactgcactccagcctgggtgacagagtgagactccatctcaaaagaaaaaagaaagcttattttttcccctaatcaccataatattcactattaagtgagggaaatagaaataatttatttagcaaatcctttctagttcaaataatttgtatacaggctgtgcaaacataataatgagattctttttagtcatcttgctttatatcactaattacactcttatttaatgatattttaaagaaaaacgtgtttattttcaagtagaaaactcatatctgtccaccaaggaaagctgtaacaaatgtaaaatacataaaaaagataactgctaaatttctaaagcattccagaaaaagacaaatagaagggtgtcagattaggaaagtatgtcttgtaaggtgtaacggacagactgatgagcttagagatgtggatctcaaagtggttctcagagcaacagcatcagggtcacctgggaacgtgttagaaatgcagattctcaggtaccatcccacatttaatgaatcagaagctcagagtagagaccagcaatttgttttaacaagtccttcagggattctgatacagctgatgtttgagaaacactagctttaggtaaacgtaagagggtcacgttagtatttttaaatcattggaagttggtttgttttgttttttcttaagtgggactcatttatacttcaatacacagaatggatatttagaggaagtcgtttttgacctaacacggatgagcatttccaattgaatagcgctttctgataatggggctgcccactacaagtgaataactgggtttctctaggctggagctgcagacaggtcactatgtgtatggaggattgtattaatatgatcgtggctctttatagctctgcattactaatattctgttttaaagtctctcctcaatatccaatgtctctgtgtgaatgatggtaaggagtgggtaacagtaacaatcatcctgttgttgacaacagatgataagagaaagcccaactttacactctgtataaccttacaccaatgccccattcctcgtctaattttttttacatgttaacacatgaccttggcattactaaataagaagccctctcacttagaacccgatgcagtatgataaaaattattttgagaacaatcaggagctctagttttcaattctgcttctcttctcaagtagttctgtgccttagtttcttctttgtaaatttaaatggttggaacagaggatctgttaagtgtgattcaagctgaaattgtatgtagcccacactgagtttctctgctatacccctaacccattcaacaatcacaccaccagttttcaggactcacagtaggatagccgtctatcatttgttaataggtgtgctctttcatccaaacaagaaactcatgatttctgcagttttttattctagccaggttctaggtgctggcctggaactataaaacgaacatttcacaaaaagttatgacaatatacaaaggaaagacaatttctttgaatatccataatctcaatatgcagtctggctgtggatggccaagagatagtttccttaactggaaaaagcttttaaatgaggcttggtggaagatatatctttgcatcattacaaagaagaaaaaagagaaatctcacaactgaagaaagtgaaatccactttacttaatgcggacctctgtctctggtgtgcaggtcctctgtgtccaaagataattagcactttataatgctaattattataattaggtctgagaaaaaaatcattagggggtaggcccgttcactgattttcaactgccccctctatttaaaaataaggtcatttttctatgaaatacctttaggagctcaaagcagaaagagggttatagaaaatcctgtgtaggtataagcctgagtttttaatattcttataattctgtgatgtgtctggaaactgaaccgggaggaaaacagtgaacctatttagtccaggagactagaaatcaggactcagaagagtaaacatttctgtaatagttagtcctcaaatagtcattcattgaccttccactgggtgtctggcaatgtgcaagctgcttctagatgctacctcatgtaacaaccatcacagttgcacagagcaagtactagtactccactttcatagataaagaagtaaaatcttagaaattagctgcccaatgtcatgtatgtaggaaaggaaagctggattctgattcatatttgctggctccaaagcacttgttgtaaatacttcactatcctgtgcttacatgtaaatgtaccatttctcttaggggtcttgaaatactgaaccaaagaatggtgtaggggaagggcagtttagaaatacctggaaatttggttgtttgaaggaagcccactctcagatggtaggagatcaagctaacagaatagctgagaatattttctgaggccccagaagtataaaaacggtctaggggggaaaatttgggacacagagtgaaaatagcctgcctctgaagaccagcttcatttcttcccctctgggtgttaatgaaagagcctttaactttgccaggcctcagttactaatttctaaaacaactgctgctactattactacggatcttactgctactatgaccaccaccaccaccacatcagttactgagaactgaactagatgccaagcaaaaatggtaaacacttcatatacattatctttttaaacacaaaatgtactattaatccagttttacatataagaaaactgaggctcaaagaggctaagtaatttgtatgtgaacatgctttacactatgtaaaacaccttattagtagatatcactattattaagaacctatcagccggagaggaagaattggccttttatctttctaagatgcacagttgtctttctgtttaatggttttttaaaaatccccctgtgacaagctccagaggacaaataatttgtttcttgtggtgtatggctctctaaatgaattaattgataggcatcccattgtcagtctcagggatgtggaaataaaacagacatgagatgttttttaccaaactaatttgtgctttaaacacataaataataaatatatatatattaaagtaaatgtgtatttaccgtctctcctgctccactttgaattcaagaacccgtgtctttgttgggtcactgcactgtcaattgagaagtttggttttgtttctttgagtgttagtaagtggcattaaatggtaaatattgccgggggaaagaaaggagaaaaacagctcttccaatccatccctgtttccattcaattaaaggagggtagaaagaatacttaagataattgtaataagtctaatagaatagcaggagccactcttttcctttcagtaggccattagctcagaactattttcagagtaatactaagatgatatttgccttttcactgtgttggcacttgtattgataaggcaaaaacagtggagtcttagcaaaaattaagaccatgaaaacaaactgcactaggaataattctcttcttcattactgtttacttgcagggggaaaaaccattttcgtttaagaaagtccttggtgaagtagtaaaaatattaattttattaaatctcaaccttgagtacaagtcttgtccttgactgtacttacaagttttgtcctccccaaagcatatggcgtcaaggctgggcctaacccagtctcatgaccttgtgaatccagtccacaaacacagagacacgcgtgaagacggctggccagcgcgaccttgtgcatactcggttggggattctaattcctttcaggacccagcagttgtgggtaaagcaggcaagtgggcccccgtagtcaccctggcaggtaggagaactgatgagggccccgggccacagcaatgactagcctgcttcatgataaaatagttcatttctagccccccatacccttccagggctggcccagggccctgccaccaacctcacaggcccccacaggggccaacagtccctcagtgcacatctcgctctcccgcacatgtcctcggtgcttgatgttacactcctggttggagatgacgttcagcaaggccacatttaggactgtgtcattacccgtacctgcagtgaggggaatggggagaaggagacggtcctggaggaagatccagggctgggcctcctggccaccagcagtcctgtgcactatgctcttacctttggtctcaccccagcctgcaatctcacacttggtccctggaggcaccacataccattcaggcggcaggcagatcagggccacacgctggttcagggtcacagatctttaacaagaatgggggcactcagggtctgaggccacaaggctcagccccacctcacatcctcccaggttgtccacatacctctccagcttgagcaggacaagctgggagcctgagggcccacacagcatcttggctactgggacccgctgtaggcctggctctccatgttgtgggttctggaacagggtgcccaaccatacctcatagcccgtgagaggcatatggctgggagagaagctctgctaggtcatttgtgactctcagtccgttgccccaaggctcacttgttagcttgcctggggaaaggggaaagtgggatgagactgggtccccaaacacaagggaggctcaccaggaggagaagcactgccgggcagtcagtatccactgctcctttactagagaccccgcgcagaaatgctggccctgcctagaggagtggggaattaggacagggaacagactcctgggacagatgctagacctgccatcttctggctaggacctctgggggcagggatagattcccagcccccagtggcataaccacagaggacacaacctcagctcctctctgtgggagacaggcagttgtgcctcaccgattccgcaagctgactgtccagggtgagttgcccggatggcccccagccacgcgcagcttggaacgacgctgatccagccgatccaccctcttgccacacttctcaaactgcacctggtctgtaggatggggtgggctggatgaaacccagactgtgtggatgtcgtgggctaaagggcctgacccataactggcccaactcgtaacctgggggggtccaggattgatggcggctggtcatcagctgaaagacaaagttcactggggttaagggagccagcctttggtggtgagggctgaggtaaggtcatggggcaagcgtcactagtgctcaccgcagcgtcgcagggcacagtagtcgaatggggtccttgggtccatcgtgtagcaccagggcccatggctatccccatctgggtctggcagaagttctcctccagttgtgcatgcggttcggaggtaaatgtgaaccgaggcgggagcgggagcaaaatcgtggcagggtagtctcaaccatttccaggctctggtcccagacatcaaagcatgccgccccagggttagggccctggcggggccgggagcaccagggactcactgcagcttgtgcggcgtctcagcggaccagcgctggcactggacacccttgcgggtcttgctgaccgtgccgcggtactgctcccccgcgccgtggtagcagtctgcggccggtgcgggcagccatcaggccgagacctcgccccggccctccggttccaggcttccagccccggctctgtagcccccaagcttgggcctcaccctggggccgcacgtcgtctgtacaacgccggatctggtagcaaaagcccacgcgcgtgccgggccgcagggtgaagcaccagggcgcctctgagccgtcgaggttccagcagaagttctcccgaaggtctctaagcaggcgctccactcagccctagcccgccagcctccagccctaagcccgtgactaccctcctcccgtctcacccgcagcagcacgtcccaacgcccgcccccccgcccacctcacttgcacgcgtatttttctggcgtaaatcggtgctgatgtgggatttgcgcgtcccaacgctggcaaggtacgccgcggtggtggtattggctgtgccccggtagccctcacccttcccgcggaagcagctgacacttgtggcctcttggcggggctgtgcctcggacccttagatggaccgagataggtcgggccccgagcgacagctgagatccctctggggctgggaccaaacccgcctttcccaggtgtacggtactccacgggatatgctctcaggtcacgcccagcccctctgacctccccggccaagccacgcccctccccaaggttcccaggtaccctcccaggcctggtccccgccgcctaccgcagcgggggaggtcacagaactctcgctcgatctgcggatccgtagtgtagcaccatggccgctcggagccgtcaggattccggcaatagttgtcgtccagaccttggtcgaggaacctgggggcggtaatggggcgtgaagaagaccctggtactctggcttatctggccccgcccagttgccctacacggagccctgcccctggagtcctggaccttccctagcccggcccccagggcgccgataccgcctacgcgtacttgcccggctcgaaggggtgctggtgcgggtgctgaagatcccagcgctggcactcgcgccctgactcggtgcggtctaccgcgccgcggtattcctcgccattgcaccagacacacgcggctggagacaaagagccagtgggttcgtggatgggcgtgggcttgcccctccactctcccagcttgacccggcgccgcttacccacccggcaggatttgatgctgcagctctggaagcgcacggcagggtctgttgtgtggcaccaaggacctccggggtcgccatcagggttacggcagaagttctcttccaggccattccggagcgtgggcatgtacctgagggcccagagcatcactatagtgtgtgctgggggaaggtcccaggccgggacggagggaaggtgtttgtctcacttgtgatcgttcgggaacttgtggctccaagcctggcaggacaggccacccacggtcgtggccatggtgccccggtacccaaccccattgttcatgatgcaggtccgtatgtagtctgggagcaagagacagaagatcaacttgggctgaggtcccctgtctcccaccctgcccctctccacccccactcgcctttctcctggaagaggtcacagcgcccagaatgccacagccttgagtggggcgagtgttgagtccatggcagcagttggcaaccatggctgctcacattgtagtggaacgccctggagagaagaaggcacagggtaacgccacggcccaggctcccctgcccccagtcttatctaggcccagtggccactcaccagcagtccattaagggcccacagcgaccagcacactcttcagcatctgccacatcctcctgccaaggcccgggcaccaccgcatgtagcaggtgctgtagctctgtgccccggagcacctggaagtcattcgatggcgagcgctgccctgcagagtgggcatgagtgggtgcaggtcaggtgggcatacatgtcagtaatgtgtattggcatgtccacactttgttcattcaggggatcaaagctacaaggcttctgggatggaccctgtatgcactttcaagggccagtctagcccccctgcacagatacttgtcaaaaaaatttcccctgggaagcaggcccagacttggtagttatcaccggtgcctctgtgtagtggcccaggcactgggctcagatctaacacatacgctctgtgagagcagtgggtgatggagcttgccccatctcatctctcaaatgagaatgctaaggctcagagccatcacattacccagccaggggccctggctaggcattcagactccaaatctgggctctcacctgcacaaaggcatacgctaggttagaggggtagatcaggctcaggaggggtcatttcctgctgtgtgcgtgcatctgtgtggtcctaacactgcttcagtgctagagcagacgtgctaatagaggcctaagtgggccgtgtctgtgtgttcctagggcttcccagctgtgctcaagaggccaaggtcactgccccatgcccactgagcctctggctccccgacttttttctcatcccagaataggagaatagggccaaccccctcctgaaggcagatggggatcagggttgggggcactcaccagggacccctaagtattgagtcagaagcagcaggagtgggagccactcctccaggatgacttcatcttaactaattatatgactatgttgactgcaacatatgtatgaagtttcatatactcaattcctttactgcttccttgagcctatgaaccccctcctgcatctcctagtcttcactgaacattatgtcaattctcagcctcagctctaaatgctcatggtttccaaaaacatatttacaacccaccataggtcctgagcaccaaagcctgatgtccagttgcccagtggacagacatctccactgggacatctcataagcactaaaaatctcaatgtactgaaacctgaatttatatttctctccccaaatgtgctccatttccatcttccctttctcaacatccatccagtggaaatgttgctcaaacccaagtccagagccacccttggcacgctcatcttcctgagccccccacttccatcggccacccaggtgcttgtcagtttgcccactttctccctctccacagcccttttcctagttcagaccttctgtctcccttgttgggatcatgtcaacctcttcctcactcgcctctggctctgggcttgtgccttcaaccgactcttcaaaccgtagcaagagggatgcctcgaatcacagatcagatccctctctccttaaagccctgcagcagcttcctgtggctctcaggatagaattcaaacacttccaggatctgggcatctcctgcccctccacagccctgcctcgccctgcattccagccccaccaaaccacagtcagtcccttccatggttttggatctcttgtctgggaactttgcacctgctgttctctctgcttaaactctcgctttcacccatgcgacctggttcactcctcattctcctgcatgtctcagcttggaagtcacctcttccagaaagccttccctgaccctcaggtccaggttagatcccccacctggattcccacagcaccgtgtttttcccctaccacaaccctagtcatgccctttagcgaacagccaacagttactaagcacctgctgtgttaggctgtttcttaggactttataagaaagatcacatttaatcctacgaagtaggtactgctattatcctattttttagatgaacaaactgaggcaagagcagtcacacacacatagagtcagtaagtggtaaagttgggatagaaaccaagacaatctgactcatggatgttacaccgtgtgttagaactagccttgaaaaaaagacacaagcttgtgccctgtgccaagaaagtttctgataatggtggcggtggtggtggtggtgggatttaatcagttggcagaagtctgtatttctaacaatctctgattcaaatgggcaggacccatgtccatttctctttattgcaattgtactatgtttcttaccttcactctgcaacaagcttggtgaagacagagaacatgtatctgaggcccttcatctcccctcagttcctagaccagcactagcccatagtcaaccctccatcaaagtagagggagaaagtaagtggcttttaccctgtgctttctgaactcctgggatgctaggaagagccagaaaaccttgtccaccgaacccacaaattcactctcttcatcccttcctcactccacttccttcccagtagttgttggagtttttgaattttccctctgtgagcccttgccctcccctgccatgttctcagcaaaggccctggcctccaggtccatgagaacaggattccctgtagtaagagctcttccctagcctcctccacttccaaaggggctggaatcttcaccccttgatcccttccctttttagagcacagaggaagcggagccctcctcctgccctgggctcccatgccccacatgttcctggagagcacccttgggccactgttgtaactacatggtgacttgcttgctctcatccttcatgaccccccctcctcccatgccccactttgttaatttcactctcctctcaaaactccccacagtgccagtgatggggtataaatgcagctgggcaacgaggctcccacagacagacccaaacctatcttccaagtgttaatttcttttctctcctcttcttcaaataggtctcttccttacacatttctgccattcctttctctctctgccttgcctctcccttttctcccggccacagccttatccaacctcccagcccagcttggactcagctttcctaggaggctcccagacaatccagtgggctctcatttttttgagtgtattcagcagttggctgatgctgcatctccagcacttgccctaggttgttttatctccctaatggcctgtaaaccccttgagggcaggatctggcctttgtactctaaaaaggtcttcctactagagaatgctccacacatgtgtgatgcttcggggagtcccaaccttcatcagagattcccactggtgccagctcatagctcatcatgacgtgtcccagatggtgactgggagtagcctatgccaagcaggagtttttccccgaagtcttcctgtttattgcaccgggctggctgcaagacattgaggatgctgccccaggggccagcagggtgactggggcaggcgccatgatggctgtgcctgggtgctggccagtgtggccccaagaagaggccgggagccagagctgcatgccctctgtcagcaccagcctcctaaaaacactctcgactttctccaagcatggattgcctgagctcccctcctgctccccaaagaggccggggaacaagtcagacaggggataagtcagacaggctcagctgtgggaggctggaggaaaaagaccaataaaactgactttatttgtaatgttcccatgtttgtgattttgttatttctactctgtttcctcagagcaatgaaacaaggaaacggaacaaaaaataacaaaacccagctctaagtatacgtgaactgtaaggcctccctctggcctcctctcttcctccttcctcaccaggtttgcctggctgacccttccagccagtgaattcctttcccaggttgagtgttttccattttaatttttgtggcatttccctggattaatggttaacgcattcattttctcccctccagcctccattatcaaagagtgctttgaataaccattaactctctggttaagcgaaagaaacacgttaatcatctacaagtcctggggcaggaaaattattcttggtaaccttctcccaatggcaagaaaaccactgtccctgagcagctcaacttcagccacacctgggtctacaagcttgcaaaacccctccggtaaccttgttacaaggacttggtaaactgaggtcataaactgctgaatggctaagcgctgtgcttttcaacccagccaccaccggttctctaggaccctataaagagacaaggctgggctgctgcttctccctttacttttaaaaattgttttgccagtaaagtctcatctattgtacattccttgttacggggaaactcaagtggctgtacaggctgttcttggagccacagttaaaagcgctttgactcaaacacacatgtggcgtcatcctgagctccgtttgcgtggggccggaacaccggactaggaaacctctccctgctttagcaactgagtgtggctagattgagggaccacagggggtggctctggatgcagcaatccaagtccccttttcagggagggtgacctctttccgaagttcagtggatggcccccttccagggttagggagacaggaggaggaggaagaagaaaaggaggaggaaagctctcaacagccccccacccccaacccatccaggagagaaggactgcagtccccgagaccagctggaggagtggcgtgtgcatggtgtgccctcagggtagagcgcgccatcttggagagatgcctctttcattcacaaagcggatctgttgcagagcccagagccccggggagagcagggcggcgtccaagtgcttgctgggtttggcttgcactccctctcccttaaagaagacagaggcggaagggagaggctgttcttcggaggcgagcctcaggcactgctagacttagtaggaaagatattgctggggtcttggcaagccgtaggtgcagcgctccccatcgtcattccggtgcggctggttactgtcaccctgcctcctccccgccggcctgagagcctctctgttccagatccaaacatttccacattaggcagcctgcatgtgcatttccctggcagtggagggaaaggcacccctgtgacctgggatgaccgacgacggggacttgccctcctcccccacaggtgcacttgctcttttctgggccagccttgtgatctggtgtccgggcacttggcagcatttagcaaatgttcctcagtgctctgtttggtagttaatgctgttgacacggacacctttgggagcacgtgggagaagctgctgcctccgtttcccccgggttacagcgcctggcgcagtctgttgtcccctcagaagtggtgggcgacattatctcctttttcatccctagccctctcccttgaagctgtcctgatctctcttttggacccaggaacgtgagcagaggttactactcactatatatacacactgcatctagactcatgcatgccttcttggtgtcaaggacacctcacatttcaaagacttcatgaaaaagaacgtgaggtatctcacacggtgacatgataaagctttggacaacgtgggttaagctaaaaacaggtcattacaattaattgtatctctgtcttttgacccttcagtggctcctgaaatccatcacacatgtggcttgcaagtattttggtcggacaacgctgccgtagattgtcccactctgaaatggttccctctgggcttacgggactgctatagaagggtcctaaggtcctgtgcctccctgcttttcaagtggctgcaaacttctgtgcctaccgcttcctccactggatgtttccttcctgccctcctccctgaggacctcctagtccctcttcaggatgcagagctggagcctccactccaggaaagccactcatgttgttgccaacacaaccccctgcacacatgcagtattaggcattggtctgcctggctgtccctgggctgtgctgtccttgagggcagtttttgtgtctaattcccagagagtgcaagaacacaagcatgctcatccagacgttagtaagctgccctaaggggtggagcagtcagattccggttttatttatttttcccctgcaaggagcaatcaattattaaccgaagtcacgatactttggttgctgttatcagcacatgaaaatatcagtcaaggctgggtttcagacccgcctggcactattcaaaggaaattttttagtaattcttattttattaagagcactagtatattcagatcaagtaaaacttcacatataacaggttcactcttctatatgaaatgtttgtgggaaatctatcatgcatcaggtgctctcaaaaggtggtgaggtgtaaatgtcagcctcaaaggctgcagtgtccaacatggcacacagcttgtgtggctcttagcacctgaagcatgcctcgtccacagtgagatgtgccgaaaatgtaatatacatccagattttgaagacttggtaaaatatctcaccagcaattttttatattgattacatgaggaagtgataatgttttgggttggttaagttaaacgtattattaaaattcatctcacctgtttctttttaaaagtggcttctagagaattttaaataacatgtagttcacattatatttctatgagacagtgctgctctaaggcgattatgctttgtttgttttgagacactcacaggtgtatgtgagcatttcaaccgggtttataacagcttaggaaactgggaactttgacttggaactttcccgccaagtgacaaaacatccgtccagtgatagaagttttaattctacttcctccagctagatcttgcctggaggacccacgttgacttactctctccagaaacggccccactggctctctgggggaactcctgggttctgcagggacttgctaggtagtaattacaggtgtgtagagaccctcctgcttcatacgctcagtcatcattatttacttttaccaggcaccaggggcgtgatgagagcttagctgaaaggagagaagactcagcaagcacatcaccttgaagctgacctgtcagccagatttcgcagcacctgcctgttccagcctgaggggctgcgattcattccttgggaaagagagctgcaaattccctctctaggccacagtccaaatccttgctcttctctctcaggttctggaagacagaatggaggcatctacagagcaaggacatgttttctacctgaattagcttttctgacaccttgaaaccatctctaagaaattgattttttaacatacacatatacaggtaaacatttaaatctgtgccataatgtatttgcacttcgagtccccctgaagtcctaagtcacatgcttctcttcctaggggttctgtctgaagcagagacccctggattggagcagtgggaagaatcctgatgaatcaggtgttcctgcctgtttacattaactgggcaccctgcctgcccaccccacatgctgaatactgctggggagaagagaagaaacatttattaaaggcaaggaaaaattagagccttttcattgaggtcagaagatttttgaggttggatcggctggccaggtgcatgaccaattttcttggctccttagaagcagcaaagtatttgaaaaataatggagcccttcgtcctacaagtaaaagcccatttatattgggaattttttaaaaagtgctggcgatggaaaatttccgatgagatgcatttcttcctgcctgaatgtcttgaatgcctgctggatttgtctccctgctaagacactcacacttgcaaatctgtgcttttcaaggtggggagatgaaaataaaaagtctgtgacatgtatttctgggaggcctgaaaacaggaagcaaattggaaccacagcatgtggggcacggatgctggattctgggggatatttgcttatttggaaaggctgcaaacattccatcctacccactgctaggagctctgcactttgctaacgtcccatggaaaccaaggttctctttaggactcgacaggactgggttatttttctcagcttaaattgtttttatatggttatcctcagtactcttttctgttttgggatattttcatactttttattttttaaaaaccccagaatatcttgattttgaaaaggtacattcacccaaataaagtgcccagcgcatagacaaggctgcctcaatatttcacgtgtcaacagccaatgcccccggtacgtgcagaaaagcctgagaacaaggaaggaagaaaagggtctggtccttgctctgcgggtatttaagcatttctcagccccctcctctgacttctcaactatgttcacctatatggcctcaaatggagagaactggggttataaaagaggatattagctatgcctgctatagaatgaggaaggcatttcaggatgtgcttggggaggagatggaatgaatggcaaaggggatgtttgtccgtgagggtggtctgtgatctgtgggtgggggatgtctgtgcagctcccttcatggcctctcatggcccacacagtaggcagtgtttgccacacacagaccctggacaaagtcacagagtggtgttggtaccatttcataggaggggtcctaggggacattctaggaagttcttcatcagcttaggaaggtgcagcctctgcagtcattaaacacagtctaccagccagagaagcccaaaagctgctgctcctgctgttctgcgtggtgtgggaaactacggcattggcacaactttgggagctctctttgatctcttgtttgtctgcatttcccatactcttccagtcaccaagtgtcatcattcttccccaggttgtctctgtctcccttccttttctgtccccatgactcttacctgtatccaaaactatggcgtttaaggtgaaagagccagtctgtaggagctgcttcgaggaaagtcttgcaagactgccttcttgaacttggtgctcaaactcccctctggcttcacaacctgcatagttgcctgggtcagaaacaggttcctcaggcaacttggtgttgcattaaccaagtgacactgattgtcacttggaagacactcagtgactgactattagagatcatctgcctctcattttggggatgtgaaggttgagactcagagaggtcaggcaacatgtctgaggtcattgagccaactagcagcagccccagagttgtcacccagatttcccgactccccattcattccagaaaacctacccatggggaatgttctgccaggctgttctacatcaccagtagagagaagttgccttgagtattcggtttggttttgaagttaacctattcagacacacttgagcatgcagtgagtcactgactggattcattcccagacctatggactcagcacatcagctcaccaagcctcctgcatactctgcttctacgctggacaactgtgcattttgagaagctggaggaaattgtttggcatactgttctaggccagcagtcatgcgatactgagctaggcctggctcctataggctggtgaaagccaagtgttaactgttcaggatttttttgagttggttaactattgatagcttcaaagtcgccatggcaggggtatttataccatagaaattggtacatgttacaaattagggtttcatttttcaccatccagagatctgatttactaactcactactgattctgaggtaggaccccagcttaggaaggcactttcaggcaagactgttctgcggtaattagaaaatggagagtggccctgtcagatgcaaaggagaatatcaaatttggaaaaaagtactgcctattgcacaagaggtaagagtcactgagacatcttgcaccagacccaagtgagggatggaaggggccctgatggtcatcttgggacagcttcttagggtcacccaggagcccaggagccaggtatgccactccgtggtgggacagaaacccctgtaaagagcaagcagacactcagtcacccaggaccctccccaacactcccattccctgcaatctatcagcgcatcctatcaatcccgtctggagtagatatctgatcatgccttctctcccttgtgactgccatcacccaagtccaggttcctgctacatccttcctaaaaggccttcccctgcaagcttgcctacctcacatcgactttccccacatagctgcaaaagtggacgtctgagaagaagggggaggaagaggagaagaaggaagagatgaagaaggcgaagatgaagaaaaagaagaagaggaggaagaagaagaaggaggaagagggggaaaagaggaggagatgatgttatgtcatcccttcacccttcccctgcacacacacacacacacacacacacacacacacacacacagacacacacacacacacacacacaccacgaaaacccttcaagagcttcccattgtacttagaataaaatccacgcttgagtaaagctctgcatgatttggcccctgcaaacctctccagcctcctcttgcttgggagcctctgtgctcacaactctcctgtcaccctggtcttcttccaggtccttgaatgccggctaagctctttgctgccccaggaccttcgcacctggtcttctactggcaggaatactgtttcctgagtcttcccctgactggctccttcatttcctttaggtctcagcttgagtgtaacctcacagggccatttcctgctcacctggtgaaaagtcaggcctcgtctgttctctgttttagctcctaagtttctttatgacaattatttcagcccacagttcttttatttacttgtctgcttacattttgttttaatcttttctttacttccccccacttcaacagatgctccatggagaaatgggttaaccactgcattgccagagcctggcatataggggtgctcaaataaagacttgatgagtgggctgggtgtggtggctcacacctgtaatctcagcactttgggaggcaaaggcgggcagatcacctgaggtcaggagttcgagaccagcctggacaacatggtgaaaccctgtctctactaaaaatacaaaagttagctgggtgtggtggtgagtgcctgtaatcccagctactctgggaggctgaggcaggagaatcgcttgaacctgggagacagggattgcagtgagctgagaccgcaccactgcactccagcctgggagacagagcgagactccatctcaaaaaaaaaaaaagttgatgagtggttcattctactgccaccacctatgggaagacaggtcaggaatgttgaaatgaaagaagtgcttggcttcctctgagccccagctggacacaggcatctgtgatgcatccagattcaggctgctcatggactctgaggactcaacgctcccggagggctagcagggagctttgcacacatacaaccagttctcaccaagcaactggggattaatagtgcaaggggttaaatgggttcaaactgttcctcttaagctccccaagatggtgaaccgcacttcaaagctgcttgaaaattcttacttggtgagcatgctgttctgtgtcccttttgggcagaggattgggaaggcagccaccaaggccgcctgccgagtgaacagggggagggggcactccaggtgacgtgtgtgcagagacccgctcatgcctgacccacagttagtgcacgctcacagtggttccagtcttgtcccagcgacccgactggcctgctttgttattggaactagagctgatgattcactttaaatagatccttaacctcacaatttgtttttcttgaaacggtcctgagaggtgctttccaagaaacaaggaaaaaactgactgcacagtggtgactttgagtctgtctgcagaaagcagtgtgagtggatggttcattcccatggcaaagcctttccctgtcacccggtgtcagggacagtgaaaaaaacgggccgtagcttgggaaacaggggtgctctgcagttgccgtagcaggtcttcagggagagcttacgggaacccacggtgtaggggcgggggagggggactgggtgtgttcatttcccggggatgctgtaacaaattaccacaaactgggggccttaaaacaacagaaatgtattgtctcacatttctggaggctggaagtctgaaatcaatgtgtcgcaggaccacacttcttccttgccgctttctggcttctggcgcttgccagcagtccttggcagttctcggccggcggttgcatctctccagtctctgcctttgctgtcgtgtggccatcttccctctgtctctgtctctgtctccgtattcaaatctttttctctttgtgagaacaccagtcattggatttagggcttgccctaatccagtaggatcttattttaacttgattacatctgcaattatatcctattttctaatagggtcatattcacaggcatcagagttaggacatcagcatatcttttggggctggggactcaattcaacccaccacaggagaggtccccttgctactaggcgggtagtcatatcacacgcacatgtcgtaaacatgctgagcagacgagaacccaaaatctctgatttgggtaagatgtgattccaaaatgtagagtgcagaatttactaaaacgttttgaggcttagagtaagagactgctgcagtttaggaagacttcctcattaaaagattccaaaagacatattccatgagtcaccagggtagactgaataatgagcgctcaaagatgtccgtgctgtaatcccgggagcctgtgactatgttaccttgcatgacaaaagggactttacagatgtgtttaaattcaggatttgagatgagatgatcctggattctctgaatggatcttctaagaatcacaagggtccttacaggagggaggcaggagggtcagagttagagaaggagacgtgatggctgaagcagagatcagagcgcgaggggttggaggatggagggaggatctagaagaggaaagcaggcagcttctagaaactggaacaggcaaggaaatagattttcccttcagagcctctggaaggagctgaccctgctggacgcttcaatcctagcccggtgagactgatttttttcttcatgacaagtcagttgatgttgttttaagctcctaaatttgataattggttacagcagcaataggaagcattgcagtcacatagcccagtttggcatcttgtattattttaacaaactctccatcaatccacctgtgtatcattttagtctgctaacaccaagaacaatatgttgcatgtggaagaccttaataactacttgttggatgcatactctgagagcttattatacactcggtagtatgctaaaccctttggatacatccctgtcctcctatctatcagtgtggaggagaattggacattgaacaaataattttacaaataaaacagacattgatttatgtgacaagtgctgtcacagaaaaaccacagggagacatgacagggtagagtcggggaaacctaacttcaacgtggggtcaggcagagccttccaggacactcccagctgaagccaggactggacataccctcgcttggttccagttttaaagacaagacactttgcccaaggaggtgacccgagttgagcactcggagcgtccaccatcttttctgaatggtgcgaggttgtctgttgttcatggagctcgtgtggggtaggccaatccctggtctgaacttgaggcggtgacacattttcatcttggttctgccgtaggtttagcgggtgacctttgacatatcgtctgcccttcctgcatgtcgtttgtgctctggctgacaaacaacgatctcaccagccatcagcgctccacaggaatgaaaagagtgagtgaccaggacagggagggaggaaagaagaagttgccttgttgccacggccttcctcagatgtgcctccgtgccttgggtcacccctggggctactggcaccttctgagacagagccggggctgagggctagattgtcgttcactgggcacctctgcaccggggaaggggacgggagctgaggagggggcactgagcaaggcagaatccttatccccaagcagttgctgacaggtggagagacaaatgcaaacactcagaatgcaaacacacagtgtccaaagcagaagcagcaggaggggcgtgggctctgccccaggaattcaggtgcacagaaggagctgggcctgcagggatactttggggtttggtaaatgaaggcggggtcgtgcactctgcggtggacaacaagagagaagcctccccacacatcagggttacacgtggcttggggtatggcttgccaccttctcccgtttctccccacatgagcaagggcggtgtccattatctctcaagcaattcctacctccctggcactggtagatgctggacacatggtacctcctccagcctcacaacaacactgtcacatcgtcacctccatttctcagatgaaactcaaagaggtgacacttgtccagtgtcaggtggctgtgaagatcccagcacagtctccttgcatccaaggccctagctcttaccacattgttgatcctgggttgatggtgaaggtgtaagctggggttcctccccagcccctacctgtcgtgtgcacacctggccttctctgggggtgcatttcccagctgaggagactgtctgcgtgtgtggctccgaaggaagcctagctggtgagttcagaacaggccctgtgtgtgatgtggtgacctgaggtcataggatacagactgcgtcccaggagcacctgccattttaggggtggctcaggaaagcctctgagctccctggaggaagttgtcccctctccactgctgcaaaggagagttggtcatggggccaggcagacactctctggacatgctcgtggaagagctctttgggagaaaagacactcgagcatgccaacaaggggacttaggggccagaatgttctgccacttgccactcgccaacctgaaatctgcacctcctaatcacctcctctcagccctgcctcatcaagtggggtcttgcaggaactgctggcagctcggccaccatcggggaaaacaccccagtcaaacacaggctctcctgtgccttggcatagagggaagagccagccctgcccccgcccctgcccactatggtctcaggattcactccttgctgaagcctttacaggggagccaaatgccctctcacccaaggcccttccaaggccctcccacatcctttgggtgaatctgtttcaggagcacccatttgagggaaaacttcgtccccaggagaaatggcaacggagaggtgaaggggtggaggtacgctttggagcagggccaaggcacatgggggtgggctccagcctcgagcctgtccttctccatgatcctgaacatgactcttctggaacctggccggaagttgcccctcaggagacagcgggggaaggaagttgtggtccagaaactccagaatgcagggtgcccttcccattcaatcacggaggctggtccaggccaagagcatcctcggcctttgtttaagctcccgtgagttcttggttgacctggagaggctgagagaggcccacaggacctctttccttctgacccttcattgcctttggatccagctcacctcagtgcaagcctgtggcctgcaggggaggccctgaggtagaggcactcagccctgataccgtgagggacccttgaaagtttgtgctcttgtttatggtctcaaagacaagaggccaaattcctcagctgacatttttactgtcaggacgtgccaatgttgttcactttttgttttgctttgcttatgattgtctggcaccttgagatgatgctgagtatgccaggctataggatggagatgtgggtgggagcaggcaacagactggccctgatcttccagagctgatcacattctctgacgtcagctctctctgttcatgtcctttgaagggcaatggactccgtgaggggagacccgaagtctgtgaatgcccagcttctgagataccgtcaatactgttgactgcatgaatggatgaattgcaagtgagttgttgaacacagtggcaaggaggctccttactagcttggaaccccctcctccggcagggaaagtgattaccaacctggaggtcagccaggccaagagggctttgagatctacaacaccatctccatctactgggtttgggttacgtgttttaagtggctcaaccttcctctgaaatcatagcaatagcaatgaatgatgtcccatcaggcactgccctggtttttttgcacacactatctttcatccctataaggacgatgtgggatggccattgtcatgttcctttcacagaggtgaaaattaacactcagagagagtaggcatcttgctcaaggctagaatggggtaaagccattcatttaatttatttattcaacaaatattcattgccaacctgctataggccaagcccctggcactattccaggtatcgggaaaatagcagtgagcaaaatggacgagaattcctgctctccgggagcttcacttctaatgggggaagcagagcaacacacaagataaaatacacagcatgccagaggttgttaagtgccaaggaggaaaagtggagaaggtggaggggaagggaagggctggtgggcagagggatatgcctactgctgaggaagctcccaccatgaaggtgacatttgcaaacaaacctgaaggaggtggaagactggccaagcagagacctccgggaagaggggctaggcccagacccaagcatgagggtggccagagtgttctgggaacacgaagaccagcgctgctgcaggtgggaggggatgtggggaagataagatgagacagagtaagggtgtgttggggggtgacagattatggagggccccagaggccatcctgaggatacgggagccattctctgagcagagaagtgacataatccaatttcagtttctgcagggtccttctgggctctaggctgagagtggactgagggatgagggtggagtcaggggcatggattaggaggctatggctagtccaggcaagggggatggcagtctaaatcagggcagcagcagagtcaggttttggaaatgttttgaaaatagagccagtaggatttgccaacattggcaaagattggatgtgaggtgccagaccaagtgttgtcctcagcaactgggaaaaaagagttaacgttctgcattaggctgttccagcattgccataaagaaataccagagactgggaagtctataaagaacagaggtttaattggctcacggttctgcaggctgtacaggaagcatggtgctggcatctgctttccttctggggaggcctcaggaagcttccaatcatggtggaaggcagagggagagtgggcatgtcacatggccagagcaggagcaagacagcaaggggggaggtgccacacacttttaaacaaccagatctcatgagaactctctctctatctgcaggatggcaccaagagagatggtgctaaaccattcatgagaaatctgcccccatgatacaatcgcctcccaccaggccccacctccaacattggggattacagtgaacatgaggtctgagtggggacacagatacaaaccatatcatgttccctgagataggatggctgggggttgggggtgaacagtatttgggagggaaaatcagggactctgttttggacacaatccattggagttgcaggtagacgttccagtggagaagacaagtggctggctggctctctgagcctggagttgagggggtgatgtgggctggagattggactttggcatcatcagtgttggtgaggcagctacaatcatgactctggatgagctcattgatgggggcagcaagtgtggacagagaagcaggaggtctgaagactgaggtctgaggtgtttggggagaagaggaggaacctgcaaaggagatagggagcaagcaaggaggcaggaggagagccgggcaggtgggctgcagccaagcaaggagagggggaggaggaaggggggaaggggaaaggcggggagtgggaagagggtaggagggggaggaggagagggggaagaggagagcagggggagtaggggtaggaggagaaggggaggaaggggaggaggagggggggaagggggtgagggagaggaaggggaggaaaggaggggtaaggggggaggaggagaggggaagaggggagaaggagtgaaatatacctgtcgtgggatttgacctatattagagaatcactgtgcagtgcaccaagtggcactggagaagtcatccccgaaataaattggattgtgtgacaagagatgggttcagcagatgcaacagacagggaggagggaaactggaccagccttggctgtggattggctgcgcgatcttggacaaatcacccatcatgttttccttccgtgttacgtggaaatgtctctgatatctactgcccttacctcacagagtaaagacccaaaggagatgtcatgaaagcattttgaaatgctgctgaacactcagcacagtggctggcacagagtgggtagaactcaatggttggaaaatgtacttggctgttattgtgcctttttcatgaaaatatgaaaagctaaataaacctgaaacatgttggggactgagtgaggggagatgagcacgttctgagagtcctaggaccatgcactctcagagtgcctttgctattgtttcgcctcccgtcctacagaggaagggcttaggtttgctgtgaatttcccccttgcctaccagcattgcgccaattaaggtttctacttcaccgcacgtttcagccaaggatgtcaagggaatccactgctgctccagtgagacaaataacatatccagcatcaacactgccatcatcattagcatcattgtggccattaggatggttggcaaggcaataggttggcactactgatgggcagcaccattagtcttcttagtgatttttcaaaatggacagtctggagctaaaagcgtgagccctggaggagctcatttcatcagacctgctgcaggcaaacactcttctcttcatacctttcccgcctgtacgtgtggggtgatgcctgtcttgggaggaaatatagatgcagtgcctagatattccaaagcccaggttcggaatctgtgttccctttgttttttgatatttcccctcctttcctcctgccctttagatcttgtgcatttgtgggtttttccctttctgctcagctctgatcacttatttgcttttgtttttggagagctgcgtcctctctttactcacccacctgcttcattagagattgctactcacctgcagtatccatgctcaccttcttccacgataattgaaagagtgtccggcacacggctgtctacttaaaaactgctttctctagtatcccttgcagcctggtgtggtcatgggactgatttctgcaagaagagtttgagcttcagtgtggtgtgacctctggacctttgaaaagaggggtttattccttccattctcccacctttctcttccttcctccttgttggagtgtggctatcatggtgatggtgaaccatcttggaccacatggatgagggccacacactcaggatgctggagcaacaaggtggaaggtacctgggtctcgactgcccacccttgtgaaaggtaaatgcagttccatcttatctgaaccctagtattttgaggttctgttagaattgctgcacctgtattctaactaataccttctttaggctctttgacccacttgccagattgcaggttgcaggaagacagaacatggttttgctcaccattaggtcatcagggctggcacagattgctcaacacataataaatacttgttggaagtgttaatgagttatggttttactctggtatctggacttctgctttccaaaggatgagtggcccttgacgcattgttcccttgggcaactgcagcctctgtcatgggccaagtatggaatgtccctgggaaataaaatctcagaggaagagagctcctgcccagccgaaattctccctggaattgtgagcctccaattaggctagaagatacagtcttcccatctgttgtagaaacagaaagttatttagagtataaaacaatctcccggcttcatgtgtgaagcctatttgagagtcagagggttccagcagagggaggaggaacatcagctacacctggagctctggggatgaaagaacccatgagggcctcatagattatagggctctgactcctccagggaaagatgatccagtgttctggcctatcttggcctgtggttctttgtgatccatggagtgagagtgtccacaatcgcctgctgtgtggtatttccctgacttgagcctttgctcataaccagcatagcccacaaacaccagccgtatccctcaattcctgacttctgctttcctgtctttacagaagaaccccagctgtgctaatggtcctgtaacctctcagctcagggccatgagaccttctctctgcatgaatctcgcctcctctgcaccccacacttccacaccacttcctcatataacgtgttatctgactacacaaccctggaaatgatgttcctcctgatgtgttcccaagcattcttgctattctgcttcctctagaagccagggaactttagctgaccaggtctgtgtcttgggcacctgccttggtgagcgacctctgagaatttctcactaaacatttgttgaatgaactaggagatatataagggaatgcctcttctgcctaccatgagcatggccttaagtgttatctttgttgcttggccaagtcatggccttgagtcccaagtgaggtgcccagcccttattcctgatcaataaatacttttagactcctgattattctcttgcttgcttgcttgcttgctaatctctaatagattagatctattccctaatctaattctctgatcttcctcctgaaacttggctccatattgagttccttgccctatatccgtacttgcacggccgctatttgccacccagagtccctgtgctggcaaattcaacacccggagcattatcattttggtgcaattcctgagcacagcttgctgactcttcagtacttattgtttctatctggaatacaagagggagtatattatgaggatgatggtaaacccagatcatggtgctcagagcagatctgaaactctggcagcgtaacacctctctccagcatggacagataagggtgattattatttaattggacttttcattttgagagaaattgtaggttcacatgcaaatgtaagaaatgatgtggagacctatgtaccttttatacagtttctcccaaaggtaataccttcaaaactattgtatgatttcacaaacaggacactgacattgatagagtccagattcagaacatgtccgtcatcaccaaggtccctcatgttgcccttttgtggccgcacctgcgtcctcttactctccccatctctgccccatctttaactcctgacaactactaaactgttctttgtataactactaaactgttctttgtataactactaaactgttctttgtataactaaagttataattttgtcatgtcaagaatttcatatgaatggaattacacagcatgcaaccttgacttttcttactcagcacaaccgtctggaggttcacccaggttgtggcatgtgtcaatagttttctcttttgttgctgagtagtattccataatagagatgtactgcagtttgtttaaccactcaccttccacctgaagggcagctggttttttccactttggggggattacaaacaaagctgctgcagacattcacatgtgggtttttgtgggaacctaagttttttgtgtttttttttttttttttcctgggatgaatgctcaggagtgcatgccaggttgcacagaccttgcatgtttagttttataagaaactgtcagactgttttctagagtgattgcaccattttacattctcaccaacaatgtatgagggatccagtttctccacatccttgccagcatttgtggttgtcactcttttagccattcaatagtcatgtaatgatatctcattgtggttgtaatttgtattttcctaatggctaatgattttaaattacctcttcatatgcttatttgccacctgtatattttcctcttcagttaaatatctcttcatgtcttttctcatttcttcaaatttaaaaattcttatttatttattttttattttttttactgtggagttttgagagttctttctatattctacatactagtcctttgtcagataggcagtttgcaagtattttctcccagtctgtagcttgacttttcatcctcttaacagggtctttcatagagcaaatgtttaactttgatgaagtctaatttaaccatttttcctcttatggctcatgcttttggcatcaagtctaagaattccttgcctggccctagctttcaaatattttctctttttttctctataagttttatcgttttatgttttacatgtaaatccatgatcaatttggagttaatttctgcatgaagcgtgagactagattgaggtttatttatttattttttgcttatgaatatcgattgcttccataccatttgttgaaaagggtatctttcctccattgaattgcctttgtacccttatctaaagtcagttggaaattttgcgtgggcctatttctattaacttccactggtctgtgtatctatcccttcactaatagcatgtagccttgatcactgtagctatacagtaaatcttgacattaggtagactaatctatcccatttcatttttctttttcaaaattgttttagctattctagtttctctgccattttatatacatttaggataatcttgtctagatctatgcaataatattgctgggattttgtttgcagttatattgacccatatatcaagatggggagaattgacatctttactgttgagtcttctgattcatgaatttgtaatgcttcttcatgtattttagctcttatttggtttcttttgtaggaattttaagcacacaagtactgcacatattttgttagatttacacctacgtatttcatttctcttgagtgactgcaaatggcattgcatttgtaattttggtgtccacttgttcattgcagtatacagaaatagaattgagttcatgtgtttatctcttattctgtaacattgctgaactcattagttctagggttttttttttggtttgttttatagattctttgggattgtctatgttcacaatcatagggatggttttatttcttcctttccaaactatctgcttttattttattttcttattttattgcactggcagaacttccagtaggaagttgaataggagtggtagagtggtcattcttgcctctccttgatcttatgtggaaagcattcagcctttcatcatcaagtataatgttagctatagggttttatagatgctttttagtaagttgaggaagtccccctctattcctatttttctgagaggttttctaatgaatgggtgttgaattttgtcaaatggggcaagagggtggtaattcttcattattccttactgtaattagtctgtcaatgttaatgagcatgctattattaagcacctattggatgttcagtgttgtgctaggccctgtgagacatataggaacctaaaaatttgagccttgccctcaagcactaaggaaacacactttctaaaccacaatttagcatataccataagtgctgcagaaggccccaggcagcggaggccagtgttgccctggctagaaggtgtcacttaggttggcctttgggctggagtagaacctagatacacaagagaggggagtgaattagagaaaattcaacggcctaaaattctattttctaacaaggacaatggtaagttgataattagtaggatagagatagcttttgattaatgaagttggattatctctattctgtggattatccctgacaaatgcttaatcctgaacttcctccctttttgagcatttgggctctcttttctgccatccgtcaacatgttcaggggaatgcaaactaatattactattagctaaagaaaaacataattaaggagggcaatctgctgtccctaaattgtatcatcttttccaaactaaatatgagtgatattggtactatcttttgtttggagagatccacaccacttctctccctcttaaggctcaagaagaattgactgtgaccatgatatacacaatacatttattaagctgtctctctaacaaggtagctaaacacttgggaagtaagagtaatgccttagagaatttggaacccatgacatctgattcattggtattgtccatatttgtacatgtttactctaatataaagtaataatataatagtgctgtcatttgcaaaattaaaaatcctggcacattactcatgggtcatgctttgggttgtcattctaacgggtttggtggatttgtatagatctggtcctctatctcactttgtcctgctggtgaccagtggctcctcttggaggcagacggccagggttaagggtggaatctgaggccgtgagggagagtgaaattaactgctcccttcacaagggaattgaacccctgaccttcacctcattagcacagcactccaatgcagcaattcctaacctcaattttatatcaccccagggtgtctccacttatctcaagcgggagctgcagaattcctccaacaaaattaattttaattcaccttaatttaaacattaaatacggactatgaggcagcaacttgcaggagtggggaagaatggctgttgttaataaatcccaccaccacaatgcactgttatccaaacaccccaaaacaccctctcgaacccactgagccaaacagtgtggggaggaagaagtctataagtaagcagcaggcatggaaggcttttaaattgcgggggaagcaacacccaaccctaccaaacatctgcatttcatagagactgtttcatgtggtcagctggggtgcactctgacattcactgggccagatggacatatttcagctcccgtccagccagcccatccctttttcctcctagggactgtgatgctttgcatagtcccaggagtttgctgcaggaacattttgtgatttactaagaaaataaattggtctttgttgctggggctttctcctgggtcaatacaaaagatttatcacctccatgccggcccacggagaggttggctcaaaggattctctggccactggcttattctggagacaagcagagtcccagcagaacctttgcagggcaggccagcagcctgagtgtaaggcaggggaagtaaccgtaggaatcagttattgatgaacatccttaaaactctgtttgtttgtttgtttgtttgttttgagatggagtctcactctgtcgcccaggctggagtgcagtgacgcgatctcggctcactgcaagctcctccttccaggttcacaccattctgccacctcagcctcccgagtagctgggactacaggcgcccgccaccatggccagctaattcttttttgtgtttttagtagagactgggtttcaccgtgttagccaggatggtcttgatctcctgacctcatgatccaccggccttggcctcccaaagtgctgggattacaggcgtgggccaccgcgcccggccgaacatccttaaaactcttcatggtcttttactgataacaacatccacatgcattttttaaaggagaataagcatagttccttaccctggcagtgcactttatataatttgtcaaagagtttcacatgcattgtatctcaattgttttctacctacccagaattaccaacttcattttattgaagagcaaatagacttggaaaagttaaatgccttgcccaaggtcgcatagctagtaaatcatggttgtagcaccagatcccatgtcttctcatatactgcactcttttctctatactaatcttatcttggtttattatcaacatccatttgcttttggcagggaagggtccagaatcttcattttacagaacaacgaattgaggtaagtaagcgttttgggtcctgcctctttttctgctggcaccatgtgcctttcttgctgaagggcaaggagttcttttgcaggcacactcatttctgctctcagaggccaggctctcaaccatcatcatcagtgccatcctgctcattgggccccaccctgccctctgtgtccagtgggggcttacatctgtgatttctgggcagtgagggggtcatacgtgaacagttccttcgcatcctcttaaaattgctctttcagctccataagtttcaactagtcaaaacactctccttcacacttcttcaaagatgagcatttgttctacatatttttttgtagtcatattctgcgagtgcacactttccctcttgggtccttagacacacccttttccaggcatgattcacttcctcaagctccgttctggacacatacatctggtgccacctggaagagggcttatcaggtcctcccacctggaatacagcttaaccagagttgatttctaaggcatgcaaccaagaaaccagactgatataaatgggatattattgattttatctgcctaaccgagtctataaatttctgaaagccatggaaggaactctattttgttgcattcctcataacatctagaacggtgctttgcatatactgagtgctcaaggcatatttgcagatggtgacgaggatgatttgatgtcgttttaaaggccggacatccaagaggaggtctgttctctacatgtgcatgcacgtacacttacacacactctctgacttgtaagatgccctttgcaagagtccatttgggaaatgcagtgggcccactggaagaaattcaaggccatgggccagctacaccacggaagccctacacccagccaaacgtgctcactggcaagtcaaacccaaaaactgtcatcaaattctgcttcctggcagcccggatccaacaatactctgaaagacaaaagaagcagaaactcaagtgaagatcaccaacgtgtctttttgggcaactagcagattgagcagagggtcagcacagacaccagcagagaagaacattctcctggcaggactctgcctccaaattcggcaccacttcacaggatctcagcctcacaccttatgggatttatttttttaaaaaagatccaacatttgttcctaattattcttagtaaaactgcctttcttgatgtggcacccattacctcattcattcagtcactcattcattcattcaatgaaacccctgtcatccacgctctgggctctttctacagccccacgagatgatcaagaactctggaaaacaggtaagccattatcatcagtgtatatgaaattatcatcagtgtatacgaaatatgaagaaacccaattagatggagatatctcctaccacacattgaaatcagaactcagacaagactcagatgttctaactccaaattctgagcagtggcccctggataaaggattatggagaaatactgaccagaaaaaatactcttaaatggcatattgtggtgttttaaggcaaggttattggtagtgcttgtaactctcaaaatactgttttggaagtttgtagtgattttgcagaacggctttgagttacctctgggtgttatcaatcattggatagttttcagaagaaatccaccttaatttgagttaaataatatgtcatttagccagatttcctcctgcccccaatccccataggagtgagaagccatggcttggggcattatctcagcatcatgggaattgcagagagggtaccacagctttagagtttgaggtgttgagcctgaacaaaaggaaagggtaagaaacttggggtggatagaacgtggaactactatgaagagcttattgcatagaaaaagagaaatttgagtttaaaaaaaaaatggaagaaagtaaagggagcccaaatgggaacagttaccagaggagattccctggaatttgaaggaaccaggttgaaggatggtttcccaatttgaataattataagaatcacctggtactctttttaaaactataagttcctagagccccagtcttagacattgcatttagtgtgtctgggttgaggcccagaaatctgtatttttaacagaaacccaggtgatttttataatcaggaaagatttgggcaatgtctgcatttgaagatgctgtctctcaaaatgaagaaatacctggacaaagccaagtccaagacaggggctctaagtcaaaaaggcaagagcaaaaacaacatgagcctttacaaaatgtgaattggcaaaaaagcagctgtagctcatatttaataacctcccatggcttccaaagaagcagctgggtctgcagagtcctgtttgtgcacaggatgaatggagtctgtgtgccactcgggatgcccccacaatacccacattatcactgaggtgctccagcgaggcattcattatgcactcccctgccacccaaagcctcaggtcaggtttgccttggacactctcccttctcccttctctgaggctgaggggctgcaggggcgggtgcctgaactccctccctctctcagggatgcctcagctctatgggacttcctctggttcacatgattgcattttcctgccttggggcaccctaaaggcctgcctctgggaagcagggtctagaggcatgagcttgtctggacaacagaagctcaatctcagcatcctaaaggcctacctctgggaaggggggggtcacagaggcatgaacttgtctggacaacagaagctcaatctccatctccaagcagttcgatcccccaacactcttggtattaggaggggagcctctgcaagtgtgaggaccgggggcctctaaacagggtttttttctttttctttttttcttgagatggagtcttgctctgttgtccaagctggagtgcagtggtaccatctccactcactgcaacctctgcctcctgggttcaagagatttctggctaatttttgtatttttagtagagacggggtttcaccatgttggccaggctggtctcaaactcctgacctcaagtgatctgcccacctcggtctcccaaagtgctagtattaaaggcgtgagccaccacaccaagccctaaacacagcctgaggctggtatcccaggaggccttgaaaaatctcaggtttgctgctgacaggtgtgccaggaagagacctggctgctgtctgcaagtggccaaaccctgataatcccggaaataaacaataaaataaactcctcaatggtgattataaagtactattgtttatcagccaggacctgtgctaagcttttcacctacattatttcatttatatttcagagcagtcctttgaagcagtcatgtttatatcagttttatggatgaggtcagagacttctgctggttaagtaccttgccactatcacacagctagctagtaaataaactttaaaaaattgaagtattatgtacataaagacaggcatagtgtacaactaagtgggttatcataaaagtgaacatacctgtgtaaccatccacccaaatcaagagctagactattaccagcctcagaaaaatcccagaccctctccaataacctcctcttccccaatggtgaccatttttgtcaccgagtattagatggctagtttgtgaattttataaaaacagaattctacattatatgttctttttgtctgacttttttctccactcagtatgacatctgtaatgctgatctaatgtcattcatgtacaagtagtttggtcatttttaatgctataaagatgttcatagtatgaatgtatcacaatttatttatacatttttcattttgctggttatttgagtagattttaattttgccccatgacaaataatgctacttggaatgttcttggatagttgacccttgaacaatgagggtcggagcagtaaaaaattcatgtataacttttggctctcccaaacttaactagtaatagcttactattgaccagaacccttactgatgacataaataattgattaacacatattttgaatgtatatactgtattcttacagtaaagtgagctagaaaatagaaaatacttttaagaaaattataagaatgagaaaatatatttactattcattaagtaaaagtgaatcatcataaaggtcttcatcctcaccgtcttcacattgagtaggctgacgaggaggaggaagaggaggggttggtcttgtctcagggatggcagaggtggaggaaaatctgtgtataagtggacccacgcagttcaaacccatgttgctcaagggtcacctgtacatgtgtcttggtgtacatatttcggcataggatataccaagaaatgtaattgatgggtcataaggtgtgtggattttcagctttagtagatactgtttacatagttttgcaaagtggctgtaccagttcactttcagctatgagagtcctgggggatccacatcctcaccaacacttgatactgttggtctctttttacttttgccatcctgatgaatgtgtttcagtttgcatttccctgatgactaatgaaattgagcagcttttcaaatgctattggccatttggatatctactggcttattcaggtctcttgcctgtttttctactgggttttctgtctttccaggtgatttgtaggagttctttatattttccggttatgaatcatttgtcatttatatggattgtaaacgtcttctctatggcttttcttttcattcttaatagtatcttttggtgaaaagaagactcaaattttaatgtagtccaatttttcaatgttttcttttttgattctgtttttgtttctgttatatataagtacaactgactttgtatattgatatttcaatccaagaaccttgctgaatttacttattaattctgttagtttttctataaattattttgtattttctgcatatgcagtgatatagtctgtcaataatggcagttttttttctttctatttcttaaaattttatttgttttcttgctttactgcaaaggctaggacctccaaaacaataatgaatagaagtggtgatagataggaagcatctttcttttattctcagtattaggggaaaagtatcaatatttgaacatttatatgatatttgctggagggtttttttgtagatactctatcatgttaaggcatttcccttttagtcgtactttcctaaatacttcttttttccttttactatcgccaggggttgaattttatcaaatgccttttctgaatctattgagctgatcaacgattttcttctttattctgttactgtggtaaattacatagactgatttccgaacactgaaataatcttgcatttctggaaaaaaatatcatcttgtttgtgatgtattgtcctgtttatatattgctgaattcagtttgataacattttgtttaggattagcatccatgttcaggagaaagaaatcaccattttctttccttgtcaggtattaaggttataaagctctcaaaaatgagtcaagaagtcatttttattttctagaagagcttttgtaaagactgatgttatttcatctttaaaggttttgaagaattcactgatgaagccatctgggcctggaggtttgtttttgtttttgttttggtggaaaggtttttcattatggattttatttctttaataggtacaaggctattatatcagatattctttttttatttgggtcagttttaataagttgtgttttccaaagaatttgtctatttcacctagatttaaacatttatcatcataaattggttctgaacagctttttgtcttatttaggagccacagattctattgttagggcttcctttccattcctgataatatttgggactcttcttaaaaaaaattaatcttatgggcttatcggttgtattaatctcttttgttgtttgtttgtttgtttgagatggagtttcgctcttgttgcccaggctggagtgcaatggcgtgatcttggttcactgcaacctcagcctcccaggttcaagcgattctcctgcctcagcctcccaggtagctgggattacaggcgcctgccaccatgcctggctacttttttgtttttttagcagatttctccatgtcggtcaggctggtctcaaactcctgacctcaggtgatccgccccaccttggcctcccaaagtgctgggattacaggcatgagccacagcacctgtccctgtatttgtcttttttaaagacttgtttttatttttattttttcactttgttggttttctttgttgtattattgttttctactttattaattcctgctatttattatttccattcttatgctatcttaggatttaatatgctgtttttttattaaaatcttgagatggaaacttagttcattgtttcttcatcttttcttcttttcttgtaaagcattcaaggttttaaatttctcttaagcattctttggctgcatcccttacattttgatatgttttagttttattacctttttattgaaatatttcctaatttccacggtaattcttattttgactcatgggttgtttagatatgtattagttcattttacatcaccttaatccgaccaagaactgagctctttaaagatggttcaggctttctgcaggctgagttcttcctggatcacccctttgtggggagtctcaacagaagaccagtggtatttaacccagctcttcctccttgctgggctctgaattcctttctgtgcctcagccccatgagagtcctggcaactctgctcaacttctcagtttccgagccactgctggggaatccatgcacgccaaggagaaaagtggctggcacctctccgctcacgccttgtttctgggatcttagtgccttagtttctcattgcgttagtagtttttttttttttaaattcttattcatttatttaggagacagaggtcttgctatgttgctcaggctggcctcaaactcctgggctcaagtgaccctcccacctcagcctcctgagtagcagggactacaggctactattagctggtggtttttgatgccttcaaatagatttgaaaaagatgttttgtccacattatccagtgttcttggcacgaagggcgtctgataagccaatctatccttaccaccaggggacatcccctggaaccaggatttaggcacaggtctgtgcacacccagactccagagcccacaccgctgcgtggcagggggagttgccatgttggagtacaggccgccaaatgcggagtagaaaaggaatgtgaagccctcttgctctccagctctcttcttcatcatcttcattattctggatctagtcaagcattgccatttatctaatctcagttctaaaatgtgttgaacacaaattttctagtttcttagtaaaattaatcttttaaatcacttactttctaacggttgttcacagggcatctgggacctctttttcaagttcaccttctcctggtctgaaaccaaaatgaaaacaaatagaatccaagtgtgctgtagctcctgacatccctccgtgggctccgccagcccctgcatggaagcctccacatgggttcaccaggctgttcttcgggctctcccaaagtggctgcttttccgtcaatatgaatggcatgactggccacatctcccttttttcttcgggtgccaggaagcctggactgttgagctaactttacggtccaaccatagcaactatgtcagtgtgcagataactgaaggtgcctttccctccctggcttggcttctccctcttacttctcttcccaagctctcaatttgctttatttttgtatattttaccacgatattgtctctctgtgtgtctttatataaaacttgagttattccagttctgccaatctgtgtaatcacttggcatttttatttgtgttcataattttcagccatggagacatttgaaagacaacaaaatcgatcctggagaaacagagatgtgggcactattgcaatttatagaatttattgtaaaattggactttgatgaatctttgccatacatattctgttgcttaagattttttgtaacaatttatgtgtctattgctttatgtgaaagacgcttttcaaaattaaaatcagtaaacagtgttctgtgattaaccaggaacaaaagtagatggacaactgctcaatgaacatgaaacgatgaagatcaatttttcttctaggtcatggacaaattaaagtagttaagtgttaaaaacagagaccatgatgtcattcctcatgactacaatagaccaatatttaactctaagcgtatttcctttaaaaaaaaaaaaagttaactacaaaaatgtagttaaaggtgctaatctactacttttttggtactgtaatatttactgtattatttatttttctattttatgggcataaccatccacagaagggtcagtaagagagaaatatcactgctttcctcttctatccattatttttgttgtttcgtttcatggctactactaaaaataatgttgtcacagagaagcaaggtgataaaaggattctctctgggggtcaatccatgaagaaagctggagaaatatctgctgaacagagttcatggcttcatgttctatctgagcaagtctcatcctgcagtcagctctcttgaggctgagccaggtctttgcacacctttcctctggctgatgcttttaaattccctctgtcttcgtctctgctattgagttcggtctcctccgtgagtcccccacggggcctggtgaggacaggctctgtgggagcagctttctgttttgagcctgtgatgtctggccaaggagcgcctgtcagctgcttgggctccatctcagcccagagacgtcgtgctgtgtggtcttaaagcaggtcacttcacctctcggtatctctctctgtaaaacccagataataatacttcccaaataaagaaagggttttctttaagccctttgagctcctcagatggagcgcaccacagaaatgccaaatgcggcattgtgatccgcgctgcctccatgtgattaggtaatgtgagattgtggttcattatgctttgtctggaatgaatgcgagccctgccacaaagcactgggaactctcagttacacagaaaccccatggtaagcttggattggcttacacttaaataaagcacaccagaaaagagcagtagttttgacgaacccagctctgaattaacactcatttgatttcttctgctgagtgcgggcgataagtaagagatgacccagttacaggtgcggggggcacaaccaacactgaggtgactgagtcgggggaagggcagcccctctgcaaaatgcttcaggctcccaaggaggcaggcccagagtgggcaggtctggacttactgctgtacagacaagggggaaattcaatagctaccatttattgagtttctgctaggtgccaggaactctgcaatgtatgccattcttctaaaccctccagacaacggtattaaaccatattaatattctgaaaaccaaaacaaacacccactacacttgacacatttttttttgtaccataatgaaagcctatgtgtttgggcccacagtttcagccaggattttgacctggggcctcctcactgatcctgaggctttaagaccacacagcatgggtctgcgaattgcaaatgggaggcttacttttcccattcttatccaagcctccagaagtggctctggagctggatccagcctcctttcttacgaagccttggatacatcccacttagcttgacaaacttttaccggaattctctgatcccatttcacagctgttgcaaaggtagggtcttggttgtgtcttccttcaagctgcttatgaaccaggggtggagactaggaagtaaggaaccctggaatcagagaagtcaggagcaagcatcttgttggcttgaggttctccaggcaccataaaccaagtagtgcgcatactaagaaaacaagctggacaacaagaggagagcaggagggtccttaggattggctgcttgtaccatggcccccagtggctcagtagagacaaggggaatcccaggtaagtagactccttcgctccccagagaggaatctattgtgtcaattgctgggaaacacgctcagttgaactgaccctctatagccgtatgtgcatgtggaatccattgttagggaaaccatggtgagaagggaagtgagatgctctggatgggtgctgagctgagtgctgatggaacagaccttccagaaaaggttgcatattatccaaggaaatatcattgcctggagagtcctaggctgacttgctctcttgggagctgatgtttagggaatgggagaagcagctggtttaaagcatcaaacaatgaaatgaacttcagaatctgccaaatcctaaacatttcttgctaagcaccattttttctgtattgtgaacccatctgtgcttcaaaagcaattttgtttaaatggcttcttccccttactcctaatccttgggaagctgtaatacacaggtggtaaaggggactccccaagagatgctcactaggactgctgtgagccagatactgggctaacactgcatagcaccgagggtgtgggagatcagaagtcaggagcctgcattctcaggggagggactggatccctgcaaggaaacaaagtgtggtgtgtgtggcttcatgatccactggcctaggtctaatagcggatctttttgcaaatttatttatttttcttttcttttcttttcttttcttttttcttttcttttcttttcttttcttttcttttcttttcttttcttttctttcttccttccttccttctttccttccttcccttcttttttctttctttctttccttgcttttttttttttttgatggagttttggtcttgtcacccaggctggagtgcagtggtgtgatcttggctcactgcaacctctgcctcccaggttcaagcgattctcctgtctcagtctcctgagtagtggggactacaggcaggcaacaccaagcctggctaattttgtatatttggtagagacagggtttcaccatgttggccaggctagtctcaaactcctgacttcaggtgatcctgaccttggcttcccaaagtgctaggattccaggcgtgagccaccgcacctggcttgcaaatttctatttctaattgagccagtatttcttcccaaaggttcactggaaaatcactgacatgaagaagattgattaataggaaaaaaggcatacacatttatttaacgtgtatacacaggagccttcagaatgaagacccaaagatagaggggaaattgtccacttttacacttaggttcaagacagtatggatagtcacatagaaatatgactggacaaaaagggtctgatggaatgctagactagactgagtggaaagcgcagcaaggcctgtctgcctagattcttccaggcatccatgcagcattccttccttctgggtatgggacaggatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcagcaaactttcagcaaacaattcattgtgatggcaatgagctatctgagaagtaaactgacacaatgatttcatttataatagcacctgtaaggataatatgcctgggaataaatttgttcaagaaggtgcagtacttgtacacagacaactacagaacattgttcgaggagactaaggaagacctaaatcaatggaaagacatcttgtgtccacgggttggaagttgtaacatggttaagataaaaatacaactcaaagcaatccacagactcaatacaatcctatcaaaaagtggctttttttacaggaatgcctgagaagaacttcatgttcctaaaaaacagcaagtgtccccccaaaacaaaagcaatcttgaaatgcaagaaggaacgttctctattccaaaggtctttaactgctctcagtaatacgtggtaatcttcaatatacaggctttcacacctttttttttttcttcttttgtttctagacacgatctcactctttcactcaggctggagtacagtggcaagatcacacagctcactgcagcatggaattctcaggccgatgacatcctagggcctcatccactgagtacctgggactacaggctcacaccaccacagccggataatttttctgattttcagtagagatgaggtctcactatgttgcctaagctagtttcaagcttctgagctcaagcgaccctcctgccacggccttcctaagcgctaggatttgaagctgagcctggctggctttcacatctttgctatgtagtttatatttcttggtgttattgtaaatgtttatgaaaggaatcttttaaaaattttgtattaaaattatatatttaaggaattacatatattatatatatttaaggaatacaacctgaggactacatatacatatacacatacacatacacatacatacacatacacatacacatacacatacacatatacatatacatatacatatacatatacatatacatatacatatacatatacgtatactatacataatgaactaatgcctactaggtgaggggctgccttgtgagcaaacccaaagtccttggctcacaaagccttgtctagaaagatggagggatcagcaaagtgggcacacagcaggttctgtctttagtgcgggcacctgcccactcgggtctctggcaatcctgaccaggcttcatgatgggtgaggtgagctaggaatgggaaagtggatgacctcagatccagagactgcagttgtcacctggggacctggcatgtgcgtggaggagtctcccactgatttggccctggatcaatgcccaaacatgcacaaggacaggactgttggcctcaatgttttaggagccaccagtcttctaaagagggtttgtggtggggaagaatgttcaacaaaacagaagagttatgggtactctagcttggcaacagagaatacttccttgtgctactaaatgacaatatttgacaattatggatgacataattgagcaacagctttcactgtttaacaagcagggtctctggaacactaggttagtgctgtcggaagttgactgaaaagtcggtggtttgagcccatccagtcgcattaatgtttctagctgatgtgaccttccatctgaagagtctcttccttggaccaaatatatcttcaagcttctcctcttcttgtctcttgtctattttccaaggtgcctctttgttgcttgaggcaaaaaaagttcattattaatccacacccagcaaacatctacccttacttatcccggtttttagagttttgagtttgtttgttttctcagcttctcatatttggaatactgggaattcctaaagtggagaacaacagaacctgaatcacacctatggtgaagccacaggccctgggtgaaaaacctaatctgctcgcgtttaaagataaacccattaattttctgtgcttccatttctatctgtctaatgggctaaatcagaacacttaatttgtccaatgtttaaacgagcagtgcaggaaaagcgtggagccaatgcctgtcacgtagcaattggtcaacacgcatgagctcctatcagcgtcacggcctccagcatttccatcaggctttgatctttgaaacgtccttcctgatatgaatgggtcattcttcaaacattctctaaccgatggccatgacattgttccaatgtgtattattacaaatacaactgcagagaccagactgacacatgtatctgtcgtgcatcacttgtctatttctccgtagatacctggagatggaattgtcagaccaaagtatttatacatttctgattttgctaatttctatccaaattactatgaaaagaagctgtaacaagtcatacttttaatattttatgagaattctttttttctccatcttctggccaaaactgggaagtacttgcctaccatttcctctgaacttacttttgccaacatttctgtagtcacacagtgggatcacattgcatgcatgacatcaaactcaaatcctaattgaaaagaggggttcacaggactctataaaaatttatattcaaaatacaaaaatgcaaacatatatgtgtatacaaatacatatatatacacatacatatatgggaaaggaatttttttatttggataccttatcaaagttatatagactggaaaatttgtttagtaaaacagcagtccccttgtgtactcccagagtttcatcacatagaagcaagtatttagttatttatctccttatgtctaaatagatattattcctttttgattttcaagcgtaggcactatctctccttcacatacttgctcatcaccaccacccccaaacatgcctctcactaccttaccctctaacatgtttgtgtcctagtttgagggccaactactacattattataacttgtatatgttattcagagttcagtcacactggatatacatagcaggaaatgaaaggccagtatcttcagggactctctctcaagtggataagcttcagagatttttgtaatctttggtcaccctctccatctttttcctattccgggtaagtactggatctgatgggcccagctcaggtcaggcactctctccttgagaaggggagagcaggacatcttcatgtgtagtaccaagaagacactgtccaaagagggacaggtagttctgagacagaaaagtcaatctggggtatgggtaggcaaaacgaggacacaaaaaaaaacccatgtctgttctgtgaggggagcatgcagtagagggtggattcagagtgggaggggagagttttgagagatatgggccatggatagccctctgtgggctggagccacgcaaggctgttggggtctctcaggggcagggagctgaggagaatctgccctccccaacctgggagactggtgaggggactgtcctggtcaccagacagaaatggggtctgggccagggcagttctggtgggaaagaaagaacaggacatcttctccttaggtaaggctctgagttcaggtcttggtagggagggaggttaccttgggcattggccactgaagatggttggccagatgagcacactgaaatctatgttctataaacttgcagttctagtaaaagaatgactgcagtaaagggtctttaggaagaggaggtggaagacctgatttgggttgggggctccaagaagaatgtctgccttgctgtgcagaagcctgctacacaacctccctggtccccttgctcagtctcccggccagacccccagagtacctgccctgtgcaccctggaagtacacagtgagttcagccaaggcatctccagccgggactcatccctgggcatttctgtggccttgggtgccctggccttctccaggccctgtcttgcaggcaatcgtcctgcaggggaatgggagaaggaggctacttgacagttgactctgagtggctccacaagttcctgacttagctcctagtcacttgcaaacctatatacccccatctcatcccccaaatggtgaaaaagaaactttgccaggactcatgccagacaaatagaacagaaccgttccatagagccaaggtcttaggacatcaataagagatggaaaccacctgctagaaggtgccacagtgggaagcttgttggaagggagcagtcactgaactgtcagggtgaatcctggctcctggccctcacacgccctttctccccttccttccttctctcctccctcctgtctgctctttcccctctctcccctgcatccctcaggtaccttccatgggccctcacccctccttttcagaggctccaaagtgagccctcaaaatacttggtaaccttgggcatttccaaaactggagagatttggccacaccatttttaggagctaggaacgtcctccagagctcttgcctaaatttttctgctgatgagaagagaacaaaagagtttccatctgatctggtcctaaggcaactgctccttggagcagagtctgggcaggaagaagggggttgcccagggccccagacttgcccctcccagctgctgtgctcctctccccttcactgcgggaggctggccagggatcgggaacctctgttctccacagttgctgcgatcccaggcccaaatctaaatattggctgatttaggaggctaagggaggcaattccctggagagaggtgtcaggatctgggacaagagcagcatctggttgccatccacggagaccccaaggacaggaatccagtggtagcctgttggaggggatcccatgacaataaaatgaaacgtgtgcattagaactggagccaagaccaggagctgaaaaaccgcgccgtcctaagggatgaaggaattagggaatcccggaagtaaagtttttcatataggtcatttcttccaaagagacacagggcaatggcccaatgacatgtataaaagaaaactcagggtctaggattgaggggaggcagccttttcagtggaggagacctgtcacctggaggcccagggtcaccctgagaggggaggggtcttgctgggtcgctgggtctaggactccaattgcacacagccagtggcctggacggtgggtgaccatgactggggcaatttcccccattccgcttagggagcaataggaatatcattggcattatacagaaaggtcccactgagacttgaacgctgatcaccgtactcagagtccaaagcgctcaccattacatcatggaacctcacaatagctcgtaactggagggcactgagttcacagagcagccgtagttcccacgcacctctgttcatgtatttcctctgatccctcaagcaacaccgaggaaggtggacctgagatggaggagtcgtcctctttctttctctgccctctcctttgatcaacttttaccatttcctttgcatcttagaaaatgaggcaaaatccagtttgggcttagggccagagaagagcccttgaggcctccctcatggaaaacatactctctcagtttaccagagtttcctgtaccaaggggaaatttctgcaaacagtaatgttatattctttttgccttccctcttttccctttgcccagggaggccagatgattgtcagaacaggacttgggccttcctgggtgcctcgcccccttcctccatgtaataaataatagctgacaccaagcaagtgggattgggaggcagggaagctttcattttctttttgatatacttttatgcatttgcttggttggttatggcaagattttctcaccagaaatggagatttgttggattgaaaataaaaagtaatcagccatgttttacattcaacatttattgaacccctgctgataaagcacttgccagcttcagtgggtctgctagagatgagagtacacaatccctgacttacagataccttgtcccaactaaggcctaggttatctgaaggggagattatcaatggcaaatgcaggctcctcctgtggaaagaaattctgcttcctggagctggtggtctcttctcccaccagttcaaagaagcttctctcgcactgtggatctgccctccctgccccacaaggttagggtatgtgccattggggctcagggcatatgtgggaaattcagacattctgtaacacctgctgtctcttcccacgcaggtgaacccttgctgaagcaggacagcaagcaggtccaggtggacctccacgacctgggctatgagacttgtggtcaaagcaagaatgaggctgaacaggaggaatccaccagtcccggtaagagcacagggtgtggggctcaccttccctccctggagtcagctgtcacatttgggtgctgttggccaattccacacctgacaagtagtggggaagaggaggacaggaggttaataggagaactcttacccaaaatgaggctgagtataagtttgaatttctacaatgagtttgtggcatactgctaataataataataatcatatgaagttctatccaactgattattatagaaatactaaggcctacttagagaccacatgaggttttggaaacatgcaaaccataagttaaaaataattttggtttgcattataaaaggactacaactatagggccacccaccacattcaaaacgagaagagaagaaaaacacagtctctctcattcttgaggaagtgtactgtggcagttaagagaaaagatcctggggtcagacttgttgcttcaaatcccaatttgtaaactttcctatgctccagtttcttcaaatgttaaaatagtaataaaggaactacctaccccatcaggtactaatgtcaattaaatgagtaaattcttataaaatgctttagaacagtgtctggcatcgggtaaaatgctgtggattagttctcattctgactaccactgccccaatacactgatgttaacatgctgatatatttattcaaactcttattttcctttgcctatttttcacacagttataacccaataaacttttaaattatagtaaactttagagagcattaaacttgcagcatgcagaaatagcttgtcctacattcttgtggctatcctaactagataaggccatgttaataatgtcttgagaaacatcagtgtgtgtggaatgaacacaggatgttggaggatttgaattcaggctctgccacgtgctagtttgagtgatctagaacaagctggtttaccacctctctttaagttttggtttccccagtcagtaaaatagagagtggtgaaacctaacttgtgggtataaggaggataagaaatactgtatttgaatgcctagtacagtgtcagggttgaataaagtacgacttcacctttttccctagtaattattatcctcatgaccaaacctgcctcctctcaaaggcagtggccacaacagcacatccaacttttattcaggaagacatctttgtcttttttcagagcatgaggagcacagcagccgcaaggaaatggtcctggtggaggggctgtgctctgagcaggggcgccggggctgaacgctggctagttcctctgagaggaagcccttggagaatgaactagggaagcaggaagagttctgggtatatggaaagtcagaaaacatctgggtcctatgaaaggacatcaaagatctgaaggcccagctgcagaatgccaacaaggtcattcaaaacttcaagagccaggtccagtccctctcagttacaagtgattattcatctagtctggaaagaccctggaagctgagagctcctgacaccctggaggggtcttcacctcatagtgtcactgatgaggatgaggtgtggctgtctgatggcactggggctttctactctccaggacttcaggccaaaaaggacctgaagagtctcatccagagagtatcccagctggaggcccagctcccaaaaaattgactagaagggaagctggctgaggagctgagatcagcctcatggcctgggtaaggatggcactgtctgggcactttctggattgaaaatgtgtaagtttgtgcttggtgtagggtagctcaggcagttggaagaaacaacatgtctgggtattcacaaggacactgatttaaatggtagatataggtctgtggaaaagacaggtaggcaagcaggagggcataggatgatgtcccagtatctgggagataccagatctcagggatttcctcttagggatatatcagtaaagtaatagtacatatggtatagtatagtatagtatagtatagtatagtatagtatagtatagcatagtatagtggtaatactggaatcagactgcctagctctgatgcttactacccatgcaaccttcttaacctttctgagcctttgtcattacctattaaatgaggatgataacagaacccatctcaaagggtggatattaggtttaaatgaattaatacaagtgctggccaggtgtggtggctcatgcctgtaatcccaacattttgggaggctgaggtgggcagaacacccgaggtcaggagttcgagaccaggctacccaacatggtgaaaccctgtctctactaaaaatataaaaattaggtgggcatggtggtgcacccctgtaatcccagctactcaggaggctgaggcaggagaatcgcttgaacctgggaagtggaggatgcagtgagccgagatggtaccactgcaccccagcctgggtgacagagcaagactctgtctcaaaaaaaaaaaaaaattagtacaagtgcttagaatggtgcccagcatacattaagctctcaatgctatttgccatagttatcagtgttattgacactttgtgttgaaaacacagacattcatcttggtatgcgtcctggttatctactgctaagtaagaaccactctaaaacttagtgacttcaaacagtactttattatgcttcatggttctgtggtttgactgggctcagctgggtggctctcacttagggtctcttgttttgggtctcatcagttgatggcatgagagtttatgtgatggccatgattgcaaaatacagtcagccacagtatcacaacacagaagaaattcagacatcaggtggtggttaaaacagaagacatgaaaggtcctatctagacttaggatgagatgagtctaattattcattgagtatctgctgtgaatctctgtgatgctggtgctgtaagggatgtgaaacgcagaactatcttcattctcacagaccttacgatttatctagggacatataattaacatatatagaacagttgaagaacagtggcatggtaaattttttgttttgttttgttttgatacagagtctcactctgtcacccaggctggagtgcagtggtgccatctcggctcactgcaacctctccctcccaggttcaagcaattctcctccctcagcctcccaagtagctgggattacaggcatgtgccaccatgcccagctagtttttttgtgtgtttttagtagaggagggggtttcaccatattggccaggctggtctcgaacttctgaccttgtgatctgcctgcctcagcctcccaaagtgctgggattacaggcgtcagtcaccacgcccggcccatactaaatttttagtgcaataatttatcagggtagaatttactcttaaatacctcctatggcttacgtgccagaattcagtttgggggagttccttagagatgttctcatagaaatctctacagaagccccataacttatcatccaccctttcctcttctgtcctgcattaggaaatatgattccctgattcaggatcagccccgggaactgtcttacctacggcaaaaaatacgagaagggagaggtgtttgttatcttctcacccagcatgcaaaagatacagtaaaatcttttgaggatctcttaaggagcaatgacattgactactacctgggacagagcttccgggagcaactggcccggggaagccagctgacagagaggctcaccagcacactcagcaccagtaggttggccacagggctttggatactctcagtcaccccacagttccagcccctggtggccaccacatctccactgcaactttttaacgtagggtcctgtttctatttcatttcctggggctaatacaggatcaagactgctcaatggggagcatggagaggaacacacagggctggagatgccatggttacaactctagaaacttcaccactcatggaatgtgacctgtggggcaggggcggcatctctctggtgctaagagggagtaggggacatgacatggaagggccttgttataggaggaagagccgtgagctaacaattgcaagacgtcgaggcgctgaggccaaagggtccgtgaggaaacaggcgcagctcgcgcccctcggcctacgggagggagggcaaggagagtcctacggttcctgggaggacgagaagagccaagagccccgacggccggcgccggggaaaaggccccgaggcggggtccgcatccctggaagggcggcgtccaccctcctgagaggcacggggcgcccagggctcggacgctcaaagcccgccggctcctgcagcttctgggagccgaagagtgtcagccgggaggatcccgcacacggcgcttagttctggaactgcatacccaggggaggatgcgggagcccgaagcccgggtatgtgtccccgaagcccgggtgtgggtccccatggttttcgtgttgggggtgggcgcggaacgctaagcctgggcctattgggagccatagtcttcttgatggctggtgcttattgggcttttttcagtcgaatttcgaaatgcagttgaatttcttactttggaaacgataatagaaatggctgacctaagattttcatgatgatattttgccttttttggtgtatatgcagtttctgtggtgtagtggttattatgttcgcttcacatatgaaaggtctctggttcgagactgcgtgggaacatcgtgttttgttttgtttttttgtccctaaatttagtgagtttaatcgaggttgggaaacaaacagaaaagtagttgaacctgtggctacactttagacctcctcaatctagacagatcgttgaccaggctacagtttccactggtctgccagcaagaggcctgcttaatattagctttggttccagaaattccttcaggttctcttcattctcttctatcgcctgtattttcacaggctgacactgaaagtggatgacatcttagtgcatttcctaagggtcccgcttggcttcgctttactctggtaagttgcagatctggctgatttgcaagacaacaaaaacaaaatattttttaaaaaggttctaaatctgcatctggaagtcatagagtcaatattcctaaatcacatgaattatgtgtatacatttgcatgcataccccttccccaaataatcctcagaaaaccggttaagttttagcatctgtgactctgagatgcatatgaggcctttgtaaatttagaagttaagagtagaaagtacaggtttgtattttagaaggagatttgggaataaatatagctctggtggatatagatcatatgttaaggtttgttggccagagctggtttgtgtcttgggtgttgggcaaagaacagagaacagccaaagctctgcgaggtcaatgtgaagggtgatttccttggtgggctcaagtttatgacgcagcctggacctagcttggcttctcagctagagaagaagcatgattccatgtcacagctcctgtctttgaaaaagtcataatgactcccagacccaacatatggagaaaactctggatttgtctcttcagttgaatgtttccagagaaaattgaggaaagaaatctctctactatttgaacttcatcaaaagactaatatgctaatatttgaccgtcaatatttccttaaactagtctactccttacatagctaatacatcaaagcatattaacttaggaaatgggattctcccaaacaatgaaacattgacggcaagcgttcttcatcttttcatatcacatttccttcaaatgctttatacatcttcaagcagacaaataatagtattataatgattacgagactgatcgttactcttttgccaaaaaaaccagcgacaaaagactaacttagtggaccaacctttatttcttcattttctctaccttggttctgtccttttatttcctctttcttctaattctgcttctgctactgatttcctccctggatttgaactttacttacctaaactaccagttaggttaccttcttagaacctctaaggcagcagtttgaggttgacgatggaagatttaggattagaaaaaagaaacgtgaatgaatttctgatgttttattataggggtttgtaatgcaggtagaaagaaggacctttttcagagttaagagtttgatccgacaaatgagctattttgatatttataacgttgtctagtaaaagtttcctgtaaaaacacatttggtttggatgtctttgttagcttttagtcgacacttgaaaaaaccgcttggaacggtttctaagtctttgtggatactcttttctgttatcctccaggcggtagttacgcagaggcattggtggttcagtggtagaattctcgcctcccacgcgggagacccgggttcaattcccggccaatgcaaaagggtctttttcaccccgctgttgctctttatctgtcttttacgctgaaaatcatactgcataacctaatagtgcatttaggggcttggccaccacaaggtaaagtgacgacaacactcacgaaagtagcggcaggagacattcaggagactaactcaggaccccatgcagttgttggactcaaacagcttagcaagctgacaagcatgaagtgtttccggtgagtcactgcagttttcatactggtacctgtgactttcatctattcactggaaggatccctgcaaacccgaagaaccatcaggttcctgattcgcgtgctggaccttgggcttaccgttgagccactatggagaggatcaagaaatgacgctcttggaaggagagaagctgcgggcaggacagtcacctcagaggtccaagaggcgtcagcggcccaaagaaaggggtggtgtgtgggcaagagtctgcgtggagatgaggggagcggcggagactggtccttgcgcagaggtggccagtagaccctcagggctgtaccccagacaccgtgaaccgaatttgctaacatcgtcagcgaccgcggcctccgcgtgttttgtgggcccatcggtgttccccgagaaattccgtgtgtctggcaatgtgtgtcaacaggtgttggcctgaaatttggccgggcacggtggctcacgcctgtaatcccagcgctttgtgaggccgaggcggatggatcgcttgaggtcaagagttcaagaccagcctggctaacatggagaaatcccgtctctactaaaaatacaaaaattagccaaatgtggtggcatgcacctgctattccggctacttgggaggctgaggcaggagaatcgcttgaactcaggaggcggaggttgcagtgagccaagatcgcgctactgcagtccagcctgggcgacagagcgagactccgtcaaaaaaaaaaagaaaaaaaaaaaggagcgaaagaaggcagagatgtcaatgggacaaagagacctcccaggaggcttgttgtagaggcagtggccggatcctgagagatgagattttttatttaattatgtagcagaatggggagagaaagggagaagcgcatgaaagacagaaaagcacgaaaatctgcggacgtccaagaataaagcagataaaatagtgtgagtgtttttacattcaaaaaatagaagaagtgcaatgcttgtcagcaggctttgtggtcgtgtagtggttaatacttgtagttgtggttgccacaacctgggttctaatctgagtcacagtagtgttttctagcctgcgattgtggctaatagacctgtcgtttgctttgcctttaatcctagcagcctccagagagcagagtaaacctctggccccgaagggcgccagcttctggagtttagcccacagcgcagaaactagggggcggcctggccgataggaaaacttggacatgctctttgtctcacaattgagcaggaaaaattcccgtaggtgaagatgctgcctctcaagggccctttgtctgtagcttccactgatgaaataatgcggttatagtcttttctggtagagaaaacggctgtatcagtggaattttttaaaaacacaaaacgagaacgagtttttaatgagctgacaataaaatctaaactagttgtcatggtctgcaccggcttgcctccattccccatctgctaatttttatgagaacagtaaattattactattatcattatttttgagacgtagtcttgttctgtcacccaggctggagtgtcatggctcaatctcggctcactgcaacctctgtctcccaggttcaagcaatgagaacagtaaagaaactacagttcacataaagtgcacaaatctttagtgcaatttgtttagttttgatcaatgttatcaccacccagctcaagttatagaaaattgccatcatctgagaaaggcctgttagagcccctgtccaggtgattcccaccctgtgtcctcttagttatcactattctgatgtctattcccacaggttacaattgcctgttcttaaagttcacatgagtgaatgtacatgttttgtgtctggccttttttctgcagttacattcattatactcatgagatatatccatgtagtttcatagatcacttctcaattttggggttattgatttcttgtgctgaatattcttataacagtctttgtgtgcacttgagattcatggaagtccttcaattgctgggtcatgacctgagtataagtttaacatcagtataaattgccagtcttctagaatgttttttcaccagcgatgacagttgaagtggcaccaaattcttgtcagcatttggtgtacgaactttgttaaatgtagctatgctctcagaccaatctggccaacatggcgaaaccctgtctctactcaaaatacaaaaattagccgggcatggtggcatgcacctgtagtcccagctactccggagggggatgttgcagtgagtcaagatcacagcattgcactccagcttgggtgacagaatgagaccctgtctcagaaaaaaaaaaaaaaaaagtagccatacactggtgagtagttagtgctatctcagtgtggaattaatttgtatttgcctaatgagcaatcctatgaagcatactttcttgtggcttccagcatataagaaactctcctttgcaaaggcctattcaaatattttgccctattttatttggcttagctctatattactgatttacaaaagttctcttgtatattcaagaattgagtctttttttttgactttttttattatactttaagttttagggtacatgtgcacaacgtgcaggtttgttacatatgtatacatgtgccatgttgatgtgctgcacccattaactcgtcacttacattaggtatatctcctgatgctatccctcccccctccccccaccccacaacaggccctggtgtgtgatgttccccttcctgtgtccaagtgttctcattgttcaattcccacctatgagtgagaacatgcagttcttggttttttgtccttgcgatagtttgctgagaacgatggtttccagcttcatccatgtccctacaaaggacatgaactcatcaatttttatggctgcatagtattccatggtgtatatgtgccacattttcttcatctagtctatcattgttggacatttgggttggttccaagtctatgctattgtgaatagtgccgcaataaacatacgtgtgcatgtgtctttatagcagcatgatttataatcctttggcatttataatcatttataataatcatttatttataatcatataaatcaaataaatatataatttatttataatcatttggcttttagcagcatgatttatatacccagtaatgggatggctgggtcaaatggtatttctagttctagatccctgaggaatcaccatactgacttccacaacggttgaactagtttacagtcccaccaacagtgtaaaagtgttcctatttctccacatcctctccagcacctgttgcttcctgactttttgatgatcgccattctaactggtgtgagatggtatctcattgtggttttgatttgcatttccctgatggccgctgatgatgaggattttttcatgtgtcttttggctgcataaatgtcttctgagaagtgtctgttcatatccttcgcccacttgttgatggggttctttgttgttttcttgcaaatttgtttgtgttctttgtagattctgatgaatctacagatgagtagattgcaaaaattttctcccattctgtaggttgcctgttcactgtgatgatagtttcttttgctgcacagaagctcttaagtttaattagatcccatttgtcaattttggcttttgttgccattgcttttgctcttttagacatgaagtccttgcccatgcctatgtcctgaatggtattgcctaggttttcttctaggctttttatggttttaggtctgacatttaagtctttaatccatcttgaattaatttttgtataaggtgtaaggaaaggatccagtttcagctttcaacatatggctagccagttttcccagcaccatttattaaatagggaatcctttccccatttcttgtttttgtcaggtttgtcaaagatcagatagttgtagatgtgtggcattatttctgagggctctgttctcctccattggtctatatctctgttttggtaccagtaccatgctgttttggttactgtagccttgtagtatagtttgaagtcaggtagcgtgatgcctccagctttgttcttttggcttaggattgacatggcaatgcgggctcttttttggttccatatgaactttaaagtagttttttccaattctgtgaagaaagtcattggtagcttgatggggatggcatggaatctataaattaccttgggcagtatgaccattttcctgatagtgattcttcctacccatgagcgtggaatgttcttccatttgtttgtatcctcttttattttgttgagcagtgttttgtagttctccttgaagaggtccttcacatcccttgtaagttggattcctaggtattttattctctttgaagcaattgtgaatgggagttccctcatgatttggctctctgtttgtctgttattggtgtataagaatgcttgtgatctttgcacaagaattttgtatgctgaggagtcatttttaaaataaatatattgcaaatgaattttcccagtcagtgaaaagtctgactgaaagctgtcaactgaaaaatcacacaatttataaatttagaagggagattttattttttataaatggttacagcctgcaaggtggccattcccacagactgggaggcataccctcctgctgaaaccgaaaagtaggtttccagggaggggaggggggaacagggatttatgttgatctggtgggccacatatgcatattcaacagggaataggaggagctctgaatattcatgaagggatcgtgctgcatgcatgctgagtaaacaagcctgttacatgcaacccatgttcactttggggtggagatgacatttaaatacattataattagtccctatgcttcaaaaggggaagcagggacacaaaggcagtcaagtgcacagcctctgtaaaacgtccagaacccgtccacagccagtgctctcttatcaaggggaagttactgaaatcagtctcttgtccaatcaaagctgtagttatggcttgtgtagggagggctcagtcagtttatggtaatgggtgagctgcaagtgcttcagcattgcttatctcaaggccagtgcttgtttagctagagaaaaaaaggaagaagaaaaaaacctgtggcaattggaacatagtttattctttaagttgaggggtgcatgactccaccttgcctggcgtggccttaggtctcgtttatcataccatatcttactactgcaaggagtctgttctgtcagtcttaggatctctattttaacaataatgctggtcagttgtgtctaaaccacaaagggagagagtataaggagaggtgtctgagcttccaagtactggccaggaactcagtatttaagacttctctggggtctccttggcaaagaagccatctgtccagctagttgggtggcttcagattttaattttagttctgaaagcatttaatttgatgaaattttgccatattttttctttatttttaaagcccgtcatgttctataaaaatctttctactcaggatgtgaatggattctcttaattttatctctctatgagttccagagtttcagttttaatttttaaattgatgacatctaaaattctactcctaaccaaaacatttttgggggtgactaaggacaactccaaaaatcttccataaatggaagtaagacttactccttaaagaactttctgggatcctgagctgcggggcacagtggctttagtgcacctctgctcttaagactattcagaaattgtctttgtgaacccatcaggctgtttcaaaatcagcaatttagggcttgcttgcaacacgcagttaagcagcagctgttttttggatctcatgagtgcctgcatgcatacttccctgggaattttctaaatttgaattctcatggtatttcaagtggcatagttgtctctttcttttgcctacagccacatacataccaccaaatcctgcactccaagcttctccttcctcaccctgaactcccaacctccagttagacaatccacatcttcccacacctgcctcaggctccatcaggccactgtgcctcccgcagcaaccaggccagggggaatctggattcctattacacttctgaggaaggtgatcagggggcgtggaggatgtgggtgggaaggggtgagattgagggcaggagtacactgtggtcttctgtcttctacctcattggcccaggtgctgctcttcctccggttgtctgctttcagccctgtgtagggaatcaggtctgcgccctcatcttcctgactctcattttctgaggaacctgaatggatgagccgtcgctcttgtcccacacattgtgtccaaaggtgccctcctctctacttgctccggtgcctgctctctgagctctgacactcaggctgggatgccgcccagtacagaagctctgcagccctgcagggctctgactgttccacaccagcaggataaaggccacagggcatgctgtggtcgaaaagcattcagaggtgtgggctgaaggcctctctttccacagtccctttgaacaccccatggaagtcagcacccctttgaggaacgaggtggcccaaggcctggcttcacatgcaggccgttgggtcccagtgggtcctctctgtgcctggtatagccaacggcttcatgcatcttacccggtttcctctcctccaccacccaagctcctccttgacccccttgctcagctgttctcaggacagcaagatccccagcccttggaaaagcccatctccagtgcttggggagggagttgggttcaggtcgtctaaccacagaaggacagagaacttgaggcaggaggaaatcccttcccttgctgggtctcttggcacagcccatccaggggtctgggtcagggtccaggtatactctaccctcctataggacctggatttttaggcccccgaggttggtcaacgtggagtctttcccactgttcacctgggaactgaaggaatatcccatggggccctctcttactcattagagacacccagaaaatactccattcagcagaaactgcgtgcagtgtaccagaccactataattataactgcagggtgtggaggtcagacacgttttgtggctattttctctctgtctgtgacttgcttgccttttcactttcttagtggtatcttttgatgagaaggtgtggctaatgttgatgaagtctcatttatcatgtctttcttatatatgtattttttgtgtcctgcttgttggtagggtgatctttgcctaccaacaagtcacaaactatccttgaaatgctttatatctttaacttttacgttttggtgtgtaatgtacctgaaattacttttgtgtgtagtgtgagggagaataacattgttggtctccccacattcatataaaagtccattaattgaaatgatttattttcttttattgaactgcttttattgaaaacccatttattgaccgtatagctgtggatcagtttcaagtctcttaactcagtctgtttatctatttgtcactcctgatgcctcgtctgtaatagcttatagtaaaccttaaagtcagatagtacaagtccttgttcttttttacacattgcaataatttttgaaataggtaataactcataaaaccatcacacacatcaggatatgctgtcacttcatccctttctgacatggtttggccgtgccctcacccaaatctcaacttgaattgtatctcccagaattcccatgtgttgtgggagggacctaggaggaggtaattgaatcatgggggcgggtctttcctgtgctattctcctgatagtgaataagtctcactatctgctgggtttctcaggggtttctgctttggcttcttcctcattttctcttgctgctgccttgtaagaagtgccttttgcctcccgccatgattctgaggcctccccagtcatatggaaatgtaagtccaattaaacctctttttcgtcccggactatgttatgtatttgtcagcagcgtgaaaacggactaatacactctcatttctgagtgggacacatgctgtcactcacatatgctggttgctgacttgtgacggaagattctctattgtaccctctggggacaatacatctccagttgcctgcggggaggatgaacatgcaaaaaatccacaacactcagcacagagtctggatttagtcccattagtctgaatgggactaatgcccttataaaagggacctcggggagctctctcgccctctttctgccccctgaggatacaatgaggaggtggcagtctacaaccagaacaaaaggccctcaccataaacctaccatgtcggcaccttgatctcggacttccaacctccggaactgtgagaaatcaatttctgttgtgaatcagccacccagtttatgtatggtacagtgttagagaagcccgaactaagacacagatggaatcccatggagagtctctaatttgctaagctggtcatcaggcgggatgttgccagttagaaacaggaagagctgacattttgtgtatatgaaagaagatagtggacaggcccattgtgtcggctttgtctgccttggcaaactggagacggaaactcgattcaccatcgccagccacgggaggactgggaggacctccagaggaggttaggttgacttcatggtaactttagatcctgaaacctcccaggatatttcttgtcttccctttgatcgctcttccgcctacccaacaggacaggactcgacgcctttctttcctggcagcaagaggtccgttgcggacaagaccaaagtgagcagctggtttcccctacgtgtccttccgggcctgggcgtctctggagctcaggctgacccgagacctgactcccggccagtgggaccagcaggagcctggaagagcgcgcccaccggggtggaggttggtcgccgggggtcgagaaccgcagtcaaaccctcttcttccccgggcaccgcgcacctgcccccggggatgccgaaggaagtggcccataaagcttctctgcaaccgaaagaggcctgaagctccaggagggccgagaggagcctcgttgagcgaacccagccctctgcctggctggccctggtcaacaggctcggaagaggctgatttggaggacagaacggaagaaaagacctaaaggtttcgaatctcatgatgtagagatgttaaaagcctccaatcctaaggtctgactgtgcgggggagcgagggggtctcaagctggatggacccctgagccttcatctggagagtcctctgcacaagctcagacagcaggacaacgcgcatcagtggttctcaagagggggcaacttcgcccttacacgcctctcacctccacgctgggacactaggtcacgaatgggggaagcggggagggagaatgctaaccccctggcatgtatctagtcagcagaggcgacggctgctgctaaacaccttacaatccacgggagggcccctcccctaccccgaagtagccattccgcagaggtggagagactctcgtgtagctcaatgcccacgcacttagccgatgggaaattacgaattgatgaccagttggctcttggatctgaggaaaaaactccagagtcagagggaactctcgaagttttgcccggagcaaacggaagggtggctttgccatcgcctaagatgggaaaatggcaggtgtcacaggttgcaggggaaggtcggagaccagctgagggccccggagccttcctggaaagagtttcccatccagcccgtctcggtttccgcatccgtctgattccttatgatgttgagggtgctggcgtctgggtcctttatgatgcagagggtgcccccgtctcaccctgggcgcctccgcgctcccgcctcctcctggcaacctggtgcgcggctccggacctggcgacccacgaccggctggtcacttgctgccacctcgcaaaggcgcatctctagttcagtggtgagctgcggccgggtcgctgcaactcgctccaggcctccggactcgtggcctcggtgtccctcgcggagccctcggtgtgtcgcttgcaggctctttttttgaagaaagcagggagggaatggccttgtgagagactccaggagcaaagagcgaccctcacaaggcccaagtcctcccagagctcagggaagctgtcgcttctgacagaagaagggagacaaagctccctcctgtgtgtccctggtggtctagtggctaggattcggcgctttcaccgccgcggcccgggttcgattcccggccagggaattgttttacactggccgccctcccgcaggaatcttccttcactacgctgtcagccggcctgctccaagggccagaagcagaacagtctccgcagcggggttaaagccgggcgaaggagggcaagtgctggtggaccacctctcacgacacaccgttcctgtttatctcagtgtccgtcatccgcgggagcagctttagagagcgactgagcgtctcgctccggtgtacacagcccggcaaagatgccagcccccgtggagctgcacccaataagcccaccttctttcccgtcgccaccccggagacgcccatcgggctgagctgcgaataactaagagagaggccaagccaagtcgtggcgtttgtggcagccccggacacgggcaccagccagtcagcggagcctcctcacctccgttgccagcgaaggcgctcgttaggccttgggaagaggcgaccggaggcgatgcccgcgaatttgttaggggggtaagcggcgggtgaggtcctcgagggcggtcccgtttgctgattgagcggtagacggaggcgatgttcgctgacccaacaaggacagcaggtggagtaggcacagatggaaaactgctgccggtgccctaagcagaaggcaggtggaaaaatcagcactaggacgtcgaagcgatggtaccacagtcaaatcccacgacgtctacactctaccaagcacttgcgcacgctcccccttttccattcagtactcccaagaggggttcggaagaaccccgagtccattgtaagctcaggggagagcgggagccagggaggtgaagtgcgcagactcggcagcggcggcgggcagaaccgcgggggggtgagagggcgcggtggctgcggggcgggagccgctgctgagaggcggcctgggttgtcttgtggggtgactgtcggtggaatctttggtggagagtggtttggaagaatggcgaggggcggcagtggggagggtggtgaccctgagcgaccggccagggcgaggaggctgtgctgtccctgcaggccatgtgctcatttccacttacctggcaggggagagaccgtggtcacgaagggggttctcccagagtgaagcttcttcatctcactctagagttgctgatccctgtgatttcctccatgtgggaaacggtgtttgtgctagaagaggctgcgctctttacctgacataacggggttcaagactgacaacgcctcacgcccacccgaaaacgtttacatggcttccttgtctctttttttttctgtcctaaagtcgcctcatcttcacatcccctcttttttttcttccacactcgagagtgtctctctctctcagtaaaagctccaccaaatatttgaaatatctcaaccagaaagactgcaataaatacattatttcattcgtggaaggtacagaccagctagattgagagttgcttgatattttctgctaaacggtgaggcatagagcacttggaaggtttctctttgggccactgtttgtgtactcttgggtttccttcttttccccagacagtatggcgctgtggggccaggggtaaaccctgctttccggctttctggctgcagataaaggcctcagctggtgcaggaatcaaaagcaaaccaaaagacacgtgggttcgccccagtgggtccaagatagagtctgactgtaccaggattccgattagaacagaggttgctgcaggcacaacgcagactactaaccactagagaatcccaaggcgccccacacctactgcccgtcgttttgcttccccacccctctattatttatttgtatatttttttgagagacagaatttcgctttgtcgcccaggctggagggcagcggcacgatctcggctcactgctacctccgcctcttaggttcaagcgattctcctgcctcagcctcctaagtagctgagactacaaacgtgcaccaccacgcccagctaatttttgtatttgtggtagagacgagctttcaccatgttggcccggctggtctcgaactcctgacttcaagtgagtgatccacccacctcggcctcccaaagtgctgggattacaggcgtgagccaccgcccctggtcccccgattttttttattaatgtaaaaacattatgcgatttttacttctttattcttgggcagctacaggttcttgtgattttctctcacatcttctccccatttccccctctccattctgatacatgtcccatcttctctgcatccagccggtgccctctgcacgggcatcctgggctgtcccattgtctagtcctggtctcccctgcttctccctcctccttgtcacgttttcccttttgactcccctgcctctttcccgctcccgccccaccgaccccatctactgaagccgagttgagtgaagggagagcaagcggaacagatgattgcctgaaggcggcgcaaaagaacagaaagagctaccgtgagagccgtcggggagttcagcttcccttgggccctacttggctcaggctggggtcgcagatccaggcatttccagaggcactggcttctgaagcaggcgagggtgaacgcagggtgaaggccattcggccgcccttctggcttcagagtcacgcaatgcacgcgtttctaacgtgcagcaagacgattagtcgactcagcctctccggttttctgaagctttgtagtctgcacagttgtcccgcagaaagcgaatggcaactcctagggtttagtgattgcttaatctatatagagatgaaagcaagcgattgaggttgtctctgtggtgcaatcggttagcgcgttcggctgttaaccataaggttggtggttagagaccacccagggacgtgattttaaatgttggttgtgaccaggcgcagtgcctcacgtctattaatcccaacgctttgataggctgaagtaggggaagcctccacggagctcagaagttcaagaccagtgagaatcccacctcatttaaaaaaaaaaaaatgcagttgtatctatctcctcagacccttcaatgtatttaaaagtgaaagactgttcccttgtgtcttgtgcatcccatgaggacagacagcagaaggtccccctccaagcctcctagaaaatgagatctctgcagaacaaactagcttgtatgtacgggaaacggaaagtatttgaaggaacaaacttcaaaaattctgccttgctttccacaaaaattaacccatcacagtctgccttcaagtggcatcatacctcttcccatgactcctccccctgcctttatgctattgtcatgcattttactttacacctgttataaaccttacaatccatctctattacttttgtttcaagagtcagatgtgtttttgtttgtttgtttatttttgtttttttgttgctggtggtggtgtttttaagacgagtctcactctatcggacaggctggagtgcagtggcacagtcttggctcactgcaacctctgctttccgggttcaagcgattctcctgactcagactcctgagtagcagagactacaggcttgggccaccatatcggactaatttctgaatttttagtagagaggaaggttcaccatattggccaggatggtctcaaactcctgacctcaagtgatccaccttccttgaatcccaaagtgctgggattccaggcgtgagccatcgtgcccggctaaacagtcagatgttaaaattatatatttgcctatgtacatgtcatttctagtgtcttttttttttcatccagattttcatctggtgtcagtttccttctgcctggaggactcctttaacttgtctattaggtgtcttaaacttgcactgtcattcactgatgctctgttcatttaaaaaaaaacttgttggccgggtgcggtggctcacgcctgtaatgccagcactttgcgaggccgaggtggtagatcaggaggtcaggagatcgagaccatcctggctaacacggtgaaaccccgtctctactaaaaatacaaaaaaattagctggctgtggtggcgggcgcctgtagtcccagctactcaggaggctgaggcgggagaatggtgtgaacccaggaggcggagcttggaacctgtcaaaaggcattcttagccttaaaagaaaagccagggacatcccttgcctcaggactctcgaacttagaaaaacctttcaccctctatgtggatgaataacaagggacagcttcaaatgttctaattcaaaggctgaggaattgctttggaccagtggcttatttctctaaacagctagaccaggtggcagctaggtgactaggaagcttgagatctgtggctaccatcactttattgttagaagaaaccagtaagtttaccttgggacaaaaattacatgccataccaccccacccccaccccctgccaccccatgaagtacagtacagagggtcctagaggcaaaagtacaccaatggctaacagggagccagttacttaaatatcagacccttctgcttgacaccccagatgttaccctgaaagtatcctgattttgaaaccctgctactctgttgctgcacctcacatctcaagaaacagatcccaaactcattgactcctgtgtggaaaccacggaagagctctactctagaaggcccaaccttgaagacaagctgttgtctaacccaaatgttgagtggtttagagatggaaatagctatattcatgagggagtaagaaaggaagcttagccaacaagaagtcattgaggccaagggtttaccttctcagacttctgttcaaaaagcagaattagctgctctaattagggccttccaaccatgaaaagacttaagctggacacggtggctcacgcctgtaatcccagcactttgggaggccaaggtgggtggatcacctgaggttgggagttcgagaccggcctagccaacatggcgaaaccccgtctctactaaaaatacaaaaattagccgggtgtggtggggtgcgcctgtaatcccagctacttgggaggctggggcatgagaatccctgagtttgcagtgagctgagattgcagtgagctgagatcatgccactgcactccagcctgggcgacacagcaagactccgtttcaaaaaaagaagaagaaaaccaaaacctcaagagtcaatgtgttgactgactctaaatatgggttcctggtgctccatgctcatgcagccatagggaaggaaaggggactatcaagagccaagggatcccccacacaactttactcagatcttggaacttttagatgctgtccaactcccaaagaaataacaattactcactgcaggggacaccagaagggagacacttttattattagaggaaattccctggtggaaagagcagctaaggccacagctaaggaaaccctggtatttcaggctgctgcgctactaccaggtactgcatccgtgtcagtgacaccatactatacccctaaggaaattaaagggactgagtaaaaggcttccagggagacccctctggatggttgctagaaaagaacaaactctattcctgaggctgacaaatgggaaataattaaacattttcatgattcctcacatttgggacaggattttccatttaaattagtttcctaaatattcttgcggaagggactgttccaaactataaaaagggttaccactcaggaagccaccccataccccgatccctgcttaaacctgtacaacaccaaggaacataccatggtgaagactggcagacagacttaacccagatgccaccttacaggggagtacaagatttgctagtatttatagacactttcaccaggtggatagaagctttccccacaaggacaggaaaagtactggaagtgtctaaattcttaaagaaatcattccaagatttggattaccaaaaggtttgcaaggtgacaactgacctcacttcacagctaaggtgacccagtgaggtcatgcctcagccttaggcattacctatcttcactcctcatggagatctcagtcttcaaataacatagaaagccaatcgcgacattagcaaaactctttcagtttgggggcttgcctgccctgcgtcactatcattgtttccttgggtttcccaggaatgtacatgtgtcagactgccgccctgcttatagatctgtttccctgcaaggaaacaggaatatgttgcctgtggcttccagagttggagatacatgtagttgcacccctgagggctaacatttaattttggaatcaagtgatgcattcagactggttgttatcattctgtggtatatatttagtgaacacattctgattgagtttcctgcttttagctggagcaagaaagtttaataattgtgatttgtatgaaaaaaatcataggcaagggaatgggtgtaaaataaactttattgtcagaggtttctaaaggctcatccttcaaggaaaacggacatatgctgaagagctgataaaccgtctacagcagtgttattctaagctaatcttgattccaagttcttgccattttcctccagctgctgttgactccagttatatataggatgggggaaaggggattatctatgaatgtaggcatcactctctcttgggcagttatcacattggcagactgaagggatgtgatttctacagtcaaactatccatttggagtacaaatctggagtggctgtaaaattcggttctcagagatgaacttgcagattcagactttcaattgttctgttgttttagtttttctcatcaactggggaactgtttgtgactaagctttgttaaaagtagagaagagtttttcatagttccaacattagttgttacccgaaacaaacaaaaacacacacacatacaattaaacaataatctttggtgaggtcttgctgatacctgaggctggagtgagagctgactggtgatacaggccaggtgcaaactgagtgcaactaagtggataatctccagtagtgaactacagtctagaagaagatagtaataatagattaaaaaaaagtctcctgaagtgaaccagctggcgtgtggtgtaggacacaggaccccacccaccttatgattctaagagccttgctcaaagccactgcagttgagttcgctaggtctctaccacctcctcagcatcaattgactctccataatactcctctggagagaaataagggtctttcaacctcccaggaagggatttgcttagcctcaaatatgcacattcaggaatagcttgtcgtaagaaagagaggatagtttgcagagaaataaccctcctaagtccacatcctattccttttaaataagagagtggtgacaagggaagagccctagaatgtcaaagccaacagggtgctcagataccacccaagtacagttccatctttggccataaggagacaatggtgtcaagaggttaaggccgtatgatctgtaggtgaaaaatctgggatgggaatcaagtcctcaaaccttttccactacatcacagagtttaggagcagttagagggaaggcttcaatctggagaacactaacaggctctagagattattgggtcatggtggctgggacagaaataaggattcacagaaagatgtttatagtaaatgttcttttgggattttgcttgataaaaaggctgagcaaaagtaaaaatttatttcttttcttttcttttttttttttttttttgtttagacagtttcactcttgtttcccaggctggagtgcaatggtgcaacctcagctcaccacaacctccaccccctggggttcaagcaattctcctgcctcagcctcccaagtaggtgtgattacaggcatgcaccaccacgcccagctaattttttttttttttttttttttttttagtagagacagggttcctccatgttggtcaggctggtctcaaactcccaacctcaagtgatcctcccaaagtgctgggattacaggctccagccaccacacccggccaaaagtaaaaattttctaattgcaattctgaaccacttaggggttgtgaaatcaatatagtggactgcttattactacaggctttatttaaattctaggtagggtggattacacatagtaaaagattttttaaaaactgatcacaggacaggcgcggtggctcatgcctgtaatcccagcactttgggaggctgaggcaggtggatcacgcggtcaggagattgagaccatcctggctaacacggtgaaaccccgtctctactaaaaataaaaaaaaaaaaaattagctgggcatggtggtgggtgcctgtagtcccagctactcaggacgctaaggcaggagaatggtgtaaacccgggagggcggagcttgcagtaagccaaggtcacgccaatgcactccaacctgggcaacagagcaagactccatctcaaaaaaagaaaaaaaaaaactgatcacaaagaattgtatatttctcactgcgtcttgtggtcagaaaagtttgagaaactactctacataggcaaattacaggtccaatctctccatctacctctttatctcttctctatttccacgctatgcagacaagaccacggagagaggaaggcaaattccatcaatgggtgctgttaagccttttctatgaggtagctgcacatttggggcacttcaatactggttacttgagattctagtagacagattgtccttttcatctctagccacatggtaaaattacttgggagctttttaagactactagtggcttccacccacctggaagcatttaaatcagaatctctatgtgtagagtccaggcacttgtgttagttaaaacctcaccaggctttataatatgacagagtggtttaaagctacggagtagacccaccctatttcctacctttctctttgtttctctttcaccataggcttctttcccatgagaaagtaaagattttagtctctgttttcagagtctcaagtaaatcactctctttctcaactggacttccaaggcaaagatttctttctatttatctatctgcatttttacaaagttggcctctggattcccttttcccaaacctaattcaccacaaaggtgcccctcaagtcaaggagctgggctttcatacacctgcacctgtcaatcatggtaaatattttgcaggcagggttgctgggtgctgtgggattgacgtaaactcccaggtattgccagctctgagcctcaggcaagcttgtgactaaatgactccagtagtctgaggatagtccttactcagaagggtctttggaagcaaaagcaaacataggcatgagagggtaaaaaaaaaaaaaaaaaaaaaaaaaaaaatctcatgtcatcttggcttatacctaacagaacttgtgcaagaatggatattaaggtgggtattgtacagagcagaacttaataaataccaagtctggagtttaagggataggctgaagagattttgcaggcttgtaaacatttttgccaacttgaacacacttttgtttgggtttggtttttctcctcattggtaagagctacgcacaatagggtagctaagatattataatttgaatcgatacatttgtattttgccaaggatcaagatgaactatgatgatttccattttttagtactttattttcatcagtttgaaaattaggacttttgctccttttttggcttgtggcacctttttggttttcacactttctcaaagaccagtaacttagaatctaaattatgattgcttattctttcagtactctaggggaaagttgatttaatcttgacaaaatgtattcagttaaaataattgttctcttaaatctttctttctttctttctttcttttttctttttttggagatggagtcttgctctgtcacccaggctagtgtgcagtggcacaatcttggctcactgcaacctccgcctcctgggttcaaatgactctcctgcctcggcctcccgagtagctgggcctataggcgcatgccatcacgcccggctaatttttgtatttttagtagagatggggtttcaccatgttgttctcttaaatcttttcaccttttaagtttgtccttcctttctccaatttgcaataggggagtgtggctcgcagctaaatagtagacttctcagagctacttattcctggagcctggcagtctgcaggcctggagggggagcatctagaaagcagccctctctaagttgagaataactatgagaattgtgggttataaggctttgagcagctctggcctccccgtcctcttttgtttctactgtgggatgtgacaagagaaggaactcatctgagagagacttcatattgtggcctttcaccgattacttctggaaatttgattcaggcaagccagggagagtgtctggtattcttctctgagaagaagaattcattatacagctggacaatggaatctatgatctgcctgtagaggttagaggtgcatcctgttccgggaaataattacaatttaggcaagttatacatgtttgcttaagagaatgctttctgcacatttcatgttcttcctttctatcttagcctagggagaaaaccgtggggactcagggctggaactttagtgtgatggggcagaagcttaattttcacatgattctcaacaaatggcagcatatcccatgtattatcatgtccaatggctgcaatatgaaggaggcttttccgaaatagttgctgctttggtaaaaaattaactagatggattcaaagtcaaatttgaagaaagctgagcaggcagaagaaacaatcagtgaacctgaagataaggcaatggaaatcatccagtttgaggaacagaaataaaaaaagattgaagaaaagtgaacagagcctaagtgaccatcaagtggaccaccatgtacattgtggaagttcttttttgttgttgttgttttggggggtgggaggggggaaggagtttcatttttgctgcccagactggaatgcaatggcgctatctcagctcaccgcaacctctgcctcctggtttcaagcaattctcccacctcagcctcccaagaggctgagattgcaggcatgcaccaccatgcctggctaattttgtatttttagtagagacggcatttctccatgttggtcacgctggtctcaaactcctgacctcaggtgatcctcccgcctcggcctcccaaaatgctgggattacaggcatgagctactgctcccagccttgcattgtggaatttctaaagaagagggagagaagggcaatagagaatatttgaagaaatcatggctgaaaacttcccaaatttgatgaaagacatgaatacaaacacagtagcctaacaaactccaagtaagataaacctaaagagacctacaccaaaacgcattataatcaaactttcaaaagtcaaagagaatctttaaattggtaagagaaaagcaactggtcacatgcaagaaatctttaataagattatcaacagatttctcatcagaaactttggaagctggaaggacaggaaatcaaaagctgccaacaaccaggaggggtggctcatatctataatcccaacactttgggtggctgaggcaggcagatcacttgaggtcaggagctcaagaccagcctggccaacatgacaaaaccctgtctctattaaaaatacaaaaattagccaggcgtggtggtgggtgactgtaatcccagcgacttgagagaccaaggtgggagaatcacttgaacctgggaggcggaggttgcagtaagccaagatctcgccactgcactccagcctgggtgatagggtgagactctgtattaataaacaaacaaacaaacaaaagctgcccgtgaaagggaaaaggatcaataaatgggtattccaaaaagtcaaaagtcacacaaatatcaagccaaaataaactggtttcctgactggaaatcgaccccaggctatggcagcaaaacacagaactttaagcactgaactgcaaggtagagcagactttattgtgcatcctggaagggatccagagcaggcagtttgagcttatgaagaattttaactttgtttcgggtcaaattttgctctttaatttagttaagagaattttttttccctacacaacacacataatattgtcaagagaatttttaagggtagccatgacactattatgtgtgtttgttttaatttgatcttcctatgaactgttaaaataagagatctctaaaatcttttttttttttaattcaggtgtctaatttaagggatccatcttcaggccattggcaagtagaatttccaatggtgtaattattgcaatagcaattcaaccaaatagcccctttgtggaaagcccaggatgtcattttccaggttaacctcctgggaagggcaaagaagaagcaatcccaaagattcccctgcaagaaaaaagttcaatgcaaggagtagaccacagatgggtaaggatgatgttggcctccagtaacccagatatttatgggggcttccagtcacagacctctgaatctataataccaggtaggccctcttgggattgagctttcctaggactaaccaggcaacaagaattgagatgacaaaagcctcaaagggatgggacttcttaagacaaaccccaagagcttgacatggtcagaacaaaaagtgtgctggggttcccagccattttcagacaggccacctagtatgacctgatagttactgcctctttccagatagtggaaaccaagagaaagcgctcccacttgctcacaagtcaagctctcaaggacataaaataagatgagaaggaacctcaaccggtacccccttttatgacagaataacacatagagacaaagacaaaggaacagacaatttctgggaacaaagggattaaacaataggaattggtaccacaaagtaccaaaaagcacaccagagtcactacacccaagactagtcacacaaatccttttctccaattaatcaagattttggagagggaaaagaaagaaacagtgatttttactgtccacttgatgagattccacacagagaaggaggccaggagcctggctggtaaaaaaattcttacccttatgacagctgatcagatcctgggttcttcactgcagcttccagaagagcagagctttcctatcctgcttacagctccaaaactgtaggggccaatggaaaccctccctcttaaccctctgaagtttcactcaaaaatcaagtcgcaaaaggcagattaattggaaaaaaggcataaaatgtactaacatgtgcatggggagagtcacagagtgattaccctcccctacccacaatgggatgcagaagcttatataccatcttgaggtaacagaatgaatgagggctcaaagcatggccaaaaccaggtgcaatcagagtcagaggtatatccaattattgtggacaagataagtgatggtagggagagaagaggaggcttggctagcaaaggtggtcttaatatgtaaatgaaaccctacagttagcagctctcagagagaataaaccctaaaaatttctttcagacctttacatgtgtcagactctcagttaatctttcctagatctgggcaaggaaagacttggctgtatcaatgcagattccctacagatgcaaatctccccaacaaaagacaactttgcagggctacttctgcagctggctttctgaacagacatctcaaaatatgtcaaagaaatgtagtttggggtcaaatatttttaattccttcacatctacagcctgatgcatcggccgtttcaatgcaacattgttggtggcaactccattcttccctatactcaagccaaaaaaccaggttctccttgaggctagtctttttctcacagcacacatccaatttgtcagaaaacttatgtttcctgtttggttaattacagattttgatctgcccaatctttctctttcttggtctctgaattttggcaaaggagtctcctgatacaggcaggatagattctactgacgattctcaaaaccgtcagacacttaagagccttaatctcggggtaggggtttgggccgccctcgaaccttttctttgggcctccccatcaaaatcagtctggccaggcctgtcttcaaggcccaggggcagggccaggtcctcccgatgcttcttgaagcttctcctgccgggtcagcagccaccctccccttccctctgacctgcagagaagcttcagggggcatttattcaatttgctaggagctcacggatgcaggtgcgcggtgactctgtggttcccaccgcacccaccgccctccttggtcctctcactgtctgaagcgggcagtaatgttcagggtgagcttgggctccgaagacacccagtcaaggagggaccagtagggaagggcactggccccttaggtccttcccagctagggatccgaaaaagttcttgaagaaatagaaagggagagttggaagtagatcaaagggaaagaaagaaaatcctagatttcctatctgaaggcaccatgaagagaaagtccgcctcctctgggccgcgtcctcacgtcgctggtgaaccaagttctgttctccattggagaccaaatcagttgactttggcttgactcctagtgaaggagccccgctttgtcctcccctgtttagctcttgatcctgaagcacttgattgtctctcccgggcttttgatggatttcagggatgcaactgagaaatttgtttttaatgcacttaattgaagtaagaatattttaaagtattttggcaaagaaaaacgtttccttttgcaatgaagacattcagatgtaaggaaaatcactaggctctcacaaacacaaattccatgtcagcaagtagatttgaccctcaggttgggcacactttaagtgtactgttggaacttaagatgaatctaggacattcatgattaatatttttagttttttagtacaatttaatattttaaatttaaatacacattctgaaaattgtataaccagcacaagaaaccggctttacgccatatttacaaacataggaaagaaagatgatattttaaatgacaatgcttcataaatggcaacatttttaaagtacctagagaaaaaaagttaatctagaattctatgcaaaaataaaatttcataactgtgagtgaaataaggacattgaaaaaatacaaaagctaaaagaattcaccaacccatgctgcaagaaatcttaagagtcctccaggcagaagcaaaaggataccagataaaaatgcgggcctacacaaagaaacgaatattggaaatggcatttagaaaacatgtactacacgttttcttataatttaaatctttcaaaaaatatttgacgtaataaataaaagtaataatgaatcacaaagcttatagtgcataaagtaaaactacataacactaggataaaggccagaaagggaggcataatgacactagaaagcagactatgataaattaaagatgtatcccggaaaccctaaagcagcctcttaaataagaaaagggttatagctaataaagcaacaaaggaaagaaaacggaatgaaataaaagctatgtaaacactatgctggaacaactactctccaggcctccaccctatagaaatacaccagtggccaatgagagtgtacaagaatgatgactgcagcattacttgtaatcataaaatgataaaaccaacgtaagtttaaagatatatgaaaagggttttatttatttaacagacagacaatggaacaagcaaacaatgggagcaagtcctttgccaaaaggaacacagagggtcatgatgatgctactcctccaaggatttcagagttcccagacgcctagttttctgtctagttcttctggaagatgttattcttggggagcaataggtcctcgagtttggggctctttcaggttctctctccatttccccattctgctacaataaacaaacaaaaacaattctcacttccagaagatcccgcctgtgcctctgcatgcgcctttcaggaggtctggatgtctggtccaccgctcccgggcttctttcccagcttttgcttttccctttacctgctctcgccctacggccccagggccggaccacggcccagctgagccccgcggctccaccgcgcagaaggtgcgccggaggccctgccagtttcccgccctgcagggtactgagaaatcaacgatttgtaaaaagaacttccccatggaaaaaaatctgttgatttccgctctcagggctcttcaaaggactaaaagctaaaggcgacaatgaattcattcgacaagtcctagtcgtgagccctggtgagtgccagaccctgctccccccgaggggacccacgagcgaccctcaccaccatccctgccctggtggagcccccgtgcggaacacaggatccgaagatggcagcggaagctcctccgcggccccgagagcgactgggcagggtgggcacaggctcttcaatgggtgaaggcggcgcaaagaacgggaagaaccatcccaggagcccacagggcgttcagcttcccttggggccccaggcggctcgggctgggtcgccgacccgggagttcctggaagcttctgaagcaggcgaggggcagggcgggcgaaggcaattccgctgttctggctccagaatctcctaacgcgcaggcgtccaacgtgaccggcgcgactcaccgctctaatctctctggttttccaaggccttgctcggtggtcctgccgggcgggctctgggagtagagggaagggagttagttcagtgagtgggcccttcccatatcaccagtagaagcggaagcgcttgtctctgtggcgcaatcggttagcgcgttcggctgttaaccgaaagattggtggttcgagcccacccagggacgcttattggaacttttgaagcattcatgcattgtcaatcactaggtaaatggggaagattttatcttcccgaagtcccaagccactcatttatgactgatccatgtcaagggccgcccacctccccgaccagattcttaaccggctatctcctgaaatgccgggtttacacctgtgtaacttaggaatcctgaaacagagacctaggaacccacttctggtgtgataaaattctaattcagtcccttatacgcttaaacaagtaattcacgtgcctccattttttcatattttagtaataggagtccagtattacctccaggatgtgcctgggtttcctgattgctctatcaataatgtgaccagtggaatctttcatcatgatagtgatcctctccatcatttttgaaaacagtatttttcctcagtctgtgcatgatttatttaacccttttcaaaatgtttttgttagccaggcatggtggcacacacctgtaatcccagctactcaggaggctgaggcaggagaatcgtttgaacttgggaggtggaggctgcagtgagctgagattgcaccactacactccagcctgggtatcagagtgagactcccatctcaaaaaaaaaaaaatgtttttgagatgatgttggtttcatggttttaggattacaaagaatgctgcagtcaccattcttgtacagatatctttggtcattgtggaaatgtctacactgcagacatttctatagtgtagagagctggatgcgccattgctacattatagtgcttatataatgcttctaatttgagtccattctgcaaatgtgtctttcacgggagcagtaccaaataatattccaatatgaatatttataaaatgaaaatgtgcagatgtgcagttgagctgcatgcctctccatggggcccatgttcataaaatggtggcgttagcaatcatctgagagtggagtttgtggccctctgacgtcaaaatctgaggcaatggacatgaaaaccctcactgtacatcctccgtagtctggccagaatcattcctgggtcggtggtctcttatcaggagggaatgctgcttgctttttttgtcaaaaccacaaaagggagggaaagcatcaggctgttggttgataacagtagtgaagcaagtctctccaaaggcttggtttgttaacccttaggaaaaaaatcctaattcttgccagatggtgccatgcatttccaggctcttggtgtcccaaacaaagaactgtacatgacacacacaaagcagcaaagcaaagcaaaagtttattaagcatagtaacactctcagagtggggagagtggactgacctctgggatgtaagataagtattagtttggtgtactttgggtcgttttatgtgtgtttttttttcttctcttcacaaggatgcctaatcgttagccagtgtttgccttttgattgataggtgggttgcttagttactttggcccttgtgtgcttgcacattggctccatcccataattttaagtacatgcatgatgtgcagtccatatgcatgagttttaatgagctgattatcatacggagtcatgttaaggatactttttttctctcatgcacatgcctatctctgaggagctgcccctttactggtttggatctcgctggccatggggtccttgcttgcttttcttttttttttttttttttttttttgagacagagtctcgctctgttgcacagtctggagtgcagtgatgcaatctcggctcactgcaacctccgcctcccgggttcaagcgatgcacctgtctcagcctcccaagtagctgggagtacaggagtgcaccaccacgcccagctaattttttgtatttttagtagagatggggtttcaccatgttggccaggctggtctgaaactcctgacctcaggtgatctgcctgccttggcctcccaaagtgctgggattacaggcatgagccaccgtgcccggccttgcttgcttttttaaatcttactttttgttttggctgctcaacttctgccttttatcttgcttcttgctctcccaccccatcaccttgcttctgtttctgcttttactcgttctgccttttatccaacttccaattccctctgctgttctcctgcctcataatggcagttagtgagcgggggttttgaggtggcatgtccaacctcctagcctgccacatccagaaactgctttcaaggtttctctgtggtcctgtcagccaagagggagtccgcagttgactgtagggactagggcttattttcatttctcaatcctgacaaggtaaggctggattaacgcagattctctgcaggtgtaaatttcccctacagaagacagttttgcagagttccttctgtttgctggttctctgacagccatcttaaaatatgccaaagaaatacattctggggtaaaatattttgattctcttcatctatctacagcttcaccatgctggcagcctccaatccaagcatacctgaaaccttcttttttttttttttttttttttggtttgagacagagtctcgctctgtcacccaggctggagtgcagtggcattatctcggctcactgcaagcttcgcctcccaggttcacgccattctcctgcctcagcctctggagtagctggtactacaggtgcctgccaccgcaccagactaattgtttgtatattttttagtagagatggggtttcaccatgttagttagggtggtcttgatctcctgacctcgtgaccacccacctgggcctcccaaagtgagccaccacgcccggcccctgaaacctttctttttaaaaagctttcccacctttatgactgccttcaagtctctgccaaaacacaagtaacagtgactgactccctgctataccaagctcacagtaaatagcctttgctgtttttcatttggttggtctttgtttatttgcagaagcttcaatgtagagttgacaaggactccaatctttgaccaaaccttagtagtttcctctgagcccttttctctgttacttcttggcctgccaagtccagctttaggaaagaatcctgttgagtctagtttagcaagagtcctcgcaaccacctttgatagctaatcaagttcctcttagtaattttccatccactgactttcttatcttgccaattggctataatcctcaactcctcctgctgtatttgaggttgagcccagttctctgggctcaacctcaaatacacgtgtccagtgcagcccctcagaaactacctttgcaaaattatgacaatcagagaaagctgacatggctgactccatcttggttctagcctcacaggcttgctgtctttgctcattcctgtgcaatttctcccaagctatctttgggaaaaattgagtttatagtttaaatcagggctccccaatccccagggccataagacaggtactggtccatggcctgttaggaacccagctgaacagcaggaggtgagctgcaggctttcgagcattaccgcctgagctctgcctcttgtcagatcagcatgagcattagctgctcatcggagctcggaccctattgggaactgctcatgtgagtgatccagattgcgcactccttatgagactgtaactgatgccactgatgcctgatgacctgaggtggaacagtttcatctggaaaccatccaccacccccttccatggaaaaattgtcttccatgaaaccagtccctggtgacaaaaaggttggggacagccaaaaatctggtttaaatgataaccttccccaaaactaaattacccctgtaaaatgaatgaaaggccaccaagttagaaggatgaaagcggcctgatttctagtaagatgtatgcctccttaaataattaccagccattattccagaagtcacaagattggcagcttccccagttactgctgtgaagaacatcactattgtagaacctaagattggcctcttgagatgtcttttcaggctttggcatttctgactgctggatggcaccatttggcccgaaaatcaaccagtcccttagcccccacccagaagctgactccatgcaggagggccattttccatgcccctgtgatttcatccccaacgatcagcaccacgcaagccctagccccctccccaccaaactatctttgaaaaaccccttacctccaagccttcagtgagattgctttgagtaataactcttgtctcccacatgtcgtggctggcctgtgtcagtgaaactctttcctgcagtgccatggtctccatgaattgattttgtgtgtacattgggcaggaagaacccatcaggtagttacatctgcaggatggtgccagttctttccacaaaggctggtcagatacccagaaaacatttctccactactacctggacaatgtgtctccctgtcaatctccagggaatggggcctggatcaagtatttagtattcagcagttactacactgtcacctaatccctcattttcaatatcttgccatgccttccagtggcctaactggccaccatgccacagaatctttatggtctccaaggagaactctctacttgatgttttgtgatttgagcaatggaatagaatctgatactggtgggctgggggaggtacccggacactggtgggatctcgaccccagccgtggtgtccaggctcttgacaccatcgcgagaacaaagtcaaagatgagtcagcagatagtgaaagaagagatttattgcaaagcaaaaagtacacactcaagaaaggggagttcaggcatacccaagagagaacaatggattctggggtttcatcttgatgggtttctttaaccaaggagtggaatgttcatgaaaattcctgggtaaaggtggagatttctcggaactgtggtgccatccatttttacatcaaatattggtctcagaactgtcatggcactggcgggtgtgtgatttagtatgttaatgagcatataatgagggcctaggtaaaacctccgtcaaatccagcaccacattgggtccactcagccttagccagcttggtccacaccctggtttttcagcgtcttaacagcccacagcctcaagtcatgtaaatctgctgcctagaatttgttatcctgtgaccaccctgtagtattcctgtctgaaatctacttgtaaatattcaaatggtctttcacttgggcattccaactttgcttacttcacagtgtttcctgcgtaatatataagaaaagatgatccagacattgttaaacatctcaaataagatgtagcccaggtatttgtgtcaaatttggattattttgatttcgtctttgcagaatataaaaaactaacatgaggtaagcactaaggtgtggagatggctgtgcaagagatgacaaagtccagcaccacgcttgagagtgtccaatcatctcttctggggcagcatagttttctacaatactgattttggaaaaaaaatcaaaaaaaaaaaacctacaagattcatgaaactggacaactgtctttataacattaccagtgataaaaccagtaaggaaggctggtttgcagtcatctgagcagcctctttactttcataaacatggtttctctcggcttccaattgcaagtggaatgctgcatcacagggataaagatgtgaagagaaccggtttcttctgtaatccgaaacattctagtctgcgaattaaaagccattatttgaagaaggatgccccggctccatctggccaccgaaaggttgctccttaacacaggctaaggaccagcttttttgggagagaacagacgcaggggcgggagggaaaaagggagaggcagacgtcacttcctcttggcggctctggcagcagattggtcagttgagtggcagaaaagcagacggggactgggcaaggcactgtcggtgacatcacggacagggcgacttctatgtagatgaggcagcgcagaggctgctgcttcgccacttgctgcttcgccacgaaggagttcccctgccctgggagcgggttcaggaccgcggatcggaagagagaatcccagctgtgtgtcagggctggaaagggctcgggagtgcgcggggcaagtgaccgtgtgtgtaaagagtgaggcgtatgaggctgtgtcggggcagagcccgaagatctcatacttacctggcaggggagataccatgatcacgaaggtggttttcccagggcgaggcttatccattgcactccggatgtgctgacccctgcgatttccccaaatgtgggaaactcgactgcataatttgtggtagtgggggactgcgttcgcgctttcccctgactttctggagtttctaaaagtagactgtacgctaagggtcatatctttttttgttttggtttgtgtcttggttggcgtcttaaatgttaatcctacagtggagggctggcgaataggaagtaacatgtcgcctgcacgccataggagaaaaagcgagcatcagccgtatcggctttgtaacacaaattagctatcgtgaagtccgctcagctcttccctttctaccctggctgctttttgcagggattggtccgtggtctccagtctcttgggttctcaccctgtgtgaaaatcttcctgtttttccctaccccccaagtcacctcttacacagcctctgcttccaagcgcagcccccacaggagtttgtaggatttctgtgctagcggggagtgtgttctcacctcatagagccaggtagaaactacgcagatgggtgctgttctccaggaagaaagcagggcctttggggctctcagtgtccccgttgggttgtagacataacacgcttactttgcgtaggggaacggctctgccggcccccaggtgccctcgcgcatattcatggaggcccgtaggtcagaaccgcagtctcacctgtcttggcggaaatgccctgcgatcctcccggagatagaaggcgggaagttttatgaggagccaggtacagtttccctactatctccggcagttcatatatctagtgtttcttcagactttatttaagcgacagcttcttgtttgatgtctcgctcccacatcctacatccattgccaggcaactttctagatagcacccagacccatccttcccacccccaagcagccgtttcctatttctggtgccagtgtcctccccagtccctctttcttcaggccctcgcttatcaccttcatggacagaaaatacttagctctctctcaacctgcggtttatacctgacacgcgtcagtaccctgacaaattccttaataccctttctcaaatggcactgaaaatgcatttctttttaactcccagaagtatctaattggttttgtccctgaactacatgaatactagtattccactacagaggaaaaccccaggcctagcgatggcggttctgggcattgtgccagcctctcccagggtatgttttctgacatcacctacttttgatcaactgaggtcaggagttcgagaccaccctgaccaacatggcgaaactccgtctctactaaaaataaaaataaaaataaattgccgggcatggtggtgtgggtctgtaatcccaactactcgggaggctgaggcaggagaatcgcttgaacccggcaggcggaggttacagtgagccgagatcgtgccattgcaccccagcctgggcaatagagtgagactctgtctcaaaaaaaaaaaaaaaaaaattagtccatctgagacattgttgttggagacagtagaatcctgcatccaacaggcacttggtgcagatctgaacccattgagctattggctcatgttccctatgttctattaagtatcatgagcagaaattgagctctttggcttttacccactgagtatggctataggacaggtctctctctctctctctctctctctctctctctctttctcattatttgcatcattattttttgccatcagtgtgggtttttggttttgaggctatgaagtgaatttctggggacaatctctgttgggtcgtgttgacaaggatccagtccctgtttggtgatacatgacagctaatctggtctgtgagtcttctttattgtctatttattgtcctgagaataatggtatttcctgaaatttgagactgcagcaatgataagttgttcagatcttgtctttccaatgtttggtaaaaattttataggcccaattgttgtcaatatctgcaagagtggcatctctattacaagagtgatcttactactcaatgtcccccctcccacccaacttcatttcctaggggctcttggctttaacgaatttactgtatctaaaagacatcttagtacaggaagaaaactaaatctgtagcatgtaaggagcagttttctttgattggtatattcaggtttctaaccagctgaaaaattcaaatacatgtcctttaaggattaagtttaaactacactacagaaagaagagaaaagatttatatgatcacatataagcaatggaatcagcaatatgagcacttttcacaactatataaatcaaatttagtaatctccagaacattaaggaagttcagcccttaatgaaaatgaatgaaaagaaattattcacccactgttacatgccctggaaagagaatgccctgcaggactcaaaagggtaccacaatattactcagattttcagcaatgaaggccctccaaggatctaatgatactcatattttcagtttatttccttcactgataaacattgttaatagataccattgcctctgttttcactttaagtgatgttacttagcacaattcatttctttagaatgccccctagtttagtgaaaggaattttcctgctttataaatataggatattttctcatgaaacaagttggcgtactctttcagtgaagggactagaccgattaggtctctaaaatgttaaaggagtcactgcctccattatcttaggaacaataataatcacttatataaaattaaaataagaaaattaagccaggaatggtggctcatatctacaatcccagcacttaaagagttggagaccagcctgggcaacatagtgaaactcctgtctctacaaatttttaagtattagctaattttttaaagttggcagggcatgataatgcatgactgtaatctcagctactagggagactgaggcaggctccagtgaactatgattgtgccactgccctccagcctgggtgacagagtgagactcccaactcaaaaaaaaaaaaagaaaagaaaatatagaatttgttgaaaattgttttactacaatgctaggctgcatgtcttgcacctgtactcccagcaactcaacaggctgaggcggaaggattgctttaggccagcggttggagaccagcctggggaacagggcaagacctcatctctaaaaaaacacaaggcaagctgagccaggaggattgcctgagcccagaagttccaagttggtcagctatgattgccctgctgcactctagcctggataacacagcaagaccctgtgtcttattttttattttatttttactacttatgcttatttatttatttatttttgagacagagtcttgctctgtagcccaggctagagtgcagtggtgccatctcagctcactgcaagctctgccttccaggttgaagctatttccctgcctcagcctccagagtagctgggattacaggcacacgccaccacatccagctaatttttatgtttttagtagagacagggtttcatcatgtttcccaggctagtctcaaactcctgacctcaagtgatgcacctgtctcggactccgaaagtgctgggattacaggtgtgagccacctcgcccaggctccttatgcttgaaatgtgaggtttcattagggaaaaattttcttgttgaatttctaacatgaaaaaataatagatttagctgtagattaaattaatggtcttgatagtttggtacaataaaataaatgaaatgaagttgatagcagagaggaatttttgatgcttttggacaatttaaataatgtaatatttaatatataaagacatgaaaaagttcattacattattatatttatttatttatttatttatttatttattttgagacatagtctcactctgttgcctaagctagagtgcagtggtacaatctcggctcactgcaacctctgcctcccgggttcaagcaattctcctgcctcagcctcgtgagtagctggaattacagacgtgcgccaccccacccagctaatttttgtatttttagtagacacagggtttcaccatgttggtcaggctggtctcgaactcctgacctcatgattcacctgctacggcttcccaaagtgctggggttacaggcgtgagccgctgcatctggtctattatgttattttttaaaagtcagtgtgactcttttgacaaattagaatggtttaataatcttggttaggctgggcatggtggctcacacctgtaatcccagcactttgggagcctgaggtcaggagttcgagaccagcctggcaaacaaggtgaaaccctgtctctactaaaaatacaaaaattagccgggtatggtggggggctcctgtaatcccagctactcagaaggctgagtcaggagaattgcttgaacccgggaggcagaggtttcactgagccaagatcgcgacattgcactccagcctgggggggcaacaaagtgagattcggtctcaaaaaataaataaataaataaaaataaagtataaaaaattaaaattatgtgttcaagtaaattaaatatatggcaatgaaaaggaggcccagcatgactgactgcattttgctcctaacccttcctaccctgtggtgatgtctttcaggctaactgctttttcttctttctgcacataggccaagctatctatgggagggatttagcttacagtttaactttaaagcacagatgataataatcctttccccaaactaactcctgagaagataggcaggttgttgaagatttataagagcagtgtgacctgacaaaggacaaagaattttcaccatccccttgggctctcactgcagcccatatgtctgtcattgtcagacctcttcacctcaaccgcctccttcttcctcccttccctaacgtacaaggaacctgaaaatcatattaatttaagatggttctttaggatgttagttcaccatctgttcagtttggtggctctctggaataaagtcaccttccctgcccctacaccttatccctggacttattggccgtcatgcagcaagcggtgagtgcagtaagccgagatcacaccactgcactccagtctgggtgacatagtgagaccttgtctcaaaaaaataaaaataaaaacagagaaatttggttttagaaccagacaaattaaatgggagattacttccagtgagacctagaaatttctaaatttctaaaatttctaaaaaaactgagaaaattgcctccattgaggaagtaagctgaaggaggtaaactgtcatgttttctgaattgagaaatattgaggaggctttgtctctttcacctccagctgctccttctcctcctgcccctgcacctgcatagtctttcttacctgagccttcctgtcctgccttgcttcttcttccatcaccaccacctggggaaagtccccagggctctggccacttccccaaaacttctgttctgacagcccctttaaaggtaaaacccaaacccacaggaagaggggagcctaccattgtgtataccacttcaccaaaacgtgaattaagaatattataaaggacttccctgatctaaacttaaatacatttcactcttctgtttctaaagcaggctccgagattctataggctctggcagaaaatttgacttaactgttgaaacctttgagcccaaatattctgacctttatcaatcaattcacatgctggtgaagaaggcaaggccactaactggttgcaaaggcaaattggaaggattttcaaaaagggactgaagcagaacatgaaaggttcacattttcaccaaatatctccatgttgccactccccaggtccttcctaaaaatatagattggaggataattcagcattgtactaaaaagccagacaaatctgtctttgcttaattaaaatggtttgagagccaggtgtggtagctcatgtctttaatcccagcactataggaggccaaggcgggcggatcactcgaggtcaggagttcgagaccagcctgccaacatggtgaaaccctgtctctactaaaaatacaaaaatcagccaggtggctactcaggaggctgaaggaaaagaatcgcttgaacccaggaggcagaggttgcagtgagctaagatcctgccagtgcaatacagcctgggtgacagagaaagactgtctcaaaaataaaaattaaaaaaaaaaagaaaaaatcagcagcgtagtagaagtataatgcacacaagaatgataatcatgaagacaatctgattctagaagagtaagggaacctattccattagagagccaactgaaaacatcaaatcccagttcacaccccagggtgtgggggcacgtgcctgtagtcccagctactcgggaggattagtaaggaggtttgcttgaatatgtgaggtcaaagcagaagtaaaccctgatcatgccactgcactccagcctgggtgacagtgagaccttgtctcaaaaacaaacaaacaaaaaacccacaaaaccaaacaacaacaaattgtcacctcactctgaaatgacagtggcaaacatcactttgctattggaaaattaaaagaaaaacactccctcttgctatcaacctgccctcttgctctaacatgtctgacccatggtttaaaatgcccaaaagctgatgtactcaaattataatacacttacctgttctgcaccagcatttatttttgtctggaggagatcaccatccatggtcctgtaaatgtctaacggcatggaatgatgaagggcagtgtcttttaggatatttggttatatctatatatatggctctgaagaaacccaacattgggcgagttccctcaaacttttcactaggcatgaccactgctctattttagatagagattctgtggggcaaaacctgagaattatctgcctggctatcaagaagatagctccttgcatttttttggggagaacacttgcttcaagggagtgtttcctcccaggattacaaatctttttgtaacctcaggaaacattgctgatgaaaaccaggcatggtggctctggcctgtaatcccagtgactcaggggctgagacaggagaatcacttaagccaaagagtttgaggctgcagtgagctatgatggcgccactgcactccagcctgagccacagagccagacactgtctctgaaagaaaaagaaaaagaaagaaaaacattgctgatgaaactgcggcctcttttgcagctctataaaaaggtatttagtcactggctaaggttgtactagataatcacatcactttaggtgatacatttagctgagcagggagatgtgtggtggcaaataccttttgttgcatatacatatacatttcccatgtagtagaaccttctctagaaaaaatcagaaaagaagccacttggctgcaagaaatcactaaagaagaaatggggtttgatgttttccctgatgttttcagttggctgaaacatcaaatcccagttccctggttcccttactgttccaggatacagattctctttgtgatgatcattcttgtatgcattatatttctactactcaaattattaatgttatgtatttctcattgttttacttcttttgagaaactaaattcatggtactctgaaaactagagatgattcaacaagtgacagcaactatagaattggccgagatatctctctctctctctctctctctttttttttttttttttccatgttgtgatgccacaccagttcagcttttggacgctgttaaaaagagaggtctccttccctcccctgacccccgtgtgggacaggactatctgggaatgagccattctggcaaggagggacacagcttttgatcgacaatgctttcaagaaatactttttttttttttaaacggagtctcgctctgtcgcccaggctggagtgcagtgggcgatctcagctcactgcaagctccgcctcccgggttcacgccattctcctgcctcagcctctgcgagtagctgagactacaggcgcccgccaccacgccaggctaattttttttttttatttttagtagagacggggtttcaccgtggtctcgatctcctgacctcgtgatcggcccgcctcagcctcccaaagtgctgggcttacaagcgtcagccaccgcgcccggccaagaaagacttttcatctaaagggagaatggggaaagaagagaacttttttattttcaaattctcaggcccagcgaggcattacattgagacagcaaccacattctgcttcctttttgtacactactgtatttgaaaaacaaaaaaacaaacctacaagactcataaaactggacaactttctttataacactactactcgtaaaaccagtaaggatggctggtttgcagttatctgagcagcttctctagtttcatagacatgatttctctctgttattaaagggctcccaattttaagtggaatgctacttcacaaagataaccaggtttgaaagggtccggtttgctttgtaatccgaaacgttccagtctgctattaaaagccattatttgaagacgggtgcacaggcttccagctgcccgccagaagggtcctccgcaggacacaggttaagtaatcacttcttcgggggagactagatgcagggtctcggcgcacctccccaaaagacaagggcgagacagaaaggagggacaggcggacgtcacttcccccgccggctgcggcaccgggttggtgggctgagtggaggagggtggggcggaagaacagaaggggactgggaaaggcactgttggtgacatcaccgatagggcgtttctatgtagatgaggcagcgcaggggctgctgcttcgccatgaaggatttcccgtgctgtaggagcaagtccgggaccgctggctggacgtgagcgtcctagctgtgcgttagggctaggagggctcagggtgattggggattggctggggtggtgctcggggcaagtgaccgtgcgtgtaaagggtgaggcgtatggagctgtggcggggcggaagttcacatgtgtggtatgtagagcacatgttatggttatcaaagtggtttactgtaaggctgagggctatgcattctatggctatgttgttgtctcttatttttccaaacgtggaaacctctgttttgtaacttgtagtaataaggtagaaattaaaaagaaaaagtattttcctgtacttgcttggctgcaaggtcaggaacagatagtttctgaaaaaccacatcgctgagaaatgagttctggagactctcttaacagtctgttatccctaggaaggataagagcaagaaacagcaaatgcttttattaccttctcttttccctttaccatttctcactattcaagttttgttaagttcttgatttcccttcagtgcagctgcaaggtcaccagctattcttgcctcgtgagacctgtcacagtttgactagctgcctttgttctgcttctgtaagccctcttgcctgccccgcgagtttggtgccatcatagtcccaccatgccattcaaactagccaaccccctttttgaagtgtgtataaaagtcaaaccctgtctttgttcggggctcagcctttggattttaatcctctgggcctgagggcactcaataaaatcctcctgttccacccattggtctctctgttctcctgattcccacaacagtagtaggggactgtgtctgcactttcccctggtctttcacggtatgaataatagccttttttttttcgcctatagtcgcaggctcggtctcagtgattttatggtgtggtcagctgtttttgtttttgtgagaccttgtttactgtcctgggacagatgtctgtagtcacttgtttccttgggaggcaaatttcagtctctgtggcagaggtctctcatgttagctgtggtggtacttggcaggcggagctcagggatctaggcttccctgctttgtagactgctcaatggtccccaaggcctactggcttttaccaccacttgaaaaccttagtgtttttccactgtccccagagtcacctcttacacagacttattttgtttgtctttttccccgagacagagtctcactctatctggtagcatcttggtttaagcgatcctcccacctcagcctctggagtagcagaggcacgagtcaccacagccagctaatttctgttcttggttttgttgtggtggtggttgttttgttttttaagagttgaagtttcaccatgttgcccaggttggtctccaactcctggactcaaataatccgccctgccttggccttctaaagtcctgggattacaggtgtgatccatcacacctggccagcccctgcttttcactatagcattcatgggagtttgcaggatttctgtgctggggggaacgtgtactcagctcatacagccaagtagaaattgtacttggaactggtgccgttgggttgtagacataacatgcttgctgtttgtatgggaagggctttgccagtgctctgtgcccctgtgcagggcatccaggcctgcaggtcagaacggcagtctcacctatgagtttgtgtaatacgcagcaattctccctggaatataagatgggtggtcttgtgaggttcctacaagtaagaagacaaatttcccttcagtttgtattgacaaaattcaaaattaataataacagcccaacctcttgaatgataaatgtcctttacattgacagaccagaactgccctgcttgcctcagctcctctgtgcaggtgcagctcacaattccccccacacaggtcatttcctccctgctttctccaaaagagggagacagcagttctgcaggaccacagggctcaaggccttccagggccaaaaatctcagaagaagttgcccgttctgcctgtacctcacgactgacctagaaatggcctttgctaggagcaaagtagggggaaatggtcgccagagctggggcctgggtactgggccaggttaccccacaggaggggaagtactcagggttagagggggccaagcaccaagacctcagcatcctcaacctccaaaaggactcagagagatgcagaaaccgagacagggttcctctttcaaggaaagagacttttgaggaagaccccagggctctgaaccaaaatccagatttttccccatctgcagcttaattccaccttagttggtgcaacttcatccttcccctatgctcaggacaaaaaacagttcttctataggctggtcattctctggccccatacatcctattggtcagaaaattatgttttttctttggttaactgcagactttggtctgcacagtctttttctttcttggtctgaaaaccacccagtagtcccatatgtagcttttttggataaacctagaaattgaccctgctggtcttaaagcttgaaacttaatatttgtttcgtctgagttccttcctcaggaaacaaccttcaggcctctcaaaaaagccatcaaagaactgaaattcatccagacaatgagatgctgggacccctcattcatcatgattgcttccttgctcctccctagttcctgttttcttacacattgttacatttcttccctgccatataaacctctggttttgttggtcagggagatggatttgagactgagttctcatctcccccactgcagcaccctattaaagcgccttccttggcaataatcatctcggtgattggctttctctgtggcaaccagcaggaatcccagatctctgaattttggcaaaggagtctcctgataaaggtgggatggattctactgaccaacatcaaaacgatcagacatttgaaagccttaatctcagggtcggggtttgggccgcccttgggccttttccttgggcctaaccattaaaatcagcctagccaggtctgtcttccaggcacaggggtagggccagatactcctgatgctttttgacgcttctcccactgggtgggcaacaaccctccccttccctgtgacctgcagagaagcttcagggggcgtttattcaatttgctaggagcctacaaagcacaggtacacggtgactctgtggttcccactgcacctgccactctccttggtcccctcactgtctctggcaggcagtaatgttctgggtgagcttgggtgctgaagacacccaggcagggagggtagggaaaggcaccagccccttaggtcctgcgcattagggatccaaaaaacatctgaagaaacagaaagggagcgttggaagtagatcaaagggaaagaaagaaatcctaggagatttcctatctgaaggcaccatgaagagaaagtccgcctcctctgggccgcgtcctcctgttgcaggtgaaccgagttccggtctccattggaaaccaaagcaggtaactttgccctgactcctagttaggaagccatgctttgtcctcccctgtttagcacttgatcctgtagcacttgattgtctctccctggctttctatggattccagagatgcaactgagaagtttgtttttaatgcacttttccttaaagtaagagtatttcaggccgggcacggtggcttacacctgtaatcccaacactttgggaggcagaggtgggcattttacttgaggtcaggagttcgagaccagcctggccaacatggcgaaactctgtctctacgaaaaatacaaaaattagccaggtatgttggcaccggcctgtagtcccagctactcgagaggctgaggcaagagaaacctgtgaacatgggaaggggaagttgcagtgaactgatatcaaaaaaaaaaaaagtatcttttggcaaaggaaatgatttctgacaggttttgcacttaagacactcaggtgtgaggaaaacatgaaaaccactatgctagggaaagcaaatgctgttgagaatgtctcataaacacaaattacatgtcagcaggtaggtttgaccctcaggttgggcacattttactttaagttcactgtcggtggaacttaagatgaatctaagacattcacgatgtatgtatgtatgtgtgtgggtgtgtatacatatacatatatgtatacatatatatacacacacacatatatatatatacacacatatatatatgtctctcatatatatatgagagacagagtcttgcaatcttgcccatattggtctccaactctgggcctcaagcgatcctcctatctccccatcccaaagtgctgggactataggcatgcaccacctcgtccagcccattttaatgtttttaatttaaatacacattcccaaaattatataacaagtacaggaagcccactttcagccagttttacaaaaacaaagtggcaacatcctaaagtactgaaagaaataaagttttcctagaattctatgtcaaagtgaaaaatctttcaagaatatgactgaaataaggacatttaaaaacatataaaaaatgaaagaattcagcaacccacactacaagaaatgcaaaaggagtcctccaggcctaaagataaggataccagacagaaatctggatctacacaaagaaatggagactactgcaaatcggtatgtacatagttaaatatatatgttcttattatttaaatcttttttaataatttatttattttaaattatttatgatttaagtctttttttaataattaaaaaaagcaataataatggattctgggatttataacatgtctgaaatcaagttacatgacaacactagcataatggccagaagaggaggtataatgccactagatggcactgataaaggtgtattcaggaaaccctgaagccctcactgaaaaggcaaaagcagggaaagaagtcggggagcggtagaccagaagaaagaaagagttatagctaataagccaacaaaggaaagaaaatggaatgatataaaaaccatgtaatcattatgctggaacaactgctcttcatgcactccagcctgggcgacagtgaaaccctgtctcaaaaaaaaagcccacccctagggctgggcatggtggctcacgcctgtagtcctaccacttggggaggccaaggcaggttgatcacctgaggtcaggagttcaagaccagcctggccaacatggtgaaaccccgtctctactaaaaatacaaaacaattagccaggcatggtggtgggtgcctgtaatcccaggtactcaggaggctgacgtaggagaattgctagaaccctaggaggggaggttgcagtgagccgaggtcatgccactgcactccagcctgggcaacagagcgagactcatctcaaaaaaaaaaatcgtacacttaaaaggtcacggaggcaagcaaaaatcacctggtggctgcaaagcagaccatcgagaggcaaaactctttatctggggaatttagaggcaattagacttccttattatttaaagcaagaatctagttccaggcttctttcccaaaaatttataactaactagaatttctggggttttttttttgttgttgtttgtttgtttgtttgagacggagtctcactctgttgcccaggctggagtgcagtggcgcaatctcggctcactgctacctccgtctcccgggttcaagcaattctctgcctcagcctcccgagtagctggaattacaggtgcccgccaccacacccggctaatttttgtatttttagtagaaacggcgtttcaccatcttggccaggctggtcctgaactcctgacctcgtgatccacccgactcgccctcccaaagtgctgggattacaggcgtgagccaccgtgcccggccagtaactagaatttctatacatctctggaatacgtgcttatcaaaacttgtgcaacccttgctgacattaaggcaccaaaatgtctacaaatgtagtattctgtgagccaccgcacccggcctacaaaatgtttttttaaaaaattattgtgttgggagtgaattattgggctggtggctcatgcctgtaatcccagcacttcaggaggccgagatgggtggatcacttgaagtcaggagttccagaccagcctggccaacatggtgaaaccccatctctactaaaaatacaaaaattagctaggcgtggtggcgggcacctgtaatcccagctacttgggaggctgaggcaagagaattgcttgaacccaggaggcagaggttgcagtgagccgagatcgtgccattgtactccagcctgggtgacaagagccaaaaaaaaaaaaaaaaaagaaagaaatcattattatttctacaatatgggcttatccctgtattactcttctgaacttttcacttaatatatcgtaaccatctctccagtcattgaatgttcttctataacatttggaatgatatcatagtatcccattatatgaataacccatggtttattatacaagtcccctactgctgaacgtttaggtctttctaactttttgctattaaagtctggcatgatagactctgcaagttagccttcagatgcccagcaaatccagttaaccagagcactgtcctctaagcctcctggtgaatgtggttttgctgatggtgggcagagtccaccccagccgagccgctggatttggcaggcacttggccttagcaacctgagggtggtaactccaatcagttacttgtttccctgttacctgagttgcagatttagagccctctgcagtgagcaggtgagcacctggcatgattcttttctggtgagtggtcctgggggtcactgggccagtcaccacctggtgacaggacagggtgaccggtgggtggcagcactggggattcaaatgaccgcagcccggtcaggctgagctgagcagagccaaggactcagcacagcaaggaacctaggctcttcacagagaagggagctggaggaccccccaaggagatgagtatgtgccaccctgcggcagggtcctgtgggctttgggagtgagagggtcaaggggagaggagctgtgtttgccaccccctgttaaaaacctcaagtgaagcagcatggtagagaggaaagagcatgggattggaagccattgaacttcctgctgtgtgtccttgggcaagtgactacatgtctctgatcctcaatctccccttctataaaatggagatgatcctagaacctgcttcacgggagtgttcagaggggactgtagacagagcgggaacatagaagaggaagtaggcggcagtgtggttcacagccagcgcaggctgcctgcagggtgcaggtactgtcaccaagggagacccaaggtgccctggagggagtggcaaggacacaggcctgagcccagccctggtgatatgaacactggagtgggcttcacagggacaggcagcatcagaactggactagtgaggtcatgagcccaccagggcctgggtagggacatagcaagtctggggactccagacagggtcacacagacctgggccatgctgggcatccagggactggctgtgcatactggcagatgtcagtcagccctcctgcagttgggccagggacacctcagggaaactgtgaccttccttccaatcttggtaacatcacccttccaccccaaatcccagggaatggcccgaatctctcctgacaaacagctctcagccctggtccaggccacagtcttgcttgcaccgggccgggtttcagagcccgaagggcacactggcagcctttagtgcagtgtttcagatgtcacagacaggttcctctttgacgaagatggaacttccactgcttccctcctaccacgcaggaaacacagaagcaaccatcagccgagggcctgctggccgttctctctgggtactgtgtttggaaaaagcacaaaatcattaacttaaacatgctttttcaaaccaaacacatccctctcttagccctggagattcagagctgcctctccctttgaaaatgaatgatctcgcccgggtgcagtggctcacgcctgtactcccagtactttgggaagctgaggcgggtggatcgcgaggtcagcagtttgagaccagcctggccaatatggtgaaaccccgtctctactgaaaatacaaaaattagccgagcgtggcggcgggcgcctgtagtccaagctactcaggaggctggggcagaggttgcgtttagccaagatcatgccactgcactccagcctgggcaatagagcaagactccctcaaaaaaaaaaaaaagcatgatttcatccaatgccttcaataacagaaggaggtccaagtccagtgagagggtggaacgaacatactgtcacagtggaaaggacacgagacaggcgcgccaccgggttgagtctcgcgaacaaactgaggccagagtgccttccccagggctgcacgtcagtcaggaaaaaaaaaagcattctctccgacaggtcaaatcaccgaagcctcgggatcgtcgctgggggctgtgacggggctggcatgaaacgtccctctgtctggctgggcgatgggtcagtgctcaggagtttcaggcctttaaggcccggccagaccgcagggggactctgcagccgggtcggggtttcgatcctgcgctgcggccttgcaactgcgaggacttgggggtcgtgcttcgttcgcctggtatcctcgttcgtgcgtgtaggaggcgcctggcttgccgggcggtgccaggcggcaagagggagggcgcacggagcgtgtccgcccagggcggcccctgtaagcgctgcagaagcgctgctcccggcgcccggccccgccccagcctccgccccactaccgcgcagcgcaggctccgcccccagttttccccgccccgtggcggggacgccccgcccggtccggcccgctcggcctcggcagcagcggctgcggcgaaggcgcgcgaaggtaggtggccgggggcgcgcgcgtgcgcgggggcgggacggacgcgctcccggcggaggaggccgcgcgcctgggggcgggctggagccacgtaccggggctgggggcgctgtgtgttccgcgactgccgcggcccggcaccggaggccaggagagcgttcccaacaggctccgcggatgccccgccgcgtcctgccgcccatcctgcccggattgtcgcgggccgggggcacgacaggagactggggcctgcagggcgcagccgtccctccgccggccggggtcccctcgctccgcgggcggccgtgggaggccctcgcgacggcctctgccccccgcagatgccctctgcagctcctgcgtgcgggccccgccctgcactgccctcctcgtgtgggatccggtttcgtcttcattgcagccctgccgagtcggaagcatctccattgtgcggatggggaaactgaggcccagagcgcatagttgggctggccacggaggcagggccgccggatgctgtgcggggatggggccctgcaccccttgcgcctctcaccatgcggcctcaggcctctgtgcccggcagcgtctctggagtgggcattttgaacgagctccctcctgattttcacacagacttaagcctgacgaccatgctggggcggatgtctgcccctctggtgaccaggtcacagctcccttgggaagacgattgactggggaatggggaccctggggaggaggacttcagggtgccatctgtctgtttacgccagaaaacagagatttctgttttctttcgctgggctcacagcaggtgcttaataaacagatcttgtggcgggagcagacgacagcgaggttcaggcaagactccaggagtcaacccctggatctcggaggctccccacccgcgcacatttccctgacttaaccctcccctccccaagtctttcagccctttccacccaagtggcccctgtgggggtcactgcctggttttcaccctgatcttctgggatgcggcagatgctggctggatatgtgttcgctggtgtccttccgtgatccccgtctgtggctgacaccatctgtggcccaacatgaccccagccagagccaaggggaatcatttctttttccatttaacatcctatgttattacttggctcttagcattcattaattcattcagcagctcttcatggagctttggccttagcccatgcactgtggaagtgacagtgagctaagccaacctggcactttgggaggctgaggtgggaggaccgcttgagcccaggagttggagactagcctgggcaacatctcatctctacaacaagtaaaaaattagccagacgtggtggcacgcacctgtggtcccagctactcaggaggctgaggtgggaggatcccttaagcccaggaggtcaacgctgcagtgagccatgattttgccactgcactccagcctggaaaacagagcaagaccttgtctcaaagaaaaaaaaaaaaaaggaggagacagacaacatacatgttggagaaaatggaacagccactggagggacctctttagctgagagtcggggtagctccctcagaaagtgatatttttgagccaaaatctggccgacaagcgggagtcagctgtgcaaaagaagggggaagtgcgtcccaggcagagaaagtggcagtgcaaaggcccagaggtgggtgcctgcctggtgtttgaggaatcaagaaggccatgagcagccaggtgtggtggctcatgcctgtaattccagcactttgggaggctaaggtgggtggatcacttgaggtcaggagtttaagaccagcctggccaatacagtgaaacctcatctctactaatacaaaaattagctgggcgtggtggtgcatgcctgtaatcccagctactcgggaggctgaggtaggagaattgcttgaacccaggaggtggaggttgcagtgagctgagattgtgcaccactgcactccagctcaggcctgggcaacagatcaagactctgcctcaaaaaaaaaggccatgagagaaggggagagaggagatgaggtgggaaaagtggagtggggccagatctggtgggccctgtgggccatggaaggactttgaacttcattttaggtgtggtaagggctagtagagggccttgggtaggggaggggtatgacctttactgtgtgaaacttgagtgggtgaggggatgagcagggaagcatagagaccctcggggagccatctcagcagtccaggcagtggcttatataatacacatcggcgtcctggggtggtgccaggtacacagcaggcgctgcaggatggaagtcattgctgttactgtttttgtttatttgagacagggtcttgctctgtcacccaggctagagtgcagtgacacaaccacggctcattgcagcctcaaccttccaggctcaagcaatcctcctgcctcagcctctcaaggaactgggactacaggaggtgcatgccaccatgccaggccaattttttttatttttttggcagagatggagtctcactgtgttgccagggctggtctcaaacgcctgggctcaggcagtcctcctaccttggcctcccaaagtgttgggatcacaggtgtgagtcagtgcacccggcttgctgttattatttaaaactctgggctgggcgcagtggctcatgcctataatcccagcactttgagaggccgaggcgggtagatcacttgaggtcaggagtttgagaccagcctggccaacatggtgaaaccctgtctctactaaaaatacaaaaataagctgggcgcggtggcgcatacctgtaatcccagctactcaggaggctgaggcaggagaattgcttgagcccaggaggcggaggttgcagtcagccgagatcgtgccattgcactccagactgggtgacagagccagactccatctcaaaaacaaaacaaaacaaaaaacaaaaaccctttggaatcaggcacacctaggtcgcggctgtgacttgagctctttgtggctgggtgcattggagccaattatttaacttcgctgagacttcacgctgtcatctgtaaagtgagtagggtggtgccaggagtgttaaagcaggtaagggacagatgtaacgttttgggcacagggcctggctcgtggttggttcaatatttttgtcataatttctagtcagcagcaggaggataacgaaggggtaagcggataagagcagctgctatgtttgaaacgagtaatctttgaggggctttttggctagttcctgccgctagccctggcaaaaggcaagtttggagggtggtagtggggagggaagggtacaaagggtgtctcctctgtatttggtcaccaaataatgtctcagcatctagaacaaggcacagggttctagcttggggactagaaagagccaataatactcatgatagtaatgataacagtagtaatagccaacacttacccgctgttgaactgcaggtagtaattaaggtaacactagctaatgtgatagtgaaaccctgaattctcagaggcttagcgcaatagaagtttatttctcattcatgaaaagccctgttgggtgtttggcaggtggctttctatgtggcgacccagggaccgagatcccttctgtcttgtggttgcggcatcccctaggaccttggagttatttccttctagctgatggaccaggaaggagagaaataattttatggaccaagcctaaagtggcacgctgtctttctgtcttaattctatggaccagaacttgaccacatggccgtatctgactgcaagggagtctgggaaatggcttttagccatattcctaagaggaatcggaaatgctttgtggtgagcacattgcagtttctgccacaccatatccaggcatatagcttagcacggagtattttatttaatgctcatgctagaaacaggcaccattattatcccattttgcagatgaggaaactgaagctcagagaagtgaagacactggtgcagggtcacacagctggtgaggggctggtgagccaagattggagtccaggtggccagatgctgaagctgttagcatccagatttctaagaggaattcagtctttttttttttttttttttttttggagaattgggtggaagcagtggacacatacacgaggttcagatatgacttcctgggacccacagaacccagcaggactctgggggagaactttggggatggagccaagggtgaatgtcacctggtgccaggggctgacatcctgtccccttcctccaacccttagggccgtggtcaggagaaggcacagaataatccagttcagtccctcaaggacatctggggccccctctgctgagctgggcatgcagggctggacatgctggtccaggggtatttttggcttcccccctgttctggtgggcaggtgtgcagcctgtagaggggattttttggaggctgcctagaggtagaagagtgggcgtccctggggtttgtagtggcagctctatctgctggccggtttagttttttgtttttgttttttttttgagacagagtctctctctgtcacccaggctggagtacagtggtgcgatctcagctcactgcaacctctgcctcccagtttcaagtgattcttgtgcctcagcctcccgagtagctgggactacaggcacccaccaccatgcccagctaatttctgtatttttagtagagacggggtttcaccacgttggccaggctggtctagaattcctgacctcaagtgatcgacctgcctcggcatcccagtgttgggattacaggcatgagccactgcacctggccagtagctggtttagttttgcccaaatctggcttgcttgccattgcaacttggcaacatttatcttttcagacctgtttcttggttttccatttgcagggcagtttccttagttgggcgtgagcggtccagcctggactgatgagcatttatacagcaccgtggcattctgggtctgacctggatacagaagtagagcctcaaagcgcaaatgcctcggccttgcccttcagtcactcattgggaggctgctggtctaagtggaatgagctttgggctcaccacttccctgaagcatgtcgccttgaataggtgagagcccaatgtctctgagcctcagttttctcatctggaaataggttgaagtaaggatttaatgagataatgtgaatatgccccctttggggcacagcatggagcagagggcacccagggacggagggctgaggcatagcagtgtagcaggacaagccgcaggcaaaactcttcagtcaccaggttaaagaaggaaggaactttattcggctgggaacttcaggagacttgtgtcttaaaagccgagctcctcgagtgagcaattcctgtccttttttagggcttacaactctaagggcaggagcccagacacgtgatgctaatgacaataggaacagtggcccccattggctaatagctcaccacctgccaggtgtggtaggtactatcagtcgcatttttttgttgtttttggtaggacagagtctcgctatgttgcccaggctggtctcaaactcctgggctcaagcgattctcccattttggcctcccaaagtgctgggattatagacctgaatcaccacactcggtctagtctcattttattttattttatttttttgagacagactcttgccctgtcacccaggctggagtgctgtggcacaatctcggctcactgcaacctcctcctcctgggttcaagtgattcccctgcctcagcctcctgagtagctaggattatatgcacatgccaccacgccccagctaattttttttatatttatttatttatttatttatatttttgagacggagtcttactgtgtcgccaggctggagtgcagtggcatgatctcgcctcactgcaacctctgcctcccaggttcaagcgattctcctgactcagcctcccaggtagctgggactacaggtgtgcaccaccatgcctagctaatttttgtatttttaatagagacggggtttcaccatgtaggccaggatggtcttaatctcttgacctcctgatccgcctgcctcagcatcccaaagtgctgggattacaggccaattcttgtatttttagtagagatggggtttcactatgttggccaggctggtctcaaactcctgacctcaagtgatctgcccgcctcagcctcccaaagtgctggaattagaggcttgagccactgcacctggcctggtttagtctccttttagagatgagaaaactgaggctcagggaggtaacctgttcaaggtcttactgtcttgaacaccatagttgcaagtgacagagctgagtctcacatgcaacctcagacctgatactgactccagagctgtgcgcctaagcactagagcacatagcctccttgccccagggaaagaacaatgggaggtggtgggtgacctctgggtctcagggccctgggatatagggactgtgccttttttttttttttttttgagacaaagttccactcttgttgcccaggctggagtgcaatggcgcgatcttggctcactgcaacctctgcctcctgagttcaatcgattctcctgcctcagcctcccaagtagctgggattacaggtgtgcaccaccacacccggctaatttttgtatttttggtagagacggggtttcaccatattggtcaggctgatcttgaactcctgacctcaggtgatccacccgctttgtcctcccaaaatgccgagattacaggcatgagtgcctgcgcctggctgggactgtaccttctggattttcaaatgaatgaaatgagtatttcttgagtgttggccacgtgaccccccagcaccatgtcatgtgctgggtatgcacacacgatactgtttcatccccggacggctccgagagatgagtaccaatattatcacatcttacgtaagaggacactgagtctcagagaggcaaagtcagtgtccctggtgcacccagctagtgggggctggggtgggtgtgaaggggccagaagcttcccaataagtgcctgaagggcaaggctagggcatttgtagttcgaggctctaccactgtgtctaggtcagacctaggaatgccgcaggtgttgcataaatgctcatcagtccaggctggaccgctcatgcccaactaagtgccaagcctggcctgggtgatctcacagcctgcattctttgccctacacctgttgtgggaaaacatactcccagcatgctgtaaatcctctcattcttagctaaccatgtgactcccgttctgggccagaaagatggtcacaaatacttaggactctggcctttcccgccgcatggctactgaccccaccccctgggcttggagggctctaggacccagcaacctgcgcagggtgaagagtgtgtgaggtcctgacctccaggtgtctcccctgtttcctcctcccattccctcttctctctcctccctccttttctctcccttctcctcccctctcttcatccttcctcttcctttggctccctgcctctgcttccctcctctcctgtcctttcccatcccctccctcctcagcccacatcctgctcctcccaccgcggtggtcacatgggggcgccgccggatttaagcttaatctgcctggtgctcagcacagcatcctggctgtggcgcgtgctgactgagctagtcttggggtcctggagaagggggctggaggcatgcccacagcctcccccccatgagcttggggctggcgagggcacaggaggtggagctgacactagagacggttatccaggtgggtcctgggggctgtgcccaccctgtctggggcggggcagcgtggacttaacaggagtggtgagaggtgtgtgcgtcttggggatcaaggggtgggagaggtgtggtggtggtggggtatacaggggccccccgcttgcagttcctggcaagatggggggcagaggtacacacagggtgcacctgctgtggctccctcatcccagtgccctgggttgggagaagggggtctctactgccagattttagggcttgggggacctctggcatagccagatcctcatccatctagggtcggaaccggattggggcccccaacactggactgcctccagtggggtttgggagttacccgtagggtttggttctcatctctggccctgggccttcttcctggggcagtgagcacacaagaggctctttgcatggggattttttggattctaactcccaggcttcactccatcttgagggggctcctggggacctgtatcttgggcagtaggattctgtggctctccccacgaggccagggagccccgggtcccatgtcccctgaagaccctctcgcttttcccacagacactggagagcagcgtcctgtgccaggagaaaggcttgggcgcgcgggacctggcccaggacgctcagatcaccagcctgcctgcccttatcagggagattgtcacccgcaacctctcccagcctgagagcccaggtgccacccccatccgctcccctccacaaacaccacccacattttacctcttctcatgtccctttcctgagcagtcaccatgatgatcatgactgtaactcactgtggggcaggcacagctttatgacagaagaacccattttacagatgaggaaacagaggctcagggatgtaatttgtccagacttattccgcatgtggtgcaactagaaggaagggccgagcatctcctgcgtgcttgcctgtagcctgctgcagagatgtgaaccccaaatcccgtattcccacccggggaaggtgtgagctggctgaacccaagatacaggaagagggcagctcagctcagaccagggttttgcggaagtctgagtggatggcgccgtccatccgtttcccacgtgggcaggaaggcggatggtccctgctcctctcagtgggtggcgcacacggtgtagttatgtggcttgaggatctgggaaaggcacactcagttgcagctggtgtgctggcgtgtggcgttttggtgctctaaccattgtctgtgttcaactcccaagctacagacgggccccctccttgggagcgccagggatgttggcgccctggagccccagacagggagagactcagagggccctcaccctgacacctggggtgtatgtccagttctcccagggtagaaggggaacccacaggaggtggacaaccccgcttctcccgctggcctttctttccctcttctctctttctccttctcctcacaacctgacctatgctatgctctcctgagccctagcctttaaagttccatgaagcccttctcttgagcgaggctttgatgcttttctgggaggatctggttactactattctaccttttttttttttttttttttttttgagacagagtctcgctgtgttgcccaggctggagtgcagtggcgcaatctcagctcactgcaacctccacctccccggttcaagtgattctgctgtctcagcctcccaagtagctgggactacaggcatacaccaccatgcccagctaatttttgtatttttagtagagacagggcttcgccgtgttggccaggctagtctcaaactcctgacctcaggtgatcctcctatctcgactcccaaagtgctgggattacaggcgtgagtccgtgcccgccccacccatattacagataagtaaatctgaggccccggagaagaagactaattggaaaaggagggagcaagaactcaggggtctcctggctcctagactgagtgtctctcctgcacctcccaaacctgctgggccacactttagctggagttgtgttcactttacgtccagctttgtatcccctccttgccttcctccctgttctcagctctgtttgcaggcctggtgctgcagccattcccatctggactcctcccaggggcctggatggttttcttgccctccctgttggggggaggatgtcccactggacccagaagccaaccatgtgcccactgtcccttgccagtcctgctgccggccacagagatggcatcgctgctgtcgctgcaggaggagaaccagctgctgcagcaggagctgtcccgcgtggaggacctgctggcccagagccgtgccgagcgcgatgagctcgccattaagtacaatgcggtcagcgagagggtgggtgccgcccaggtggtggactaggccagggttcccctcgttcaagggcagggaggcatctagaccaggcccacacacggggcaaaagatgggccctggagtcaggttggcctgggcttggattgaggctctgccaccttgagtggcgttgagcaaatcactatgctctttaagcctgttttctgtagtggggattgtaatgggacgtggaattgtaggaatcaaggagataatagaataaagtgcctggcaccaggggtattttgttcccatctgtcccaggcctgttaggggtgtgggacacggagaatgagatccctaaagattcctgccccttgagtttctgggcatctcccattgccacgggccttggggttgaggcggtggctggatgctggctcgaggctggtgtgggcacccgcggtgttctgcagcccatctggggcagccacaagacctgccgccactgcctattggaatgagttccaggcagggaaggaaggagaagcaggcctgtcttcatgtccaggcaggattcacatcacccgtgctgcaggcttgtgggggtcccagggtgtggggcgggagctgggtgtgagccggtgcgaggggtgcgggatgctcttgatgcactgtctgctttgggcctccgggtggccgggaggtggccctgggaagttggtggtggctgaagattggtaagggacactcgcagctgggacagagtgtatgtgtgcagatgagaggcatgcaggtggcaataacgtattaacagtagctactgtttattgagtgcctactatgtgccaggcgcgtgctgagtgtttcacatttaatacaccaaggtcgggaccattatgatgcccatgtaacagaggagaaaacagaggctcagggaggggaagcaccatgctgggggcacacagccagttaaagttagacaccaggtcttccaactcccagcccagggctctgtttggtttctaaactaacccagtctagaaacaaagttctgaagtttcatttcctgtgtatgggaagagacactgggctagggatttcagggcacagctggcccccacaaagttggaagggacccagagaggcaggggctggcccagggtcccctgtgtggtagtggcagagctagggttggcatgggacccctgagctggacttgtccaggctggagcccgcattggcaggagggtgtgtgttcctgtgtatgactgtggggtgtgcccgtgtcctgggatttgcctggctggacaaacccacgactagttgggacttgtagaggagcagagtaggcggcccgcagtggcccctggcatgaggacagtggagagctcgtttccccagggtctgcagcgggtgtgtagggcacgctggccccagtcatgaattgtgggtggtgatggggccctgagccaggcacccctttcttttggtccatgcatggcacagtgccacacccccagggccgcctcttaaatgccaccttctgaagctagccctgcccccaggttggcagggaagggaagaggtgggaggtagcaggttcctcctctgctgggacacagctgctggggctgggactgcagcacagggggtctgggttagtctagaaagctccctcctgtggttagtgggggcccaaatggcacgcagagggcgcccgctgcttcagttgtcctctatccaccatggtttgaatgaggccccacctggaggcaggggtggaacaggaatgacctcaaaggcctttcctggagggtgggtccccagagaacttcagagcctagagatcacctcatcacagatagggaaagtaagtccgggagaggggcatgataggcccaaggtcagtggtggtcctgggatgagacccttggtccagggctctgcagttgggcaacattctctttccctgccacccccttgtccccatggccacaggtggcagtgcctgcccctgtggccctcactggcatgttgggctgggttggtgggcagtcagcgagattgttctgatctttccaaccctgcagcacccctggcatggggagcggagggagggtcaggtctgtgtcctgttaactgcatgtcctgcagggaaactgaggcactcccagaggccacctcccagccgagagagaggacctcagggcccccatgggggtccccccttcttgctgtccctgagaagcagatgtaggcgcagctgggaatggaaaggagggagtggtcacgcctcccttggctccagaggacagaccccctgggctccctcgtgtccatagcaacctggaaagagtaaattgaatggcggtctgagggcagcagttgctaggggagacagtcaacttctttcatctctggcttagtggcagcctccttcccttttgaattgcaagtaaaattgaaaggctgttttgctcacggtgaagtttgtggaaaggggtgaggtgtggccgagagggccctggctctggttctgagcactggagaagggggaggagaacccagcaacggcctgaacccctctgtgtcccagaggcaaacagcacctgcttcacacagatatgcagtgtgtacacgacatgggctacactgggccccacacagacacacagatgcacaaaacattccacaaacaacatagtgagaccctaaaaccaggccacacagaaacactccaattcacagaatatgcacagtgttagccgcacacacagccagatgccacacaaccccacacaggcacagaacagtccccccaccaccggggacctataacaaccatatgcagatgacacagcacgctatctcccacctcatgggtgcacacggacaggaaaagcatacagttcaacacagccaccaatcggcccacaaaggtatgcccagatgcacaaagtgtgtatcacacataccagggagcccaggcacaccccccagacccacccacatgcggttgtacacttgcctcaccgacacacagacatataccctgatacacacagccaggcccaacacccgcgccacaacatagaccttcagccacagatgccgccttagccgttcacgggaaggctcagatgcaccaaacagtcgacgtgaactcagcacccacacactacacacacagtgtcctgcgtggagacaaatgacaaaatacaccccactcgcacctagtgagagccaccaacatcagtgcacagcctgtgtggctgcctcaggccaccgccaccacacacagatgtggacaccgctcaccattgacctcagtgggcttggcacagacgcttgacaggcctgcagccgccatccaggcagaaaccccctacttccacctcccctgcacagccttggactgtgttcctccagactcagggggaagcccccaagtagtcacagttagctcctccctattggtggggctgccatgcacgtgtcccgggggtggggtggg

SEQ ID NO: 39 - DNA, 259291 bp, Homo sapiens
ctttctgtttcttcaagacctttcttggatccctaatgtgcaggacctaaggggctggtgcccttccctacccttcctgcctgggtgtcttcagcaccggagctcacacagaatgttactgcctgccagagacagtgagaggaccaaggagggcgatgggtgcagtgggaactactgagtcaccatgtacctgtgcctcatgggctcctagcaaattgaataaacactccctgaagcatggcaccagttccaagtacaattactacttggctctatgagctgagtgcacgttccccccagcacggaaatcctagaaactcccatggatgctatagtgaaaagcaggggctggccaggtatgatggatcacacctgtaatcccagtgctttagaaggctgaggtagggcggatcatttgagtccaggagttggagaccaacctgggcaacatggagaaacttcaactcttaaaaaacaaaacaaccaccacaacaacaaaaacaacagaaattagctggctgtggtgactcgtgcctctgctactccagaggctgtggtaggaggatcacttgaaccaagatgccaccagatacagtgagactctgtctcagggaaaaagtcaaacaaacaaaaaaagaggctgtgtaagaggtgattctggggacagcggaaaaacactaaggttttcaagtggtgttaaaagccagtaggccttggggaccattgagcaatctacaaagcagggaagcctagatccctgagctctgcctgccaagtaccaccacagctaacatgggagacctcccccacagagactgaaatttgcctcccaaggaaacaagtgactacagacatctgtcccaggacagtaaacaagaaaacaaggtgtcacaaaaacaaaaacagctgaccacagcatacaatcactgagactgagcctgcgactataggcaaaaaaaaaaaaaaaaaaaaaaaatgccgtctattattcataccatgaaagaccaggggaaagtgtgaacgcagtcccctactactgttgtgggaatcaggagaacagagagaccgataggtggaacaggaggatttattgactgcactcaggcacagtggattaaaatccaaaagctgagccatgaacaaagacagggcttgactttatagacacttctgaaagggggttggctagtttgaatggcgcggcgggaatttgatggcacgaaactcgtggggcaggcaagagggcttacagaagcagaagaaaggcagctaatcaaactgtcacaggtcttgcaatgcaagtatggctggtgaccttgcagctgcactgaagggaaatcgggaacttaacaaaacttgaataattagaaatggaaagggggaaagagaaggtagtaaaggcatttgttgttttttcctcttatctttgctaggggctgtgttgagagagtctccggaacgcattcctcggggctctgacttttcagatcgtgttaccgaggatctgctagggctctatctatggcaggtcttggagtcagccaagtacagggaaacctgtcttttccttttaacttctgcctgattactacaagttgtacagcacaccatgcctggttttcatcagcaatgtttcctgaggttacagaaagatttctaatcctgggaggaaacactcccttgaagcaaaagtgttctcccccaaaaaatgcaaggagctatcttcttgatagccaggcagataattctcaggttttgccccacagaatctcgatctaaaatagagcagtggtcatgcctagtgaaaagtttgagggaactcacccaacgttgggtttcttcagagccatatatatagatataaccaaatatcctaaaagacactgcccttcatcattccatgctgttagacatttataggaccatggatggtgatctcctccagacaaaaataaatgctggtgcagaacaggtaagtgtattataatttgagtacatcagcttttgggcattttaaaccatgggtcagacatgttaaagaaagagccaggttgatagtaaaagggagtgtttttctattaattttccaatagcaaagtgatgtttgccactgtcatttcagagtgaggggacaatttgttgttgtttggttttgtgggtttttgtttgtttgtttgtttgtttgtttttgagacaaggtctcactgtcacccaggctggagtgcagtggcatgatcagggtttacttctgccttgacctcatgaattcaagcaaacctccttactaatcctcccaagtagctgggactacaggcacgtggccccacaccctggggtgtgaactgggatttgatgttttcagttggctctctaatggaataggttcccttactcttgtagaatcagattgtcttcatgattatcattcttgtgtgcattatatttctactaccctgctgtttttttttctatttttctttttatttttttctttgtgagacagagtctcgctctgtctcccaggctgtattgcagtggcaggatctcagctcactgcaacctccacctcctgggttcaagcaattcttttgcttcagcctcctgagtagccacctggctaatttttgtatttttagtggagacagggtttcaccatgttggcaggctggtctcgaactcctgacctcaagtgattcacccgcctcagcctcccaaagtgctgggattacaggcatgaactaccacacctggctctcaaaccattttagttaagcaaagacagatttgtctggctttttagtacaatgctgaattatcctccaatctatatttttaggaaggacctggggaatggcaacttggagatatttggtgaaaatgtgaacctttcatgttctgcttcagtctctttttgaaaatccttccaatttaccttttgcaaccagttagtggccttcccttcttcaccagcatgtgaattaattgataaagatcagaatatttgggctcaaaggtttcaacagttaagtcaaattttctgccaaagcctacaggatcttggagcctgctttagaaacagaagagtgaaatgtatttaagtttagatcagggaagtcctttataatattcttaattcacgttttggtgaagtggtatacacaacggtaggctcccctcttcctgtgggtttgggttttaccttgaaaggggctgtcagaacagaagtttcagggaggggtccagacccctggggactttccttaggtgatggtgatggaagaagaggcaaggcaggacaggaaggctcaggtaagaaagactatgcaggtgcaggggcaggaggagaaggagcagctggaagtgaaagagacaaagcctcctcaatatttctcaattcagaaaacatgacagtttacctccttcagcttacttcctggatggaggcaattttctcagttcttttagaaattttagaaatttagacatttctaggtctcattagaagtaagtctcccatttaatttgtctgattctaaaaccaaatttctctctctctctttttttttttttttgagacagggtcacctagactggagtgcagtggtgtgatctccgcttactgcactcaccgcttgctgcatgacagccaagatgtcgagggttgaggtgtaggggcagggaaggtgactttattccagagagccaccaaactgaacagatggtgaagtaacatcctgaagaaccatcttaaattaatacgattttccggctccttgtacgttagggaagggaggaagaaggaggcgcttgaggtgaagaggtctgacaatgacagacatgggctgcagtgggagcccaaggggatggtgaaaattgttcgtcctttgtcaggtcacactgctcttataaatcttcagcataacactgttacttgtgtatacaacctctctatcttctcaggagttagtttggggaagggattattatcatctgtgctttaaagttaaactgtaagctaaatccctcccatagatagcttggcctatgtgcagaaataagaaaaagcagttagcctggaagatgtcaccacagggtaggaagggttaggagcaaaatgcagtcagtcatgctaggcctcattttcattgccatatatttaatgtatttgaacacataattttaattttttatatttatttttattaatttattagttttttgagacagagtctcactctgttgcccccccaggctggagtgcaatggcgtgatcttggctcactgcgacctctgcctcctgagttcaagcaattctcctgcctcagccttctgagtagctgggattacaggagccccccaccatgcccggctaatgtttgtatttttagtagagacagggtttcaccatgttggccaggctggtctcaaactcctgacctcgggctcccaaagtgcttggactacaggcatgagccaccatgcccagcctaaccaagattattaaaccattctaatttgtcaaaagagtcacactgatttttaaaaaataatgtaatgggccaggtgcagtggctcatgcctgtaaccccagcactttgggaagccatagcaggaggatcatgaggtcaggagttcaagacagcctgaccaacgtggtgaaaccccgtgtctactaaaaatacaaaaattagccaggtgtggtggtgtgtgcctgtaatcccagctactcaggaggctgagacaggagaattgcttgaacccgggaagcagaggttgcagtgagccgagattgcaccactgcactctagcttaggcgacagagtgagactacatctcaaaataaataaataaataaataaataaataaaataataatgtaatgaactttttcatgtctttatataataaatattacattatttaaattgttcaaaagcatcaaagattcctctctgctatcaatttcatttcatttattttattgtaccaaactaccaggaccattaatttaatctacagctaaatctattattctttcatgttagaaattcaacaagaaaatttttccctaatgaaacctcacatttcaagcataaggagcctgggcgagttggctcacacctgtaatcccagcactttgggaggccgagacaggtgcatcacttgaggtcaggagttagagactagcctggcaaacatgatgaaaccctgtctctactaaaaatataaaaattagctgggcgtggtggcatgtgcctgtaatcccagctactctggaggctgaggcagggaaatagcttcaacctgggaagcagagcttgcagtgagctgagatggcaccactgcactctagcctgggctacagagcaagactctgtctcaaaaataaataaatagataaataagcataagtagtaaaaaaataacataaatttaaaaataaggcacagggtcttgctctgttatccaggctagagtgcagcggggcaatcatagctgaccaacttggaacttctgggctcaggcaatcctcctggctcagcttgccttgtatttttttagagacgaggtcttgccctgttccccaggctggtctccaaccgctggcctaaagcaatccttccccctcagcctgttgagttgctgggagtacaggtgcaagacatgcagcctagcattgtagtaaaacaattttcaacaaattcttaattttctttccttttttttttttttttgagttgggagtctcattctgtcactcaggctggagggcagtggcacaatcatagttcactgcagcctgagattacagtcatgcattatcatgcccggccagctttaaaaaaattagctaatacttaaaaatttgtagagacaggggtttcactgtgttgcccaggctggtctccaactcttaaagtgctgggactgtagctatgagccaccatacctggcttaattttcttattttaattttatataaatgattattattgttcctaagataattggggcagtgactcctttacaattgtagagatctaatttgtctattcacttcactgaaagagtatgccaatttgtttcatgagaaaatatcctatatttataaagcaggaaaattccttccaccaaactagggtgcattctaaagaaatgaattgtgctaagtaacatcacttaaagtgaaaacagaggcaatggtatctattaacaatgtttatcagtgaaggaaataaactgaaaagatgaacatcattagatccttggagggccttcattgctgaaaatctgagtaacagtgtgatactcttttgagtctggcaggacattctctttccagggcatgcaacagtgggtgaataatttcttttcattcatttccattaagggctgaacttccttaatgttctggagattattaaatttgatttgtatagttgtgaaaagtactcatattgctgattccattgcttatatgtgatcatataaatcttttctcttttggtagtgtggtttaaacttaatccttaaagggcatgtatttgaatttttcagctggttagaaacctgaatataccaatcaaataaaactgctccttacatgctacagatttagttttcttcctgtactaagatgtcttttagatacagtaaatttgttaaagccaagagcccctatgaaacgaagttgggtgggaggggggacattgagtagtaagatcactcttgtaacagagatgccactcttgcagatattgacaacaattgggcctataaaatttttaccaaacattggaaagacaagatctgaacaacttatcattgctgcagtctcaaatatcaggaaatatcattattctcaggacaataaatagacaataaagaagactcacagaccagattagctgccatgtatcaccaaacagggactggatccttgtcaacacgacccaacagagattgtccccagaaattcacttcataacctcaaaaccaaaaacccacactgatggcaaaaaacaatgatgcaaagaatgagagagagagagagagagagagagagagggagagtgagagacctgtcctatagccatactcagtgggtaaaagccaaagagctcaatttctgctcatgatacttaatagaacatagggaacatgagccaatagctcaatgggttcagatctgcaccaagtgcctgttggacgcaggattctactgtctccaataatatgtctcagatgcactatttttttttctttttttgagacagagtcttactctgttgcccaggctgcggtgcaatggcgcgatctcggctcacagtaacctccacctcccgggttcaagtgattctcctgcctcagcctcccgagtagttgggattacagacagacaccactgcaccaggcaattattattattatcattattattattattgtgcgtgtgtatgtgtttttagtagagatggagttttgccatgttggacaggctggtcttgaactcctgacctcagctgatcaaaagtaggtgaggtcagaaaacataccctgggagaggctggcacaatgcccagaaccgccatcgctaggcctggggttttcctctgtagtggaatactagtattcatgtagtgcagggacaaaaccaattagatagttctgggagttaaaaagaggtgatttacagtgctatttgagaaggggtattaaggaatttgccagggcactgacgcgtgtcaggtgtaaacctcaggttgagagagagctaagtattttctgtccatgaaggtgataagcgagggcctgaagaaagagggactggggaggacactggcaccagaaataggaaagggcttcttgggggtgggaaggatgggtcacggtgctatctataaagttggctggcagtggatgtaggatgtgggagtgagacatcaaacatgaagcagtcgcttaaagtctgaagaaagactagatatataaacggcaggagatagtagggaaactggaccggctcctcataaaacttcccgccttctatctccgggaggatcgcagggcatttccgccaagacaggtgagactgcggttctgacctgcgggcctccgtgcatatgcgctagggcacctgggggccggcagagccgttcccctacgcaaagtaagcgtgttatgtctacaacccaacggggacactgagagccccaaaggccctgctttcttcccagagaactgcccatctgcataatttctacctggctctatgaggtgagaacacattccccgctagcacagaaatcctacaaactcctgtgggggctgcgcttggaagcagaggctgtgtaagaggtgactggggggtagggaaaaacacgaagattttcacacagggtgagaacccaagagactggagaccacggaccaatccctgcaaaaagcagccagggtagaaagggaagagctgagcggacttcacgatagctaatttgtgttacaaagccgatacggctgatgctcgctttttctcctatgacatgcaggcgacatgttacttcctattcccataaaccctccactgtaggattaacacctaagacaccaaccaagacacaaaccaatacaaaaaaagatatgacccttggcgtacagtctgtttttgaaactccagaaagtcaggggaaagcgcgaacgcagtcccccactaccacaaattatgcagtcgagtttcccacatttggggaaatcgcaggggtcagcacatccggagtgcaatggataagcctcgccctgggaaaaccaccttcgtgatcatggtatctcccctgccaggtaagtatgaaacgttgtgcctctgccccgacacagcctcatacgcctcactctttacacacacggtcacttgccccgcgcactcccgagccctttccagccctgacacacagctgggattctcacttccgatcagcggtcctgaacccgctcccagggcacgggaactcccttcgtggcgaagcagcaagtggcgaagcagcagcctctgcgctgcctcatctacatagaagtcgccctgtccgtgatgtcaccgacagtgccttgcccagtccccgtctgcctttctgccactcaaccgaccaatctgctgccagagtcgccaagaggaagtgacgtctgcctctccctttttccctcccgcccctgcgtctgttctctcccaaagaagctggtccttagcctgtgttaaggagcaatctttcggtggccagatggagccggggcatccttcttcaaataatggcttttaattcgcagactagaatgtttcggattacaaaagaaaccggttctcttcacatccttatccttgtgatgcagcattccgcttgcatttggaagccgtttaatatcagagagaagccatatttatgaaagtaaagaggctgctcagatgactgcaaaccagccttccttactggttttatcactggtaatgttataaagacagttgtccagtttcatgaatcttgtaggttttttttttttgatgttgtttttttttcaaaaatccgtattgtagaaaaatatgctgtcccagaagagatgattggacactctcaagcgtggtgctggactttgtcatctcttgcacagccatctccacaccttagtgcttacctcatgttagttttttatattctgcaaagacgaaaccaaaataatccaaatttgacacaaatacctgggctacatcttatttgagatgtttaacaaatgtctggatcatcttttcttatatattacgcaggaaacactgtgaagtaagcaaagttggaatgcccaagtgaaagaccatttgaatatttacaagtagatttcagacaggaatactacagggtggtcacaggataacaaattctaggcagcagatttacatgacttgaggctgtgggctgttaagacgctgaaaaaccagggtgtggaccaagctggctaaggctgagtggacccaacgtggtgctggattggatggaggttttacctaggccctcattatatgctcattaacatactaaatcacacacccgccagtgccatgacagttctgagaccagtgtttgatgtaaaaatggcaccacagttccaagaaatctccacctttacccaggaattttcgtgaacattccactccttggttaaagaaacccatcaagatgaaaccccagaacccattattctctcttgggtatgcccaagctcccctttcttgagagtgtactttttgctttgcaataaatctcttctttcactatctgctgactcatctttgactttgttctcgcgatggtgtcaagagcctggacaccacggctggggtcgagatcccaccagtgtccagggacctcccccagcccaccagtatcagattctattccattgctcaaatcacaaaacatcgagtggagagttctctttggagaccgtaaagtaaagattctgtggcatggtggccagttaggccactggaagcatggcaaaatattgaaaatgagggattgggtgacagtgtagtaactgctgaatactaaatacttgatccaggccccattccctggagattgacagggagacacattgtccaggtagtagtggagaaatgctttctgggtatctgaccagcctttgtggaaagaactggcaccatcctgcagatgtaaccacctgatgggttcttcctgaccaatgtacacaaaaattcaattcatggagaccatggcactgcaggaaagagtttcattgacacaggccagccacgacatgtgggagacagagttattactcaaagcaatctcactgaaggcttggaggtaaggggtttttcaaagatagtttggtggggagggggctagggcttgcgtggtgctgattgttggggatgaaatcacaggggtgtggaaaatggccctcctgcatggagtcagcttctgggtgggggctaagggactggttgattttcgggccagatggtgccttccagcagtcagaaatgcaaaagcctgaaaagacatctcaagaggccaatcttaggttctacaatagtgatgttcttcacagcagtaattggggaagctgccaatcttgtgacttctggaataatggctggtaattatttaacgaggcatacatcttagtagaaatcaggcccctttcatccttctaacttggtggcctttcattcattttacaggggtaatttagttttggggaaggttatcatttaaagcagcctttttggctgtcctcaacctttttgtcaccagggactggtttcatggaagacaatttttccatggaagggggtggtggatggtttccagatgaaactgttccacctcaggtcatcaggcatcagttacagtctcataaggagtgcgcaatctggatcactcacatgagcagttcccaatagggtccgagctctgacgagcagctaatgctcatgctgatctgacaagaggcagagctcaggtggtaatgctcgaaagcctgcagctcacctcctgctgttcagctgggttcctaacaggccatggaccagtacctgtcttatggccctggggattggggagtcctgatttaaactataaactctatttttcccaaagatagcttgggagaaattgcacaggaatgagcaaagacagcaagcctgtgaggctagaaccaagatggagtcagccatgtcagctttctcttgttgtcataattttgcaaaggtagtttctgaggggctgcactggacacttcttaaaaacatgagacagatgttattgtatttactacagtaggcaagagagaccagcagagaactgggctcaacctcgaatacagcaggaggagttgaagattatagccaattggcaagataagaaagtcagtggatggaaaattactaagaggaacttgattagctatcaaaggtggttgcgaggactcttgctaaactagactcaacagtattctttcctaaaactggacttggcaggcaaagaaataacagagaaaagggctcagaggaaactactaaggtttggtcaaagactagagtccttgtcaactctacattgaagcttctgcaaataaacaaagaccaaccaaatgaaaaaaagcaaaagctatttattctgagcttgctatagcagggagtcagtcactgttatttgtgttttggcagagacttgaaggcagtcataaaggtgggaaagctttttaaaaagaaaggcttcaggggccgggcacggtggctcacacacataatctcagcacttcgggaggcccaggtgggtggtcacgaggtcaggagatcaaaccatcctgactaacatggtgaaaccccatctctactaaaaaatttacaaacaattagccaggtgtggtggcaggcaccagtagtcccagctactctggaggctgaggcaggagaatggcatgaacctgggaggcgaatcttgcagtgagccaagattacaccactgcactctagcctgggtgacagagcgagactgtgtctcaaacaaacacacaaacaaacaaacaaacaaaaaaacaaagaaaagcttcaggtatgcttggattggaggctgtcagcatggtgaagctgttgatagatgaagaaaatcaaagtattttaccccagaatatatttctttggcatattttaagatggctgtcagagagccagcaaacagaaggaactctgcaaaactgtcttttgtaggggaaatttacacctgcagagaatctgcattaatccagctttatcttgtcaggtttgagaaataaaaataagccctaggccctacaaccaactgaatggactccctcttggctgacaggaccacagagaaacttcgaaagcagtttctggatgtggcaggctaggaggttggacatgccacctcaaaaccctcccctcactaactgccattatgatgcaggagaacagcagagggaattggaagttggataaaaggcagagtgagtgaaagcagagaaagaagcaaggtgatggggtgggagagcaagaagcaagatataaggcagaagttgagcagccaaaacaaaaagtaagatttaaaaaagcaagcaaggctgggcacggtggctcatgcctgtaatcccagcactttgggaggccaaggcaggcagatcacctgaggtcaggagtttgagaccagcctggccaacatggcgaaaccccatctctactaaaaatacaaaaaattagctgggcgtggtggtgcactcctgtactcccagctacttgggaggctgagacaggagcatcgcttgaacccgggaggcagaggttgcagtgagccgagattgcaccactacactccagactgtgcaacagagcgagactctgtctcaaaaaaaaaaaaaaaaaagaaaagcaagccaggaccccatggccggtgagatccaaaccagtaaaggggcagctcctcagagataggcatgtgcattagagaaaaaaagtatccttaacatgactccatatgataatcagctcattaaaactcatgcatatggactgcacatcatgcatgtacttaaaattatgggatggaggcaatgtgcaagcacacaagggccaaagtaactaagcaacccacctatcaatcaaaaggcaaacactggctaacgattaggcatccttgggaagagaagagaaagaaacacacataaaaagacccaacgtacaccaaactaatactgatctcacatcccagagatcagcccactctccccactctgagactgttactgtgcttaataaattttgctttgctttgctgctttgtgtgtgtcatgtacagttctttgtttgggacaccaagagcctggaaatgcacggcaccatctggcaagaattaggattttttttcctaagggttaacaatccaagcctttggagagacttgcttcactgctgttatcaaccaacagcctgatgctttccctcccttttgtggttttgacaaaacaagcaagcagcattccctcctgataagagaccaccgacctaggaatcattctggccagactacagaggatgtacagtgagggttttcatgtccattgcctcagattttgacgtcagagggccacaaactccactctcagatgattgctaacgccaccattttatgaacatgagccccatggagaggcacgcagctcaactgcacatctgcacatttttcctcttataaacattcatattggaatattatttggtactgctcccgtgaaagatacatttgcagaatggactcagattagaagcattatacaagcactataatgtagcaatggcacatccagctctctacactatagaaatgtctgcagggtaaacatttccacaatgaccaaagatatctgtacaggactggtgactgcagcattctttgtaatcctaaaactatgaaactaaagtcatctcaaaaacattttgtttttttgagatggagtctcgctctgatacccaggcagtgcagcggtgtgatctcagctcactgcagcctccacctcccaagttcaaacgattttcctgcctcagcctcccgagtagctgggattacaggtgcatgccaccatacctggctaacaaaaacattttgaaaagggttaaataaatcatgcataaactgaggaaaaatactattttcaaaaatgatggagagaatcactttcatgatgaatgattccactggtcacattattgatagagcaatcaggaaacccaggcacatcctggaggtaatactggactcctattactaaaatatgaaaaaatggagacacgtaaatactcgtttaagcgtataacggactgaattagaattttatcacatcagaagtgggttcctaggtctctgtttcaggattccttagtgacacaggtgtaaacccggcatttcaggagatagccggctaagaatctggtcggggaggtgggcggcccttgacatggatctgtcataaattagtggcttgagactttgggaagataaaatcttccccatttatctagtgattgacattgcgtgaatgcttcaaaagttccaataagcgtccctgggtgggctcgaaccaccaacctttcagttaacagccgaacgcgctaaccgattgcgccacagagacaagcgcttccaactctactgggcatctaggaagggcgcactcactgaacttcctccgttccgtctattctcagggcccaccgggcaggaccactgagcaaggccttggaaaaccagagagattagagcggtgagtcgcgccggtcacgttggacgcctgcgtgttaggagattctggagccagaagaacagcagaattgccttcgcccgccctgcccctcgcctgctgcagaagcttccagaaactccctggtgggcgacccagcccgagctgcctggggccccaagggaagctgaacgccctgtgggctcctgggatggttcttcccgttctttgcgccgccttcacccattgaaggagcctgtgcccaccctgcccagtcgctttccgggccgctgaggagcttccgctgccatcttcggatcctgtgttccgcacgggggctccaccagggcagggatggtggtgagggtcgctcgtgggtcccctcgcggggagcagggtctggtactcaccagggcgcacgactaggacttgtggaatgaattcatcgtcgcctttagcttttagtcctttgaagagccctgagagtggaaatcaagagattttttccacggggaagttctttttacaaagcgttgatttctcggcacccggcagggagggcaactggcagggtctctggcgcaccttctgcgcggtggagccacgggggctcagctgggcggtggtgcggccgtggggtggtaggtcaagagctgggaaaggaaaaagcaaaagctgggaaagaagccggggagcggtggaccagacatccagacctcctgaaaggctcatgaaggggcacaggcaggatcttctggaagtgagaattgttttgtttgtttgtttgtttattgtagtagaatggggaaatggagagagaacctgaaagagccccaaactcgaggacctattgctccccaagaataacatcttccagaagaactagacagaaaactaggcgtctgggaactctgaaatccttggaggagtagcatcatcatgaccctctgtgttccttttggcaaaggacttgctcccattgtttgcttgttcaattgtctgtccgttaaataaataaaacccttttcctatatctttaaaattacgttggttttatcattttatgattacaagtaatgctgcagtcatcattcttgtacactctcattggccactggtgtatttctatagggtggaggcctggagagtagttgttccagcatagtgtttacatagcttttatttcattccgttttctttcctttgttgctttattagctataaccgttttcttatttcagaggctgctttagggtttccggaatacatctttaatttatcatagtctgctttctagtgtcattatgcctccctttctggcctttatcctagtgttatgtatctttactttatgcactataacctttgtgattcattattattacttttatttgttacgtcaaatattttttgaaagatttaaattataagaaaacgtgtagtacatgctttctaaatgccatttccaatattcgtttctttgtgtaggaccacatttttatctggtatccttttgcttctgcctggaggacgcaagatttcttgtagcgtgggttggtgaattcttttagcttccgtatgtttttcaatgttcttatttcactcacagttttgaaattttatttttgcatagaattctaggttaactttttttctctaggtactttaaaaatgttgccatttatgaagcattgtcatttaaaatatcatctttctttcctatgtttgtaaatatggcgtaaagccggtttcttgtgctggttatacaattttcagaatgtgtatttaaatttaaaatattaaattgtactaaaaaactaaaaatattaatcatgaatgtcctagattcatcttaagttccaacagtgcacttaaaatgtgcccaacctgagggtcaaacctacctgctgatgtggaatttgtgtttgtgagacattctcaacagcatttgctttccccagcctagtgattttcctcacatctgaatgtcttcattgcaaaaggaaacgtttttctttgcaaaaatactttaaaatattcttacttcaagtaggtgtactaaaaacaaatttctcagttgcatccctgaaatccatcgaaagcccgggagagacaatcaagtgcttcaggaccaagagtgaaacaggagaggacaaagcagggcttcttcactaggagtcaagccaaagtcaactgatttggtctccaatggagaacggaactcggttcaccagcaacgtgaggacgtggcccagaggagacggagtttcccttcatggtgccttcagataggaaatctaggattttctttctttccctttgatctacttccaactctccctttctgtttcttcaagatctttttcggatccctgggtgcgaaggacataaggggccagtggccttccctactggtccctccttgactgggtgtctttggagcccaagctcacccggaacattactgcccgctgcagacagtgagaggacaaaggagggcggtgggtgcagtgggaaccacagagtcaccgtgcacctgcgcccgtgggctcctagcaaattgaataaatgccccctgaagcttctctgcaggtcagagggaaggggagggtggctgccgacctggcgggagaagcttcaagaaacatcgggaggacttggccctgcccctgggccttgaagacaggcctggccaggctgattttgatgggtaggcccaaagaaaaggttcgagggcagcccaaaccccgaccctgagattaaggctcttaagtgtctgacagttttgagaatcgtcagtagaatcgatcctgcctgtatcaggagacttctttgccaaaattcagagaccaagaaagagaaagattgggcagatcaaaatctgtcattaaccaaacaggaaacataagttttctgacaaattgaatgtgtgctgtgagaaaaagactagcctcaaggagaacctggttttttggcttgagtgtagggaagaatggagttgccaccaacaatggtgcgttgaaacggcaggtgcatcaggctgtagatgtgaaggaattaaaaatattttaccccaaactacatttctttgacatattttgagatgtctgttcagaaagccagctgcagaagtagccctgcaaagttgtcttttgttggggagatttgcatctgtagggaatctgcattgatacagccaagtctttccttgtccagatctaggaaagatgaactgagagtctgacacctgtaaaggtctgaaagaaacttttagggtttattctctctgagagctgctacctgtaaggtttcatttacatattaagaccacctttgctagccgagcctcattttctctccctgccatcacttatcttgtccacaataaatggatatacctctgactctgattgcacctggttttggccatgctttgagccctcattcattctgttatctcgagatggtatataagcttctgcatcccattgtgggtaggggagggtaatcactctgtgactctccccatgcacatgttagtacattttatgccttttctccaattaatctgccttttgtgacttgatttttgagtgaaacttcagagagttaagagggagggtttccattggcccctacagttttggagctgtaaacaggataggaaagctctgctcttctggaagctgcagtgaagaacccaggatatgatcagctatcataagggtaagaatttttttaccagccaggctcctggcctccttctctgtgtggaatctcatcaagtggatggtaaaaatcactgtttctttcttttccctctccaaaatcttgattaattggagaaaaggatttgtgtgactagtcttgggtgtagtgactctggtgtgctttttggtactttgtggtaccaattcctattgtttaatccctttcttcccagaaattgtctgttcctttgtctttgtctctatgtgttattctgtcataaaagggggtactggttgaggttccttctcatcttattttatgtccttgagagcttgacttgtgaccaagtggaagcgctttctcttggtttccactatctggaaagaggcggtaactttcaggtcatactaggtggcctgtctgaaaatggctgggaaccccagcacactttttgttctgaccatgacaagctcttggggtttgtcttaagaagtcccatccctttgaggcttttgtcatctcaattcttgttgcctggttagttctaggaaagctcaatcccaagatggcctacctggtatcatggattcacaggtctgtgactggaagtccccataaatttgtgggttgctggaggcaaacatcatccttacccatctgtggtctactctactaaaaatacaaaaattagccaggtgtgatggcatgcgcctataggcccagctactcgggaggctgaggcaggagagtcatttgaacccaggaggcggaggttgcagtgagccaagattgtgccactgcacactagcctgggtgacagagcaagactctatctcaaaaaaaaaaaaaaaagaaagaaagaaaagatttaagagaacaattattttaattgaatacattttgtcaagattaactcaactttcccctagagtagtgaaagaataagcaatcgtaatttagattctaagttactggtctttgagaaagtgtgaaaaccaaaaaggtgccataagtcaaaaagagcaaaagtcctaattttcaaactgatgaaaataaagtactaaaaaattgaaatcatcatagttcatcttggtccttggcaaaatacaaatgtattgattcaaattataatatcttagctaccctattgtgcgtagctcttaccactgaggagaaaaaccaaacccaaacaaaagtgtgttcaagttggcaacaatgtttacaaacctgcaaaatctcttcagcctatcccttaaactccagacttggtatttactaagctctgtggtgtacaatacccaccttaatatccattcttgcacaagttctgttaggtataagccaagatgacatgagatttttttttttttttttttttttttaccctctcatgcctatgtttgcttttgcttccacagacccttctgagtaaggactatcctcagactactggaggcacttagtcacaagcttgcctgaggctcagagctggcaatacctgggagtttatgtcaatcccacagcacccagcaaccctgcctgcaaaatatttacccatgattgacaggtgcaggtgtatgaaagcccagctccttgacttgaggggcacctttgtggtgaattaggtttggcaaaagggaatccagaggccaactttgtaaaaatgcagatagataaatagaaagaaatctttgccttggaagtccagttgagaaagagagtgatttacttgagactctgaaaacagagactaaaatctgtactttttcatgggaaagaagcctatggtgaaagagaaacaaagagaaaggtaggaaatagggtgggtctactccgtagctttaaaccactctgtcatattataaagcccggtgaggttttaactaacacaagtgtctggactctacacatagagattctgatttaaacgcttccaggtgggtggaagccactagtagtcttaaaacactcccaagtaattttaccatgtggctagagatgaaaaggacaatctatctactagaatctcaagtaaccattattgaagtgccccaaatgtgcagctacctcatagaaaaggcttaacaccaccctttgatggaatttcccttcctctctccatggtcttgtctgcatagcatggaaaatagagaagagataaagaggtagatggagaggttgaacctgtaatttgcctatgtagagcagtttctcaaacttttctgaccacaagatgcagtgagaaatatacaattctttgtgatcagttttttttttttttttttttttttttgagatggagtcttgctccgttgcccaggctggagtgcattggaatgatctcggctcactacaagccccaccctcctgggttcacaccattctcctgccttagcgtcctgagtaggtgggactacaggcacccaccaccatgcccagctaatttttttttttttttgtatttttattagagacggggtttcaccgtgttagccaggatggtctcaatctcctgacctcgtgatccacccgcctcggcctcccaaagtgctgggattacaggcgtgagccactgcgcctggcctgtgatcagtttttaaaaaatcttttactatgtgtaatccaccctacctagaatttaaataaagcctgcagtagtaagcagtcgactatattgatttcacaacccctaagtggttcagaattgcaattagaaaatttttccttttggccaggtgtggtggctggagcctgtaatcccagcactttgggaggatcacttgaggtcgggagtttgagaccagcctgaccaagatggaggaaccccgtctctactaaaaaaaaaaaaaaaaaaaaattagctgggcgtggtggtgcatgcctgtaatcacacctacttgggaggctgaggcaggagaattgcttgaaccccaggggctggaggttgtggtgagctgagattgcaccattgcactccagcctgggaaacaagagtgaaactgtctaaaaaaaaaaaagaaaataaataaatttttacttttgctctgcctttttatcaagcaaaatcccaaaagaacatttactataaacatctttctgtgaatccttatttctgtcccagccaccatgacccaataatctctagagcctgttagtgttctccagattgaagccttccctctaactgctcctaaactctgtgatgtagtggaaaagttttgaggcctcgattctcatcccaggtttttcacctacagatcatacggccttagcctcttgacaccattgtctccttatggccaaagatggaactgtacttgggtggtatctgagcaccctgttggctttgacattctagggctcttcccttggcaccactctcttatttaaaaggaacaggatgtggacttaggagggttatttctctgcaaactatcctctctttcttatgacaagctatttctgaatgtgcacatttgaggctaagcaaattccttcctgggaggttgaaagacccttatttctctccagaggagtattatggagagtcaattgatgctgaggaggtggtagagacctagtgaactcatctgcagtggctttgagcaaggcttttagaatcataaggtgggtggggtcctgtgtcctacaccacaggccagctagttcatttcaggagacttttttttcaatctattattactatcttcttctagactgtagttcactactggagattatccacttagttacactcagtttgcacctggcctgtatcaccagtcagctctcactccagcctcaggtatcagcaagacctcaccaaagattattgtttaattttgtgtgtgtgtgtttttgtttgtttcgggtaacaactaatgttggaactatgaaaagctcttctctacttttaacaaagcttagtcacaaacagttccccagttgatgagaaaaactaaaacaacagaacaattgaaagtccaaatctgcaagctcatctctgagaaccgaattctacagccactccagatttgtactccaaatggatagtttgattgtagaaatcacatcccttcagtctgccaatgtgataagggcccaagagacagtgatgcctagattcatagataatcccctttcccccatcctatatataactggagtcaacagcagctggaggaaaatggcaagaacttggaatcaagattaggttagaataacactgctgtagacagtttatcagctcttcagcatacgtccgttttccttgaaggatgagcctgtagaaacctctgacaataaagtttattttacacccattcccttgcctatgattttttcatacaaatcacaattataaaactttcttgctccagctaaaagcaggaaactcaatcatgaatgtgttcactaaatatataccacagaatgataacaaccagtctgattgcatcacttgattccaaaattaaatgttagccctcaggggtgcaactacatgtatctccaactctggaagccacaggcaacatattcctgtttccttgcagggaaacagatctataagcagggcggcagtctgacacatgtacattcctgggaaacccaaggaaacaatgatagtgacgcagggcaggcaagcccccaaactgaaagagttttgctaatgtcgcgattggctttctatgttatttgaagactgagatctccatgaggagtgaagataggtaatgcctaaggctgaggcatgacctcactgggtcaccttagctgtaaagtgaggtcagttgtcaccttgcaaaccttttggtaatccaaatcttggaatgatttctttaagaatttagacacttccaatacttttcctgtccttgtggggaaagcttctatccacctggtgaaagtgtctataaatactagcaaatcttgtagtcccctgtaaggtggcatctggtttaagtctgtctgccagtcttcaccatggtatgttccttggtgttgtacaggtttaagcagggatcggggtatggggtggcttcctgagtggtaaccctttttatagtttggaacagtcccttccgcaagaatatttaggaaactaatttaaatggaaaatcctgtcccaaatgtgaggaatcatgaaaatgtttaattatttcccatctgtcagcctcaggaatagagtttgttcttttctagcaaccatccagatgggtctccctggaagccttttactcagtccctttaatttccttaggggtatattatggtgtcactgacacggatggagtacctggtagtagcgcagcagcctgaaataccagggtttccttagctgtggccttagctgctctttccaccagggaatttcctctaataataaaagtgtctcccttctggtgtcccctgcggtgagtaattgttatttctttgggagttggacagcatctaaaagttccaagatctgagtaaagttgtgtgggggatcccttggctcttgatagtcccctttccttccctatggctgcatgagcatggagcaccaggaacccatatttagagtcagtcaacacattgactcttgaggttttgttctttttttttctttttttgaaacggagtcttgctgtgtcgcccaggctggagtgcagtggcatgatctcagctcactgcaatctcagctcactgcaaactcagggattctcatgccccagcctcccaagtagctgggattacaggcgacccccaccacacccagctaatttttgtatttttagtagagacggggtttcgccatgttggctaggccggtatagaactcccaacctcaggtgatccacccaccttggcctcccaaagtgctgggattacaggcgtgagccaccgtgtccagcttaagtcttttcatggttggaaggccctaattagagcagctaattctgctttttgaacagaagtctgagaaggtaaacccttggcctcaaaaacttcttgttggctaagcttcctttcttactccctcatgaatatagctatttccatctctaaaccactcaacatttgggttagacaagagcttgtcttcaaggttgggccttctagagtagagctcttccgtggtttccacacaggagtcaatgagtttgggatctgtttcttgagacgtgaggtgcagcaacagagtagcagggtttaaaaatcaggacactttcagggtaacatctggggtgtcaagcagaagggtctgatatttaagtaactggccccctgttagccattggtgtacttttgcctctaggaccctctgtactgtacttcatggggtggcagggggtgggggtgggggtggggtggtatggcatgtaattgttgtcccaaggtaaacttactggtttcgtctaacgatagagtgatggtagtcacagatctcaagcttcttggtcacctagctgccacctggtctagctgtttagagaaataagccactggtccaaagcaattcctcagcctttgagttagaacattcgaagctgtcccttgttattcatccacatagagggtgaaaggtttttctaagttcgagagtcctgaggcaagggatgtccctggcttttcttttaaggctaagaatgccttttgacaggttccaagctccgcctcctgggttcacaccattcttccgcctcagcctcctgagtagctgggactacaggcgcccgccaccacagccagctaatttttttgtatttttagtagagacggggtttcaccgtgttagccaggatggtctctatctcctgacctcctgatctacccacctcggcctcccaaagtgctgggattacaggcgtgagccaccgcacccggccaacaagtttttttttttaaatgaacagagcatcagtgaatgatagtgcaagtttaagacacctaatagacaagttaaaggagtcctccaggcagaaggaaactgacaccagatgaaaatgtggatgaaaaaaaaaaagacactagaaatgacatctacataggcaaatatataattttaacatctgactgtttagctgggcacgatggctcacgcctggaatcccggcactttgggaggccaaggaaggcggatcacttgaggtcaggagttcgagaccagcctggccaatatggtgaaccttcctctctacgaaaaattcaaaaattagtcatatatggtggcgcaagcctgtaatctctgctactcaggagtctgagtcaggagaatcgctcgaacccggaaagcagaggttgcagtgagccaagactgtgccactgcactccagcctgtccgatagagtaagactcgtcttaaaaacaccaccaccagcaacaaaaaagcaaaaacaaacaaacaaacaaacaaacaaacaaacaaaaacacatctgactcttgaaacaaaagtaatagagatggattgtaaggtttataacaggtgtaaagtaaaatgcatgacaatagcataaaggcagggggaggagtcatgtgaagaggtatgatgccacttgaaggcagactgtgatgggttaatttttgtggaaagcaaggcagaatttttgaagtttgtttcttcaaatactttctgtttcccgtacatacaagctagtttgttctgcagagatctcattttctaggaggctcggagggggaccttctgctgtctgtcctcatgggatgcacaagacacaagggaacagtctttcacttttaaatacattgatgggtctgaggagatagatacaactgcattttttttttaaatgaggtgggattctcattggtcttgaacttctgagctcagtggaggcttcccctacttcagcctttcaaagcgttgggattaataggcatgaggcactgcgcctggtcacaaccaacgtttaaaatcacgtccctgggtggtctgtaaccaccaaccttatggttaacagccgaacgcgctaaccgattgcaccacagagacaacctcaatcgcttgctttcatctctatatagattaagcaatcactaaaccctaggagttgccatttgctttctgcgggacaactgtgcagactacaaagcttcagaaaaccggagaggctgagtcgactaatcgtgttgttgcacgttagaaacgcgtgcattgcgtgactctgaagccagaagggcggccgaatggccttcaccctgcgttcaccctcgcctgcttcagaagccagtgcctctggaaatgcctggatctgcgaccccagcctgagccaagtagggcccaagggaagctgaactccccgacgtctctcatggtagctctttctgttcttttgcgccgccttcaggcaatcatctgttccgcttgctctcccttcactcaactcggcttcagtagatggggtcggtggggcgggagcgggaaagaggcaggggagtcaaaagggaaaacgtgaaaaggaggagggagaagcaggggagaccaggactagacaatgggacagcccaggatgcccgtgcagagggcaccggctggatgcagagaagatgggacatgtatcagatcggagaggaggaaatggggagaagatgtgagagaaaatcacaagaacctgtagctgcccaagaataaagaagtaaaaatcgcataatgtttttacattaataaaaaaaatcgggggaccaggggcggtggctcacgcctgtaatcccagcactttgggaggccgaggtgggtggatcactcacttgaagtcaggagttcgagaccagccgggccaacatggtgtaagctcgtctctaccacaaatacaaaaattagctgggcgtggtggtgcacgtttgtagtctcagctacttaggaggctgaggcaggagaatcgcttgaacctaagaggcggaggtagcagtgagccgagatcgtgccgctgccctccagcctgggcgacaaagcgaaattctgtctctcaaaaaaatatataaataaataatagaggggtggggaagcaaaacgacgggcagtaggtgtggggcgccttgggattctctagtggttagtagtctgcgttgtgcctgcagcaacctctgttctaatccgaatcctggtacagtcagactctatcttggacccactggggcgaacccacgtgtcttttggtttgcttttgattcctgcaccagctgaggcctttatctgcagccagaaagccggaaagcagggtttacccctggccccacagcgccatactgtctggggaaaagaaggaaacccaagagtacacaaacagtggcccaaagagaaaccttccaagtgctctatgcctcaccgtttagcagaaaatatcaagcaactctcaatctagctggtctgtaccttccacgaatgaaataatgtatttattgcagtctttctggttgagatatttcaaatatttggtggagcttttaatgagagagacactctcgagtgtggaagaaaaaaaagaggggatgtgaagataaggcgactttaggacagaaaaaaaaaaagagacaaggaagccatgtaaacgtttttggatgggcgtgaggcgttgtcagtcttgaaccccgttatgtcaggtaaagagcgcagcctcttctaccacaaacaccatttcccacatggaggaaatcacagggatcagcaactctagagtgagatgaagaagcttcactctgggagaacccccttcgtgaccacggtctctcccctgccaggtaaagtggaaatgagcacatggcttgcagggacagcacagcctcctcgccctggccggtcgctcagggtcaccaccctccccactgccgcccctcgccattcttccaaaccactctccaccaaagattccaccgacagtcaccccacaagacaacccaggccgcctctcagcagcggctcccgccccgcagccaccgcgccctctcacccccgcgcggttctgcccgccgcctctgccgagtctgcgcacttcacctccctggctcccgctctcccctgagcttacagtggactcggggttcttccgaacccctcttgggagtactgaatggaaaagggggagcgtgcgcaagtgcttggtagagtgtagacgtcgtgggatttgactgtggtacaatcgcttcgacgtcctagtgctgatttttccacctgccttctgcttagggcaccggcagcagttttccgtctgtgcctactccacctgctgtccttgttgggtcagcgaacatcgcctccctctaccgctcaatcagcaaacgggaccgccctcgaggacctcacccgccgcttacccccctaacaaattcgcgggcatcgcctccggtcgcctcttcccaaggcctaacgagcgccttcgctggcaacggaggtgaggaggctccgctgactggctggtgcccgtgtccggggctgccacaaacgccacgacttggcttggcctctctcttagttattcgcagctcagcccgatgggcgtctccggggtggcgacgggaaagaaggtgggcttattgggtgcagctccacgggggctggcatctctgccgggctgtgtacacctgagcgagaagctcagtcgctctctaaagctgctcccgcggatgacggacacggagacaaataggaacggtgtgtcgtgagaggtggtccacaagcacttgccctccttcgcccggctttaaccccgctgcggagactgttctgcttctggcccttggagcaggccggctgacagcgtagtgaaggaagattcctgcgggagggcggccagtgtaaaacaattccctgaccgggaatcgaacccgggccgcggcggtgaaagcgccgaatcctagccactagaccaccagggacacacaggagggagctttctctcccttcttctgtcagaagcgacagcttccctgagctctgggaggacttgggccttgtgagggtcgctctttgctcctggagtctctcacaaggccattccctccctgctttcttcaaaaaaagagcctgcaagcgacacaccgagggctccgcgagggacaccgaggccacgagtccgaaggcctggagcgagttgcagcgacccggccgcagctcaccactggactagagatgcgcctttgcgaggtggcagcaagtgaccagtcggtcgtgcgtcgccaggtccggagccgcgcaccaggttgccaggaggaggcgggagcgcggaggcgcccggggtgagacgggggcaccctctgcatcataaaggacccagacgccagcaccctcaacgtcataaggaatcagacggatgcggaaaccgagacgggctggatgggaaactctttccaggaaggctccggggccctcagctggtctccgaccttcccctgcaacctgtgacacctgccattttcccatcttaggcgatggcaacgccacccttccgtttgctccgggcaaaacttcgagagttccctctgactctggagttttttcctcagatccaagagccaactggtcatcaattcgtaatttcccatcggctaagtgcgtgggcattgagctacacgcgagtctctccacctctgcggaatggctacttcggggtaggggaggggccctcccgtggattgtaaggtgtttagcagcagccgtcgcctccgctgactagatacatgccagggggttagcattctccctccccgcttcccccattcgtgacctagtgtcccagcgtggaggtgagaggcgtgtaagggcaaagttgccccctcttgagaaccactgatgcgcgttgtcctgctgtctgagcttgtgcagaggactctccagatgaaggctcaggggtcgatccagcttgagaccccctcgctcccccgcacagtcagaccttaggattggaggcttttaacatctctacatcatgagattcgaaacctttaggtcttttcttccgttctgtcctccaaatcggcctcttccgagcctgttgaccagggccagccaggcagacggctgggttcgctcaacgaggctcctctcggccctcctggagcttcaggcctctttcggttgcagagaaactttatgggccacttccttcggcatccccgggggcaggtgcgcggtgcccggggaagaagagggtttgactgcggttctcgacccccggcgaccaacctccaccccggtgggcgcgcttttccaggctcctgctggtcccactggccgggagttaggtctcgggtcagcctgagctccagagatgcccaggcccggaaggacacttaggggaaaccagctgctcactttggtcttgtccgcaacggacctcttgctgccaggaaagaaaggcgtcgagtcctgtcctgttgggtaggcggaagagagatcaaagggaagacaagaaaaatcctgggaggtttcaggatctaaagttaccatgaagtcgacctaacctcctctggaggtcctcccagtcctcccgtggctggcgatggtgaatcgagtttccgtctccagtttgccaaggcggacaaagccgacacaatgggcctgtccactatcttctttcatatacacaaaatgtcagcttttcctgtttctaactggcaacatcccgcctgatgaccagcttagcaaattagagactctccatgggattccatctgtgtcttagttcgggcttctctaacaccgtaccatacataaactgggtggctgattcacaacagaaattgatttctcacagttccggaggttggaagtccgagatcaaggtgccgacatggtaggtttatggtgagggccttttgttctggttgtagactgccacctcctcattgtatcctcagggggcagaaagagggcgagagagctccccgaggtcccttttataagggcattagtcccattcagactaatgggactaaatccagactctgtgctgagtgttgtggattttttgcatgttcatcctccccgcaggcaactggagatgtattgtccccagagggtacaatagagaatcttccgtcacaagtcagcaaccagcatatgtgagtgacagcatgtgttccactcagaaatgagagtgtattagtccgttttcacgccgctgacaaatacataacatagtccaggacgaaaaagaggtttaattggacttacatttccatatgactggggaggcctcagaatcatggcgggaggcaaaaggcacttcttacaaggcagcagcaagagaaaatgaggaagaagccaaagcagaaacccctgataaacccagcagatagtgagacttattcactgtcaggagaatagcacaggaaagacccacccccatgattcaattacctcctcctaggtccctcccacaacacatgggaattctgggagatacaattcaagttgagatttgggtgagggcacggccaaaccatgtcagaaagggatgaagtgacagcatatcctgatgtgtgtgatggttttatgagttattacctatttcaaaaattattgcaatgtgtaaaaaagaacaaggacttgtactatctgactttaaggcttactataagctattacagacaaggcatcaggagtgacaaatagataaacagactgagttaagagacttgaaactgatccacagctatacggtcaataaatgggttttcaataaaagcagttcaataaaagaaaataaatcatttcaattaatggacttttatatggatgtggggagaccaacaatgttattctccctcacactacacacaaaagtaatttcagccgcattacacaccaaaacttaaaagttaaagatataaagcatttcaaggatagtttgtgacttgttggtaggcaaagatcaccctaccaacaagcaggacacaaaaaatacatatataagaaagacatgataaatgagacttcatcaacattagccacaccttctcatcaaaagataccactaagaaagtgaaaaggcaagcaagtcacagacagagagaaaatagccacaaaacgtgtctgacctccacaccctgcagttataattatagtggtctggtacactgcgcccagtttctgctggatggagtattttctgggtgtctctaatgagtaagagagggccccatgggatattccttcagttcccaggtgaacagtgggaaagactccacattgaccaacctcgggggcctaaaaatccaggtcctataggagggtagagtatacctggaccctgacccagacccctggatgggttgtgccaagagacccagcaagggaaaggatttcctcctgcctcaggttctctgtccttctgtggttagacgacctgaacccaactccctccccaagcactggagatggggcttttccaagggctggggatcttgctgtcctgagaacagctgagcaagggggtcgaggaggagcttgggtggtggaggagaggaaaccgggtaagatgcatgaagccgttggctataccaggcacagagaggacccactgggacccaatggcctgcatgtgaagccaggccttgggccacctcgttcctcaaaggggtgctgacttccatggggtgttcaaagggactgtggaaagagaggccttcagcccacacctctgaatgcttttcgaccacagcatgccctgtggcctttatcctgctggtgtggaacagtcagagccctgcagggctgcagagcttctgtactgggcggcatcccagcctgagtgtcagagctcagagagcaggcaccggagcaagtagagaggagggcaccttttggacagaatgtgtgggacaagagcgacggctcatccattcaggttcctcagaaaatgagagtcaggaagatgagggcgcagacctgattccctacacagggctgaaagcagacaaccggaggaagagcagcacctgggccaacgaggtagaagacagaagaccacagtctactcctgccctcaatctcaccccttcccacccacatcctccacgccccctgatcaccttcctcagaagtgtaataggaatccagattccccctggcctggttgctgcgggaggcacagtggcctgatggagcctgaggcaggtgtgggaagatgtggattgtctaactggaggttgggagttcagggtgaggaaggagaagcttggagtgcaggatttggtggtatgtatgtggctgtaggcaaaagaaagagacaactaagccacttgaaataccatgagaattcaaatttagaaaattcccagggaagtatgcatgcaggcactcatgagatccaaaaaacagctgctgcttaactgcgtgttgcaagcaagccctaaattgctgattttgaaacagcctgatgggttcacaaagacaatttctgaatagtcttaagagcagaggtgcactaaagccactgtgccccgcagctcaggatcccagaaagttctttaaggagtaagtcttacttccatttatggaagatttttggagttgtccttagtcacccccaaaaatgttttggttaggagtagaattttagatgtcatcaatttaaaaattaaaactgaaacgctggaactcatagagagataaaattaagagaatccattcacatcctgagtagaaagatttttatagaacatgacgggctttaaaaataaagaaaaaatatggcaaaatttcatcaaattaaatgctttcagaactaagattaaaatctgaagccacccaactagctggacagatggcttctttgccaaggagaccccagagaagtcttaaatactgagttcctggccagtacttggaagctcagacacctctccttatactctctccctttgtggtttagacacaactgaccagcattattgttaaaatagagatcctaagactgacagaacagagtccttacagtagtaagataccatattataaacaagacctaaggccatgccaggcaaggttaagtcatgcacccctcaacttaaagaataaactatgttctaattgccacaggtttttttcttcttcctttttttcctctagctaaacaagcactggccttgagataagcaatgctgaagcacttgcagctcacccattagcataaactgactgagccctccctacacaagccataactacagctttgattggacaagagactgatttcagtaacttccccttgataagagagcactggctgtggacgggttctggacggtttacagaggctgtgcacttgactgcctttgtgtccctacttccccttttgaagcatagggcctaattataatgtatttaaatgtcatctccaccccaaagtgaacatgggttgcatgtaacaggcttgtttactcagcatgcatgcagcaggatcccttcatgaatattcagagctcctcctattccctgttgaatatgcatatgtggcccaccacatcaacataaatccctgttcccccctcccctccctggaaacctacttttcggtttcagcaggagggtatgcctcccagtctgtgggaatggccaccttgcaggctgtaaccatttataaaaaataaaatctcccttctaaatttataaattgtgtgatttttcagttgacagctttcagtcagacttttcactgactgggaaaagtcatttgcaatatatttattttaaaaatgactcctcaggatacaaaattcttgtgcaaagatcacaagcattcttatacaccaataacagacaaacagagagccaaatcatgagggaactcccattcacaattgcttcaaagagaataaaatacctaggaatccaacttacaagggatgtgaaggacctcttcaaggagaactacaaaacactgctcaacaaaataaaagaggatacaaacaaatggaagaacattccatgctcatgggtaggaagaatcaatatcgtgaaaatggtcatactgcccaaggtaatttgtagattccatgccatccccatcaagctaccaatgactttcttcacagaattggaaaaaactactttaaagttcatatggaaccaaaagagagcccgcatcaccaagtcaatcctaagccaaaagaacaaagctggaggcatcacgctacctgacttcaaatgatactacaagtctacagtaaccaaaacagcatggtactggtaccaaaacagagatatagaccaatggaggagaacagagccctcagaaataatgccacacatctacaactatctgatctttgacaaacctgacaaaaacaagaaatggggaaaggattccctatttaataaatggtgctgggaaaactagctagccatatgttgaaagctgaaactggatcccttcattacaccttatacaaaaattaattcaagatggattaaagacttaaatgtcagacctaaaaccataaaaagcctagaagaaaacctaggcaataccattcaggacataggcatgggcaaggacttcatgtctaaaacagcaaaagcaatggcaacaaaagccaaaattgacaaatgggatctaattaaacttaagagcttctgtgcagcaaaagaaactatcatcacagtgaacaggcaacctacagaatgggagaaaatttttgcaatctactcatctgtagattcatcagaatctacaaagaacacaaacaaatttgcaagaaaacaacaaagaaccccatcaacaagtgggcgaaggatatgaacagacacttctcagaagacatttatgcagccaaaagacacatgaaaaaatcctcatcatcagcggccatcagggaaatgcaaatcaaaaccacaatgagataccatctcacaccagttagaatggcgatcatcaaaaagtcaggaagcaacaggtgctggagaggatgtggagaaataggaacacttttacactgttggtgggactgtaaactagttcaaccgttgtggaagtcagtatggtgattcctcagggatctagaactagaaataccatttgacgcagccatcccattactgggtatataaatcatgctgctaaaagccaaatgattataaataaattatatatttatttgatttatatgattataaataaatgattattataaatgattataaatgccaaaggattataaatcatgctgctataaagacacatgcacacgtatgtttattgcggcactattcacaatagcatagacttggaaccaacccaaatgtccaacaatgatagactagatgaagaaaatgtggcacatatacaccatggaatactatgcagccataaaaattgatgagttcatgtcctttgtagggacacggatgaagctggaaaccatcgttctcagcaaactatcgcaaggacgaaaaaccaagaactgcatgttctcactcataggtgggaattgaacaatgagaacacttggacacaggaaggggaacatcacacaccagggcctgttgtggggtggggggagggggagggatagcattaggagatatacctaatgtaaatgacgagttaatgggtgcagcacaccaacatggcacatgtatacatatgtaacaaacctgcatgttgtgcacatgtaccctaaaacttaaagtataataaaaaaagtcaaaaaaaagactcaattcttgaatatacaagagaacttttgtaaatcagtaatatagagctaagccaaataaaatagggcaaaatatttgaatagtcctttgcaaaggagagtttcttatatgctggaagccacaagaaagtatgcttcataggattgctcattaggcaaatacaaattaattccacactgagatagcactaactactcaccagtgtatggctacttttttttttttttttctgagacagggtctcattctgtcacccaagctggagtgcaatggtgcgatcttgactcaccgcaacatccccctctggagtagctgggactacaggtgcatgccaccatgcccggctaatttttgtattttgagtagagacagggtttcgccatgttggccagattggtctgagagcatagctacatttaacaaagttagtacaccaaatgctgacaagaatttggtgccacttcaactgtcatcgctggtgaaaaacattctagaagactggcaatttatactgatgttaaacttatactcaggtcatgacccagcaattgaaggacttccatgaatctcaagtgcacacaaagactgttataagaatattcagcacaagaattcaataaccccaaaattgagaagtgatctatgaaactacatggatatatctcatgagtataatgaatgtaactgcagaaaaaaggccagacacaaaacatatgtacattcattcatgtgaactttaagaacaggcaattgtaacctgtgggaatagacatcagaatagtgataactaagaggacacagggtgggaatcacctggacaggggctctaacaggcctttctcagatgatggcaattttctataacttgagctgggtggtgataacattgatcaaaactaaacaaattgcactaaagatttgtgcactttatgtgaactgtagcttctttactgttctcattgcttgaacctgggagacacaggttgcagtgagccgagattgagccacggcactccagcctgggtgacagaacaagactacgtctcaaaaacaataataatagtaataatttactgttctcataaaaattagcagatggggaatggaggcaagcctgtgcagaccatgacaactagtttagattttattgtcagctcattaaaaactcgtcctcgttttgtgtttttaaaaaattccactgatacagccgttttctctaccagaaaagactataaccgcattatttcatcagtggaagctacagacaaagggcccttgagaggcggcatcttcacctacgggaatttttcctgctcaattgtgagacaaagagcatgtccaagttttcctatcggccaggccgccccctagtttctgcgctgtgggctaaactccagaagctggcgcccttcagggccagaggtttactctgctctctggaggctgctaggattaaaggcaaagcaaacgacaggtctattagccacagttgcaggttagaaaacactactgtgactcagattagaacccaggttgtggcaaccacaactacaagtattaactactacacgaccacaaagcctgctgacaagcattgcacttctatgttttgaatgtaaaaacactcacactattttatctgctttattgttggacgtccgcagattttcgtgcttttctgtctttcgtgcgcttctccctttctctccccattctgctacataattaaaaaaaaaatctcatctctcaggatccgaccactgcctctacaacaagcctcctgggaggtctctttgtcccattgacatctctgccttctttcgctgctttttttttttctttcttttttgacggagtctcgctctgtcgcccaggctggactgcagtagcgcgatcttggctcactgcaacctccgcctcctgagttcaagcgattctcctgcctcagcctcccaagtagccggaatagcaggtgcatgccaccacatttggctaatttttgtatttttagtagagacgggattttcccatgttagccaggctggtcttgaactcttgacctcaagcgatccatccgcctcggcctcacaaagtgctgggattacaggcgtgagccaccgtgcccggccaaatttcaggccaacacctgttgacacacattgccagacacacggaatctctcggggaacaccgatgggcccacaaaacacgcggaggccgcggtcgctgacgatgtgagcaaattcggttcacggtgtctggggtacagccctgagggtctactggccgcctctgcgcaaggaccagtctccgccgctcccctcatctccacgcagattcttgcccacacaccacccctttctttgggccgctgacgcctcttggacctctgaggtgactgtcctgcccgcagcttctctccttccaagagcgtcatttcttgatcctctccatagtggctcaacggtaagcccaaggtccagcacgcgaatcaggaacctgatggttcttcgggtttgcagggatccttccagtgaatagatgaaagtcacaggtaccagtatgaaaactgcagtgactcaccggaaacacttcatgcttgtcagcttgctaagctgtttgagtccaacaactgcatggggtcctgagttagtctcctgaatgtctcctgccgctactttcgtgagtgttgtcgtcactttaccttgtggtggccaagcccctaaatgcactattaggttatgcagtatgattttcagcgtaaaagacagataaagagcaacagcggggtgaaaaagaccctcttgcattggccgggaattgaacccgggtctcccgcgtgggaggcgagaattctaccactgaaccaccaatgcctctgcgtaacaaccgcctgcaggataacagaaaacagtatccacaaagacttagaaaccgttccaagcggttttttcaagtgtcgactaaaagctaacaaagacatccaaaccaaatgtgtttttacaggaaacttttactagacaacgttataaatatcaaaatagctcatttgtcggatcaaactcttaactctgaaaaaggtctttctttctacctgcattacaaacccctataataaaacatcagaaattcattcacgtttcttttttctaatcctaaatcttccatcgtcaacctcaaactgctgccttagaggttctaagaaggtaacctaactggtagtttaggtaagtaaagttcaaatccagggaggaaatcagtagcagaagcagaattagaagaaagaggaaataaaaggacagaaccaaggtagagataatgaagaaacaaaggttggtccactaagttagtcttttgtcgctggtttttttggcaaaagagtaatgatcagtctcgtaatcattataatactattatttgtctgcttgaagatgtataaagcatttgaaggaaatgtgatatgaaaagatgaagaacgctcgctgtcaatgtttccttgtttgggagaatcccatttcctaagttaatatgctttgatgtattagctatgtaagcagtagactagtttaaggaaatattgacggtcaaatattagcatattagtcttttgatgaagttcaaatagtagagagatttctttcctcaattttctctggaaacattcaactgaagagacaaatccagagttttctccatatgttgggtctgggagtcattatgactttttcaaagacaggagctgtgacatggaatcatgcttcttctctagctgagaagccaagctaggtccaggctgcgtcataaacttgagcccaccaaggaaatcacccttcacattgacctcgcagagttttggctgttctctgttctttgcccaacacccaagacacacaccagctctggccaacaaaccttaacatatgatctatatccaccagagctatatttattcccaaatctccttctaaaatacaaacctgtactttctactctcaacttctaaatttacaaaggcctcatatgcatctcagagtcacagatgctaaaacttaaccggttttctgaggattatttggggaaggggtatgcatgcaaatgtatatacataattcatgtgatttaggaatattgactctatgacttccagatgcagatttagaacctttttaaaaaatattttgtttttgttgtcttgcaaatcagccagatctgcaacttaccagagtaaagcgaagccaagcgggacccttaggaaatgcactaagatgtcatccactttcagtgtcagcctgtgaaaatacaggcgatagaagagaatgaagagaacctgaaggaatttctggaaccaaagctaatattaagcaggcctcttgctggcagaccagtggaaactgtagcctggtcaacgatctctctagattgaggaggtctaaagtgtagccacaggttcaactacttttctgtttgtttcccaacctcgattaaactcactaaatttagggacaaaaaaacaaaacaaaacaaaacacgatgttcccacgcagtctcgaaccagagacctttcatatgtgaagcgaacataataaccactacaccacagaaactgcatatgcaccaaaaaaggcaaaatatcatcatgaaaatcttaggtcagccatttctattatcgtttccaaagtaagaaattcaactgcatttcgaaattcgactgaaaaaagcccaataagcaccagccatcaagaagactatggctcccaataggcccaggcttagcgttccgcgcccacccccaacacgaaaaccatggggacccacacccgggcttcggggacacatacccgggcttcgggctcccgcatcctcccctgggtatgcagttccagaactaagcgccgtgtgcgggatcctcccggctgacactcttcggctcccagaagctgcaggagccggcgggctttgagcgtccgagccctgggcgccccgtgcctctcaggagtgtggacgccgcccttccagggatgcggaccccgcctcggggccttttccccggcgccggccgtcggggctcttggctcttctcgtcctcccaggaaccgtaggactctccttgccctccctcccgtaggccgaggggcgcgagctgcgcctgtttcctcacggaccctttggcctcagcgcctcgacgtcttgcaattcttagctcacggctcttcctcctataacaaggcccttccatgtcatgtcccctactccctcttagcaccagagagatgtctcccctgccccacaggtcacattccatgagtggtgaagtttctagagttgtaaccatggcatctccagccctgtgtgttcctctccatgctccccattgagcagtcttgatcctatattagccccaggaaatgaaatagaaacaggaccctacgttaaaaagttgcagtggagatgtggtggccaccaggggctggaactgtggggtgactgagagtatccaaagccctgtggccaacctactggtgctgagtgtgctggtgagcctctctgtcagctggcttccccgggccagttgctcccggaagctctgtcccaggtagtagtcaatgtcattgctccttaggagatcctcaaaagattttactgtatcttttgcatgctgggtgagaagataacaaacacctctcccttctcgtattttttgccgtaggtaagacagttcccgggcctgatcctgaatcagggaatcatatttcctaatgcaggacagaagaggaaagggtggatgataagttatgggggcttctgtagagatttctatgagaacatctctaaggaactcccccaaactgaattctggcacgtaagccataggaggtatttaagagtaaattctaccctgataaagtattgcactgaaaaatttagtatgggccgagcatggtgactcacgcctgtaatcccagcactttgggaggctgaggcaggcagatcacaaggtcaggagtttgagaccagcctggccaatatggtgaaacccctcctctactaaaaacacacaaaaaaactagctgggcatggtggcacatgcctgtaatcccagctacttgggaggctgaggcaggagaattgcttgaacctgggagggagaggttgcagtgagccgagatggcaccactgcactccagcctgggtgacagagtgagactctgtatcaaaacaaaacaaaacaaaaaatttaccatgccactgttcttcaactgttctatatatgttaattatatgtccctagataaatcgtaaggtctgtgagaatgaagatagttctgcgtttcacatcccttacagcaccagcatcacagagattcacagcagatactcaatgaataattagactcatctcatcctaagtctagataggacctttcatgtcttctgttttaaccaccacctgatgtctgaatttcttctgtgttgtgatactgtggctgactgtattttgcaatcatggccatcacataaactctcatgccatcaactgatgagacccaaaacaagagaccctaagtgagagccacccagctgagcccagtcaaaccacagaaccgtgaagcataataaagtactgtttgaagtcactaagttttagagtggttcttacttagcagtagataaccaggacacataccaagatgaatgtctgtgttttcaacacaaagtgtcaataacactgataactatggcaaatagcattgagagcttaatgtatgctgggcaccattctaagcacttgtactaattttttttttttttttttttgagacagagtcttgctctgtcacccaggctggggtgcagtggtaccatctcggctcactgcatcctccacttcccaggttcaagcgattctcctgcctcagcctcctgagtagctgggattacaggggtgcaccaccatgcccacctaatttttatatttttagtagagacagggtttcaccatgttgggtagcctggtcttgaactcctgacctcaggtgttctgcccacctcagcctcccaaagtgttgggattacaggcatgagccaccacacctggccagcacttgtattaattcatgtaaacctaatatccaccctttgagatgggttctgttatcatcctcacttaataggtaatgacaaaggctcagaaaggttaagaaggttgcatgggtagtaagcatcagagctaggcagtctgattccagtattaccactatactatactatactatactatactatactatactatactatactataccataccatatgtactattactttactgatatatccctaagaggaaatccctgagatctggtatctcccagatactgggacatcatcctatgccctcctgcttgcctacctgtcttttccacagacctatatctaccatttaaatcagtgtccttgtgaatacccagacatgttgtttcttccaactgcctgagctaccctacaccaagcacaaacttacacattttcaatccagaaagtgcccagacagtgccatccttacccaggccacgaggctgatctcagctcctcagccagcttcccttctagtcaattttttgggagctgggcctccagctgggatactctctggatgagactcttcaggtcctttttggcctgaagtcctggagagtagaaagccccagtgccatcagacagccacacctcatcctcatcagtgacactatgaggtgaagacccctccagggtgtcaagagctctcagcttccagggtctttccagactagatgaataatcacttgtaactgagagggactggacccggctcttgaagttttgaatgaccttgttggcattctgcagctgggccttcagatctttgatgtcctttcataggacccagatgttttctgactttccatatacccagaactcttcctgcctccctagttcattctccaagggcttcctctcagaggaactagccagcgttcagccccggcgcccctgctcagagcacagcccctccaccaggaccatttccttgcggctgctgtgctcctcatgctctgaaaaaagacaaagatgtcttcctaaataaaagttggatgtgctgttgtggccactgcctttgagaggaggcaggtttggtcatgaggacaataattactagggaataaggtgaagtcgtactttattcaaccctgacactgtactaggcattcaaatacagtatttcttatcctccttatacccacaagttaggtttcaccactttctattttactgactggggaaaccaaaacttaaagagaggtggtaaaccagcttgttctagatcactcaaactagcacatggcagagcctgaattcaaatcctccaacgtcctgtgttcattccacacacactgatgtttctcaagccattaacatggccttatctagttaggatagccacaagaacgcaggacaagctatttctgcatgctgcaagtttaatgctctctaaagtttactataatttaaaagtttattgggttacaactgtgtgaaaaataggcaaaggaaaataagactttgaataaatatatcagcatgttaacatcagtgtattggggcagtggtagtcagaatgagaactaatccacagcattttacccgatgccagacactgttctaaagcattttataagaatttactcatttaattgacattagtacctgatggggtaggtagttcctttattactattttaacatttgaagaaactgaggcataggaaagtttacaaattgggatttgaagcaacaagtctggccccaggatcttttctcttaactgccacactacacttcctcaagaatgagagagactgtgtttttcttctcttctcgttttgaatgtggtgggtggccctatagttgtagtccttttataatgcaaaccaaaattatttttaacttatggtttgcatgtttccaaaacctcatgtggtctctaagtaggccttagtatttctataataatcagttggatagaacttcatatgattattattattattagcagtatgccacaaactcattgtagaaattcaaacttatactcagcctcattttgggtaagagttctcctattaacctcctgtcctcctcttccccactacttgtcaggtgtggaattggccaacagcacccaaatgtgacagctgactccagggagggaaggtgagccccacaccctgtgctcttaccgggactggtggattcctcctgttcagcctcattcttgctttgaccacaagtctcatagcccaggtcctggaggtccacctggacctgcttgctgtcctgcttcagcaagggttcacctgcgtgggaagagacagcaggtgttacagaatgtctgaatttcccacatatgccctgagcctcaatggcacataccctaaccttgtggggcagggagggcagatccacagtgcaagagaagcttctttgaactggtgggagaagagaccaccagctccaggaagcagaatttctttccacaggaggagcctgcatttgccattgataatctccccttcagataacctaggccttagttgggacaaggtatctgtaagtcagggattgtgtactctcatctctagcagccccactgaagctggcaagtgctttatcagcaggggttcaataaatgttgaatgtaaaacatggctgattactttttattttcaatccaacaaatctccatttctggtgagaaaatcttgccaaaaccaaccaagcaaatgcataaaagtatatcaaaaagaaaatgaaagcttccctgcctcccaatcccacttgcttggtttcagctattatttattacatggaggaagggggctaggcacccaggaagtcccaagtcctgttctgacaatcatctggcctccctgggcaaagggaaaagagggaaggcaaaaagaatataacattactgtttgcagaaatttccccttggtacaggaaactctggtaaactgagagagtatgttttccatgagggaggcctcaagggctcttctctggccctaagcccaaactggattttgcctcattttctaagatgcaaaggaaatggtaaaagttgatcaaaggagagggcagagaaagaaagaggacgactcctccatctcaggtccaccttcctcggtgttgcttgagggatcagaggaaatgcatgaacagaggtgcgtgggaactacggctgctctgtgaactcagtgccctccagttacgagctattgtgaggttccatgatgtaatggcgagcgctttggactctgagtacggtgatcagcgttcaagtctcagtgggacctttctgtataatgccaatgatattcctattgctccctaagcggaatgggggaaattgccccagtcatggtcacccaccgtccaggccactggctgtgtgcaattggagtcctagacccagcgacccagcaagacccctcccctctcagggtgaccctgggcctccaggtgacaggtctcctccactgaaaaggctgcgtcccctcaatcctagaccctgagttttcttttatacatgtcattgggccattgccctgtgtctctttggaagaaatgacctatatgaaaaactttacttccgggattccctaattccttcatcccttaggacggcgcagtttttcagctcctggtcttggctccagttctaatgcacacgtttcattttattgtcatgggatcccctccaacaggctaccactggattcctgtccttggggtctctgtggatggcaaccagatgctgctcttgtcccagatcctgacacctctctccagggaattgcctcccttagcctcctaaatcagccaatatttagatttgggcctgggatcgcagcaactgtggagaacagaggttcccgatccctggccagcctcccgcagtgaaggggagaggagcacagcagctgggaggggcaagtctggggccctgggcaacccccttcttcctgcccagactctgctccaaggagcagttgccttaggaccagatcagatggaaactcttttgttctcttctcatcagcagaaaaatttaggcaagagctctggaggacgttcctagctcctaaaaatggtgtggccaaatctctccagttttggaaatgcccaaggttaccaagtattttgagggctcactttggagcctctgaaaaggaggggtgagggcccatggaaggtacctgagggatgcaggggagagaggggaaagagcagacaggagggaggagagaaggaaggaaggggagaaagggcgtgtgagggccaggagccaggattcaccctgacagttcagtgactgctcccttccaacaagcttcccactgtggcaccttctagcaggtggtttccatctcttattgatgtcctaagaccttggctctatggaacggttctgttctatttgtctggcatgagtcctggcaaagtttctttttcaccatttgggggatgagatgggggtatataggtttgcaagtgactaggagctaagtcaggaacttgtggagccactcagagtcaactgtcaagtagcctccttctcccattcccctgcaggacgattgcctgcaagacagggcctggagaaggccagggcacccaaggccacagaaatgcccagggatgagtcccggctggagatgccttggctgaactcactgtgtacttccagggtgcacagggcaggtactctgggggtctggccgggagactgagcaaggggaccagggaggttatgcagaagacttctgcacagcaaggcagacattcttcttggagcccccaacccaaatcaggtcttccacctcctcttcctaaagaccctttactgcagtcattcttttactagaactgcaagtttatagaacatagatttcagtgtgctcatctggccaaccatcttcagtggccaatgcccaaggtaacctccctccctaccaagacctgaactcagagccttacctaaggagaagatgtcctgttctttctttcccaccagaactgccctggcccagaccccatttctgtctggtgaccaggacagtcccctcaccagtctcccaggttggggagggcagattctcctcagctccctgcccctgagagaccccaacagccttgcgtggctccagcccacagagggctatccatggcccatatctctcaaaactctcccctcccactctgaatccaccctctactgcatgctcccctcacagaacagacatgggtttttttttgtgtcctcgttttgcctacccataccccagattgacttttctgtctcagaactacctgtccctctttggacagtgtcttcttggtactacacatgaagatgtcctgctctcccctgctcaaggagagagtgcctgacctgagctgggcccatcagatccagtacttacccggaataggaaaaagatggagagggtgaccaaagattacaaaaatctctgaagcttatccacttgagagagagtccctgaagatactggcctttcatttcctgctatgtatatccagtgtgactgaactctgaataacatatacaagttataataatgtagtagttggccctcaaactaggacacaaacatgttagagggtaaggtagtgagaggcatgtttgggggtggtggtgatgagcaagtatgtgaaggagagatagtgcctacgcttgaaaatcaaaaaggaataatatctatttagacataaggagataaataactaaatacttgcttctatgtgatgaaactctgggagtacacaaggggactgctgttttactaaacaaattttccagtctatataactttgataaggtatccaaataaaaaaattcctttcccatatatgtatgtgtatatatatgtatttgtatacacatatatgtttgcatttttgtattttgaatataaatttttatagagtcctgtgaacccctcttttcaattaggatttgagtttgatgtcatgcatgcaatgtgatcccactgtgtgactacagaaatgttggcaaaagtaagttcagaggaaatggtaggcaagtacttcccagttttggccagaagatggagaaaaaaagaattctcataaaatattaaaagtatgacttgttacagcttcttttcatagtaatttggatagaaattagcaaaatcagaaatgtataaatactttggtctgacaattccatctccaggtatctacggagaaatagacaagtgatgcacgacagatacatgtgtcagtctggtctctgcagttgtatttgtaataatacacattggaacaatgtcatggccatcggttagagaatgtttgaagaatgacccattcatatcaggaaggacgtttcaaagatcaaagcctgatggaaatgctggaggccgtgacgctgataggagctcatgcgtgttgaccaattgctacgtgacaggcattggctccacgcttttcctgcactgctcgtttaaacattggacaaattaagtgttctgatttagcccattagacagatagaaatggaagcacagaaaattaatgggtttatctttaaacgcgagcagattaggtttttcacccagggcctgtggcttcaccataggtgtgattcaggttctgttgttctccactttaggaattcccagtattccaaatatgagaagctgagaaaacaaacaaactcaaaactctaaaaaccgggataagtaagggtagatgtttgctgggtgtggattaataatgaactttttttgcctcaagcaacaaagaggcaccttggaaaatagacaagagacaagaagaggagaagcttgaagatatatttggtccaaggaagagactcttcagagggaagatcacatcagctagaaacattaatgcgactggatgggctcaaaccaccgacttttcagtcaacttccgacagcactaacctagtgttccagagaccctgcttgttaaacagtgaaagctgttgctcaattgtgtcatccataattgtcaaatattgtcatttagtagcacaaggaagtattctctgttgccaagctagagtacccataactcttctgttttgttgaacattcttccccaccacaaaccctctttagaagactggtggctcctaaaacattgaggccaacagacctgtccttgtgcatgtttgggcattgatccagggccaaatcagtgggagactcctccacgcacatgccaggtccccaggtgacaactgcagtctctggatctgaggtcatccactttcccattcctagctcacctcacccatcatgaagcctggttagtattgccagagacccgagtgggcaggtgcccgcactaaagacagaacctgctgtgtgcccactttgctgatccctccatctttctagacaaggctttgtgagccaaggactttgggtttgctcacaaggcagcccctcacctagtaggcattagttcattatgtatagtatacgtatatgtgtatgtatatgtatatgtatatgtatatgtatatgtatatgtatatgtgtatgtgtatgtgtatgtgtatgtgtatgtgtatgtgtatgtatgtgtatgtgtatgtgtatatgtatatgtatatgtagtcctcaggttgtattccttaaatatatataatatatgtaattccttaaatatataattttaatacaaaatttttaaaagattcctttcataaacatttacaataacaccaagaaatataaactacatagcaaagatgtgaaagccagccaggcgcagcttcaaatcctagcgcttaggaaggccgtggcaggagggtcgcttgagctcagaagcttgaaactagcttaggcaacatagtgagacctcatctctactgaaaatcagaaaaattatccggctgtggtggtgtgagcctgtagtcccaggtactcagtggatgaggccctaggatgtcatcggcctgagaattccatgctgcagtgagctgtgtgatcttgccactgtactccagcctgagtgaaagagtgagatcgtgtctagaaacaaaagaagaaaaaaaaaaaggtgtgaaagcctatatattgaagattaccatgtattactgagagcagttaaagacctttggaatagagaacgttccttcttgcatttcaagattgcttttgttttggggggacacttgctgttttttaggaacatgaagttcttctcaggcattcctgtaaaaaaagccactttttgataggattgtattgagtctgtggattgctttgagttgtatttttatcttaaccatgttacaacttccaacccatggacacaagatgtctttccattgatttaggtcttccttagtctcctcgagcaatgttctgtagttgtctgtgtacaagtactgcaccttcttgaacaaatttattcccaggcatattatccttacaggtgctattataaatgaaatcattgtgtcagtttacttctcagatagctcattgccatcacaatggattgtttgctgaaagtttgctgaattcacttattaactctgatagtgtgtgtgtgtgtgtgtgtgtgtgtgtgtgtgtgtctggtgtctgtgtgcatgtatgtgtgtttgcctttgtatgtattgtttgggattttctatgcataggatcacaccatctgcaaattgagatcattttgttttctgttcaaaaatattttttctcatgtttatttttgaaagataatttggccaggtgtagacttgtaggtgacagtttttctttttttaagtactttattgcaaacttcttgtttgtaaaatttcctatgagaaatcttatgccatccttatatttagtgctctgtatgtaacatgttcttttcccttttattacttttaggatttcctttttatcactggttttgatggatttgattaaggtgttccttggtgaagttttctgcatgtttcttgttcttgggataatcatatttctgtaatatttgaagtttatgatttctatggagcttctaaatctttcatccagtatgttttaaatatctttttctctcttctccactacctgcccttcagggattccatttagccctatactggggggtttaaagttttgatgctgatggtctttatatgttttcaagtcatttgttaatgtgtgtttcatttatgttagtttcaacttctattccttctagtttaataatcttctcttctgcaatatttaatccagtgccttcttccatttcacactgtaaatcatagtttttatctacagaatttgatatttaaaaaatcttcaacctctccatttaattaaaatacaattatactaattgcggtaacgtccttttcttctatttccaacgtgtgtgtcaatttcaaccagattattagattcttcagtatgtgtcatgttttcctgcttctttgactgcttgatattcttttatttttatttatttgtttttggggggatggagtttcactctcgttgcccagtctggagtgcaattgtgtgatctcagctcactgcaacctctgcctcccaggtactcaagcgattctcctgtctccgcctcccaagtagctcagattacaggcatgcaccatcatgcccagctaaactttttgtgtttagtagagacagggcttcaccatgctagtcaggctggtcgtgaactcctgacctcaggtgatccacccggctgcttgatattctaagatttgatgctggagctttggtgtcaatgctcaaaagtgcccaaagacaccactcaacctcagtgtctatgcacacccaagcttttgcaacaggagaggtagagacagcagagatgaatgtgctacaacatgctggtagaaggtaccccaattgtgcttggggcttcctatgcctcatagaataatgtgccttccttaatttttcccataagaaccaccctacttcatgccctgtctctctgtccaaacaccaggacagccctcagaccagtctcaaccacccaatggattgacaaaggtccaaatatgattcagtggagaaggcattctcttgtcaacaaattgtgtagaaacaactggacatgcatatccccaaaggaaaaagattcacctgaacctcaatactgactcaaaaactaactcaaaatggattatgcaactaaatataaactataaaagtagaaaaagtatagcaggaaatataagacaaaatcttcacgacgcagttaggcaaagtgttctttgttatcaagaaacacaaaccattaaagaaaacattgataaattcaactttataaaaagtaaaagtttttgctcaacacgagacagtattaagagaacaaatataagctgcagattgggagaaaaacaggggaaatgacaaatgtgacaaaggacaagtgtgatagttacttgcacgtgtcactgtgactgagcaccagggtgccgggacattcggccaaatgtgattctggttgtgttccagagagtgtttcacatatgattaacatcgggatgggcagactaagtgaagcagattgccccccttaacgggggtgggactcatgcaatcaatcaaaggtcaggagagaattaagaggcctaatgggaaacaaatgctttcctgggtatccagctttccttccatcttgggaatttcagcctccataatctcagaaacaaattcacatatgtatacacacacatatacatttcataggtatgtggctaagattgtatttttaaaagttcagccatgagatgattggtgaagccagccaatgaataagggtgtgttctattatatgactcagtcttcttttgtacacgattgaagttctgcatttgaagtaggaggacaggagagagcaagtccacctaggatgataacagctgaatttctcaacagacacttcaaagccctaggcgttaacttagagagtcaaaaatcccacccataaccctgcccctaaacgccagggctagggaacactgtggccctcaggtgattttgtttcacttggtctgggagccacacaagggcagagggagcaggaaacactaagcaaatcgaggccaggacagcagggagggcctgttcatgacagaacacaggtaaaactatcctcagaaagagcatgtggagaaacacagatcatgcctgagacctggtggattagagcactggctactggggaattgaaaggaaggggcttcaccatgcagaggaccagaggtgccagtcttggaaacgcagaattgctgggagatggggaggcatggacaaaggaagcatcctctggagactcatggtgaagagaacaaatgaagtaactggcagaaattataggtcctggtagaacaaaatagaatcccacaatgagaacatacagcatgtatgtcccgcaaggaagacaatagctcctaaaaatgcaagaaaaatcattttgggcaaacaccttatatccagtaatgcgatccatgtatcaagaccacgaggaagattattaaacatgctaaactcagcgagacctgattccctcatgaggactctgttaaggatgagtaccactcagcaagtgatgactgtgacattcacttttgaacagctcatgagcattaatatatttaattgtggatctaaaccaaaaaccaaggtgtgggcaagatgacaaccacagaatgtcactggcatatgtttaggttcaaataccattatgagaagtggcaggtaaaggaggtaggaaaaagaaaacacatcatgtaactgactgtcatatggaaatatttgacgttgaaagtcataatttaaaatgtataaaccaaatattagaagtgtgtctagttcaaaggggggaaaactatgaaacatttttaatcaatatcaaacatgagctacacaacccttcctaaatgccagaggcacacacagacacacacacacacactctcacaaagaatataaatatctagaaccaagaaatggagtaaatgcattctgctacatatggtaaacatagcctacaaggtggaagagattagaaaataaacagggaaatggaaatgtttttattaattcacatcagtacccaccaaaaccaatcagcataacaaaagattataacactgaatgtaaaaaacaatccaacagtccagagtgataggcaaaagcttttaattgtatagattaaaataactttggacaaaaattaaaactcaggcagagaatgttttttttttcaacaacacacactagcaaaaacaaaggcacagtaaacattgaggcagaaagtttccagcgtagagatatgaatataataatagacacaggcagggatgattaataaatgataaaatgtttacaggatgatcattggaatacaggacatttctaattttgaaaaccaccctcccaaatacttcattataagtaaggtgtctctaaaagggacagatctcctagacccctccttaaccaagtaaccagtcctgatatcatgataatgctgatggacaaactagaccttctctgcccgcagatgggctaaggttggaaactcacagcattgtctctgcagtgttcccggcaaaacgtttaggctgaatttaatcatgaagacattttcagacaacttcagaatgtagatcattgagccagagagctgacctgtcctctataaacaagtccatgtcaccaccatcaatgacaacaacaaaaagatgaggaaatatttggggttcaaaataactaaagaaatgcagctatattatctttttactttttttgaacccaaaatatctcttctcctttttgttgtgtgatttgtggtgatatggactatgtgaaggagacaggtcagttgtcctgctcagtgttctacattctgcagttgtctggtaattacctcctatgaaactcaggctaagcgttttctgcaagaacatggcgttgttcatattctgcaccggcagagtcctgggtgacatgctgtctcctgccagcggctcctgactcctgttctctacaggatggaatcgagaggagcagggctaaggcctcccaatgctgtttgtccatctagctgtggtcttcctaagtactgacaccaattggaggctgaaggactgtggcttctctaaccaaaggagcctagcgggttaacaattgtcaagagcagttggtggttctgaaatacaatcctcagccaaggatccctcctgtgttaaagatggatcagctaaaacaattcaacactgaagatacaaagaatgaggttaggttcattgaaaccagggtaacacctttggatgagctaaacacaaagatgacactgaccttgagcaggtatagaagctcagagacatgactgcaaaatgaaatccctgaggaactttgtagctacccagagataagtggttcaaattaaaatgtctgactgatcactcccggcatgtgctgcacagttatgtgaacgtgtcacacctaacttgggtccattgtcttcagactgagcacagggtgccactggcatggtctgagaataggaatagagccatgcccactgacccatcctatgtctgggcttccaaatggaactatagtttcattcaaatcttcacgtgcctataggtcctgcctgcaggaatgacatctctcggcttagtaagggctgcttactgtgggaatatgactcccatctggaagaccaggtggagacttgttcccatcaaagtaagaaacctattgtccacgtcaagggcgaagctgatgtgctgttcctcaaatgagtaaaacacacttctgtagtgctggaatgagtcaggtagttcaaagtacattgacggagtcgaataacatctatccagtgagtcctgcaagacttcaggctcttccacttccatcagcatgccgctgagcctggaaaagcagacaaaactaaagaagcagccagggaaaatcagacaccacagagccccactagatttcagaagtaacgtaaggaagtggtaagaaaagaaaaggatagatccattagatccattaatgaggtaaaaaaaaaaaattattgcctttatgttgggatagaaaagggccaggtagaaaacaatgaaagagaaagacagagagacagagacagagacagagacagagagaaagtgagctagtgaattggccaggtgacatactggtaagggagtaaaaggacactctgagttagtgccctcatgacacacagcacactgcgatcatgaaaagagtgagctcaatagttttccataaaatatgctcaaaattcgatgcagtggccatgagagtacagcttttgaagtatggtcatcctatggtacgttagtaaatgataaggggaggaagaaatggaaacctaaacatctactgcaatgaaaaccaacagcaatgacagtaggagtaattcagccttcgttgaaaacatgaaatcaaacacactctggtttccctcaatctgttgcctccaggtgttaacacagaattaagcatccacaattgctgaaagttacctggggcatggtgggttttgatcttcttccccttcttttcttccccttctccttcttttcttcgttgatcttcttccccttcttttcttccccttccccttcttttcaatttctgcaataaattcagacatggacagacacattaagctgattcccctacacacataacaatccactgtctaaccctcacacagggacctcaggctcctcagcataagaataggagactgtgagagatatatttcaggaggcctgaaggctggtcatgatagaaattcctcggtttttctcccagaaactgtgggtaaaatgtccctattctagtagatcgttatcccaatatcatttgtcccgagtttgtgcaaacagttatgccatatttttccaatcaatttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgagagtagaatcagagtgccacaggcatggcctgagactaggaagagagccatgctcactgacccatcccatgtctgggcttccagttagaactagagtttcattcaacctacatgtgcctataggtcctcactgcagcaatgacatctctcagctcagtaatggccacttggagcaggaatatgatctttatatggaagactcagtggatccttatcaccttcatagaaaggtactcacctcccacgtcaagagaaaagccaacatgtttttcctccaatgcataaaaggaacttccatagggcaggcaggagtcaggctgttcaagacaactggaaggagttgaataacatctatccagtgagtcctgcaagacttcaggctctactgcctccagcagctccctgctgagcctggaaaagtaggaaaaagtaaagaataagccagggggaatcagaaaccacacagccccagctacatttcatggctaacataaggaactgtttaaacagaaaaaggacagatccattaatgaggtaatgaattattgcctttatgttgggatagaccagggccaggtagaaaagaatgaaagagaaagacagggagagggagagggagagagagacagaggagaaagtgagctcagcgaattggccgggtgacacactgacgaaggggtcaaaggacactctgagttagtgccctcgggacacacagagaacagtgatcatgaaaagagtgggctcaataattttccataaacttgcttaagattccatgcagttgccatacagcctttgaggtatggtcaacctacagtaagttagtaaatgataaggggaggaagaaatggaaacctaaacatctactgcaaggaaaaccaacagcaatgtcagtaggagtaattcaaccttcgttgaaaacatgaaattgaacatactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacgcagggacttcaggctcctcagcatgagaataggacactgtgagagatcttcttcaggaggcctgaaggctgatcatgatagagattcctgggtttttgtcccagaaactgtgggtaaaattccctattctggtagatcgttatcccaagatcatttgtcccaagtttgtgcaaatggttatgccatatttttccaatcgatttaaagcaaatgcccccaaatggttgctgggagaaaaactgcaatattcagccctgtctcatcaaatactcagattcttcatggtagcgaggattttagatgctgaaattagagtgaaggatgaaatctacaagatctacaaaattgagacaaaatcagagttgtgtgaatttgtcacatctgcccagatccaacatcttgagagtgggattagggtgccacaggcatggcctgagactaggaagagagccctgctcactgacccatcccttgcctgggcttccaagtggaactagagtttcattcaacctacatgtgcctataggtcctccctgtggcaatgacatctctcagctcagtaagggccatttgcagtaggaatatgaccctaaccagaagactcagtggatccttatcaccttcatagaaaggtactcaccatccatgtcaagagcccagccaacacgctgttgctccaatatgtaaaaggcacttctgtagggctggcatgagtcagtcagttcaagataacctgaaggagttgaataacatctatccagtgagtcctgcaagacttcaggccctttctcatccagcagctccctgctgagcctggaacagtgggaaaaagtaaagaataagccagggggaatcagaaaccacacagccccagctagatttcatggctaacataaggaagagtttgaaaagaaaaaggacagatccattaatgaggtaacaaattattgcctttatattgggatagactagggccaggtagaaaaggatgaaagagaaagacacacacacacacacacacacacacacacacacacacacacacacagagtgagctcagtgaattggccaggtgacacactgatgagggagtcaacggtcattctctatttgtgctctcaggacacacagtgaacagtgatcatgaaaagcatggcctcaataattttgcataaaatgtgctcaagtttccctgcagccaccatgagaatacagcttttgaggtatggtcaaccttcactaggttagtaaatgataagggtaggaagaaatggaaacctaaacatttactctaatgagaaccaaaaagcaatgtagtaggcataatttagacttgtctgacaagacaaaatcattattttcagcatgtactgttttccctggacttggcatctccaggtgtcaacatcaaattaactgtccacaatttctcagactcacctgggacctgttgcctcttggtcctcctttttcacttgatcccaccgatgtcctgcaaataaattcagatggggcctcttacattaagcagttcttccttgcacacagaaacattcctctgtccaatcctaacacaggtacatcagtctggtcagtgtgagaacaggagactttgagagaaatattccagcaggcctgaggtcaagtcttgagaaaactggcttgggttctttcatgagccttgggcaaaattaccctgttttggaatgttatcttccctatgtgctctgtcctaggtttgtgtacacaaatgagcaactttttccccaataaattgtaggcaaatagttctaacacctcataggagagatacttcaatattaagctttctctcatcaaatacccagaatttgatagtttatgagattgtggacacagagatttgatgaaggggtgcaatgtaccagctcttgagtcaaaatgaaacttggttctacacagaagcatcagctattatggcttttgtgggtgaaaagtcagccatttatctagaaaacataccaggaacatgacggacagatgagctaaagcaagcgaacttagaagacacagaaaatgggaataaattcagtgaaacctgggccacatctttcactgagaggtagacaagggtgacacttgccttgggcaggtaaagaaccacacagacatgctttgggaacaaaactcataaggaattttgtagctggcaagagacatttaattcagatgagctgatctgacagacaactcctggtcatgtgctgcatagtttggtgtgagcttgccacacctgccttgagttcaatgtcgtgacagtcagtccaggttggcacgggcatggcctgagactaggaagagagcaaagctcactcacccaccccatgcctgtgcttcagactcgactccagagtgattgaaatctacattgatatataggttcagcccacagtgatggcaaatctcagcccaacaaggggcacaaggcccaaagattatggggtctacctgggccatgaactggagctttatcaccttcacaatggagtactcaccgcctatgtcaacagccatgcagacttgctgttcctctaatgagtgaaatgtgccgctgtaagacttgtacgaggccaacatttcaggaggaattgagagagtcgaataaccttcatcccaggactcctgggggacttcctcctcttcagactcctgcagattcctgatgagccaggcaggacagggatgatagaagatttaaccaacagacattagacaacaaaacctcccagatgatctgatgggagacagaatggagtggtcacagaaaccaaaggcatttttccttcaagagaaataaaactagccttctaaatacagggtggagggtgactgctctggggacagagcaaaaatgggcagcatgtgctcagtacatttgccacagatgagccaactcagggcacccagactctccctgtaaactaccatcatgacttgcagcacagagaactgacacagggcttcaactactttgcataaattgggttgaattttacatgcagcattcaagtgaagagagttcttgacacagtgcagacacagatcttgtgtattaagggccccattttcccaatattttgatataatatatttaccttttcaatttcttttcttgcaaaaatactagccaacatactaccaacagataggaagaaagcatatatacatctctccctggatttaaacacatgggagagaataggcaacaccaagaaatccctgtttgagggtctggagtggacttccagcaaactccaacagacctgaagctgagggacctgattgttagaaggaaaactaacacacagaaaggaatagcatcaacatcaacaaaaaagacatccatcccaaaaccccatctgtaggtcgccatcatcaaagaccaagggtagataaaaccacaaaggtggggagaaaccagagcacaaaagctgaaaattccaaaaacctgacatcccttctcctccaaaggatcacagctcctcgccagcaatggaacaaagcaggatggagaatgactttgatgagctgacagaagtaggcttcagaaagtcggtaataacaaacttctctgagctaaaggaggatgtgcgaactcatcgcaaggaagctaaaaaccttgaaaaaagattagacgaatggccaaccagaatgaacagtgtagagaagaccttaaatgacctgatggagctgaaaaccatggcacgagaactacgtgatgcatgcacaagcttcagtagtcaattcgatcaagtgcaagaaacggtatcagtgattcaagatcaaattagtgaaatgaagcgagaagagaagtttagagaaaaaagagtaaaaagaaatgaacaagcctccaataaatatgggactatgtggaaagaccaaatctacgtttgattggtgcactgaaagtgacggggagaatggaaccaagctgggaaacattcttcaggatattatccaggaggacttccccaacctagcaaggaaggccaacattcaaattcaggaaacacagagaacaccataaagatactcctcgagaagagcaaccccaaaacacataattgtcagattcaccaaggttgaaatgaaggaaaaaatgctaagtgcagccagagagaaaggtcggattacccacaaagggaagcccatcagactagcagcagatctcttggcacaaaccctacaagccagaagagagtgggagcaatattcaacattcttttttttttccatatgtatagttttcctttattattttttgtgtgtatgtatatatatgtatatatatttttcaatactttaagtcttagggtacatgtgcacaacgtgcaggttagttacatatgtatacatgtccacattggtgtgcttcacccattaactcatcatttaacattaggtatatctcctaatgctacccctcctccctccccccaccctacaacaggccccagtgtgtgatgttccccttcctgtgtccatgtgttctcattgttcaattcccacctgtgagtaagaacatgcggtatttcgttttttgtccttgcgatagtttgctgagaatgatggtttccagcttcatccatgcccctacaaaggacatgaactcatcattttttatagctgcatagtattccatgttgtatatgtgccacattttcttaatccagtctatcattgctggatatttggcttggttccaagtctttgctattgtgaatagtgccacaataaacatatgtgtgcatgtgtctttacaacagcatgatttataatcctttgggtatacacccagtaatgggatggctgggtcaaatggtatttctagttctagatccctgaggaattgccacactgtcttccacaatcgttgaactagtttacactcccaccaacagtgtaaaagtgttcctatttctccacatcctctccagcatcttcaacattcttaaagaaaagaattttcaacccagaatttcatatccagccaaacaaagcttcataagtgaaggagaaataaatcctttacagagaagcaaatgctgagagattttgtcaccaccaggcctgccttacaagagctcctaaaggaagcactaaacatggaaaggaacaaccggtaccagccactgcaaaaacatgccaaactgtaaagaccattgacgctaggaagaaactgcatcaactaacgggcgaaataaccagctaacatcataacgacaggctcaaattcacacataacaatattaaccttaaatgtaaatgggctaaatgccccagttaaaaaacacagaatggcaaattggacaaagagtcaagacccatcagtgtgctgtactcaggaaacccatctcacatgcagagacacacataggctcaaaataaagggatggaggaagatctaccaagcaaatggaaagcaaaaaaatgcaggggttgcaatcctagtctctgataaaacagactttaaaccaacaaagatcaaaagagacaaagaaggccactacataatggtaaagggatcaattcaacaagaagagttaactatcctaaatatatatgcaccctatacgggagcacccagattcataaagcaagtcctgagagacctacaaagagatttagactccacacaatcataatgggagactttaacaccccactgtcaatattagacagatcaatgagacagaagctttacaaggatatccaggacttgaactcagctctccaccaagcagacctaaaagacatctacagaactctccaccccaaatcaacagaatatacattcttctcagcaccacatcacacttattccaaaattgaccacatagttggaggtaaagcactcgtcagcaaatgtaaaagaatggaaaccacaacaaactgtcagaccacagtgcaatcaaattagaactcaggattaagaaactcactcaaaaccgcacaactacatggaaactgaacaacctgctcctgaatgactactgggaaaataacaaaatgaaggcagaaataaagatgttctttgaaaccaatgagaacaaagacacaacataccagaatctctgggacacatttaaagcaatgtgtagagggaaaattatagcactaaatgcccacaagagaaagcagaaaagatctaaaattgacaccctaacatcacaattaaaataactagagaagcaaagcaaacaaattcaaaagctagcagaagacaagaagtaactaagatcagagcagaactaaaggagatagacacacaaaaaacccttcaaaaaatcaatgaatccagggctggttttttgaaaagatcaacaagaaaaccctgtttggctagttcacctggctcatctgatggcaagttcctatcttgagaggactatgaaattaaaaccaatacaagtgccacaaataacatacaacattgtaaatcagcacaatttgtagctgggtgaatggaagaaatagttctattcatcacttcctcattttccctaaatctacaatctccagatgtcactactgaattaacagccaacaattccacaacattacctgggagacactggccctttttcttcctcttcctcatcatcactttcattttctgtaaataaattcagagaagcaggtcacattaagcaattcatacttcacatatgaccaaatcactgtccagtcatagcacaaggacataactattctcagtgcaagaataaggattctgacaggaatattctagggtgccctagattaactttggtgagaattagatgaccctgctttccagacccacaggccaaaatctccctctacgtgtagaccataatgccatattccctgcctgagtcaaagttaaacaaaattttttccccaaaaaaatctccaaaaattggtccattttctaagagtgttgctgcaatacggacttatatcaccagataacatggacattaaatgtttagaggcatctatacatgaaacacacatgatagataaatttgaacaactcttgctttaaaaagaatctgtgatttgggaggccaagacaggtgaatcatttgaggtcatgagttcaggactaccctggccaatatggggaaaccctgtctctactaaaaatacaaaaattagccagatgtgatgttgtgcacctgtggtcccagcaactcaggaggctgaggcaggagaatcacttgaatctgggaggcagaggttgcaccaagccaagatggtgcaactgcactctagcctgggtgacagagcaagactccatcgcaaaaaaaaaaaaaaaaaaaaaaaaaaaaaaaatccacgatgctacaaagaaacattggatcagccattgcattgacagggtggagaaccagggtccagccttgctttatggaaatatatcagcaaagtaaagaagaaaagtttccgtcctgatttcagggtgactgtgcagctaagcaagctgacttaaaggagatccggatgaaagctgagagcagtgaagcctggggaacaatatttccaaatacaaaggcaaggctgccagcttcctgaaacaggcatagaaactccatggacattgttcagggacagatgacttaatcacagatgacaagagatactgaatcgaagctaggaggcctgacagatactgcctgtgcacctcctgcactcaggtgactatgagattgtcacacttgcctggggtcgagtaacttgatactggggactggcagacaaaggcatgacattagctgagaaggacaaaaaaactccctgatatctgtttagaaacccatcatagttttttattcaaatgaatttgtgtttatagagcctgtcttcagagtttatcttcctcagcctagagagaggtatgagacacaaggaaaacagaggctacctgggataatgtgtacagcatcctcccattcaacatgagaggatgagccaatgagagttgagtcgactttgtcttcctcaaatgtgattttggttttcctatgtggctggttggagtcataagggccatggctatttgaacaagtgatggcacattcctccagtgagtcctcagggacttccttttcttcagccttcggcatctccctgatgagccaggtgggacagagatgacagaagattaaacacagagggattggaccccagggagtcctagctggttttgacaggcggcattaagagagtggtcccagaaagcaaaatggaggttccctttaagggggaacatgcaatcctgttctctctgcaacagagcatggctgccatgggaaccagagaggaagagagcagctggtgttcattgcagtggacagataggagctgaggaggatgaagactcagctatccctgtatggtgcagacatgacactcggcacacatagagaaacatgacagctgccgcaccctgtgtctaagctgggttatatttcacatactgtggccaagcaaatgcgggtttttggcccatcatagatgccagagagggtgtacctcctagatattcttcatatgttaccatccattacttgttcctgagtattcagtgttacctgggggcagacgatttctgcactttctcagccacctcaacttgaacatcttcatcgtcatcgttgtcattttctgtaaatacagaagtgttcgttcagatatttcccacttcacagtctgcaagcacagtcagcccaatgtgcaacagagacatgaacatctaggcatgggtcaccgttcaactgaaaactctcatgttttatctttaacagaatgccctggcatggtttcctgatccatcaggcaatgcatttctgatctggagggccaccatcaagatgtggccaaatattgaaaagaccttttgcttcccatatcactggaggcttgtgcagcctctctctggactttggcagctgtcgcccccatcctgccagatctgattcccaggcacaggcttggtgtcctgtcacagtttgcatttcaaacctaattctttctcttagaagcagacaaacttatcccacagtcctctatgcatcagaagatttcaagcctccaagtggcttctgctgtgttattcagggacattctatccatggggagtgctccagtctgaagcacttcctaccacgaaacgccaccacataaagtgccttctccaacatcacacggcgaggggcttcatctcattttggaaagcagttttaagtgttcccacatttgaatgcttcagacccttgcaagagacaatttgccatggagagagagaaactcaggaaagacaagtcattcagtcactgacagttactaagaacattgccgaaaagacaccctgggaaccttcattcttagtccagagctcttttcactctaacaagcctgctcctatcgcagcctccttcctgtcctttaaaactagatagatgctgcctcttactccaaagacaaccttccatcaagggaggagggacaattgcaatactgtgacctccaaccccatgggtttcccaactccgttcttacccaggaagtcctggtcatgtcatggccacataagcttagtggcaaaaaacaccattgatacaactgtcattgtgaaagtatggaggtctggagtctctcataagcctggggttttgggtcatcagggcctatggccaccttacctgggctgagcttttggacaaggtgctgtgccagtctacacccctcagccagctgttcttggaggtcctgcccctgggacttgtctggctcatccggagtgaggagggcctggagatgctgattcaatgagcaggaggcatctctcccttcccgtaacttctcccttaactgggtcagctctcgttcctgagagtgaaccaggactttatattgcctaaggtgagacggtagagaaaatttaagagtggaaagggttgagtgatccgctcaaatattgcaacagagatttctgagacaatgtcctcaaggagacctccaagcagaaggtcagcacatgttggaaggaatgtctgtggctaagagaaagaatagaaaatggtttacaggtttcctctgtatcagagagggctcctgcaagatcctcgatgatgttccattcatctttcccttctgtaaacaaaagtaggtgtcttcctaattccatttcaaaaagacatcctttcagtccctcactctggccatggacatttccatgtgaaaatacacatagtgcatcttgcggccactagatacaaagccatgtacagaaatgaggccaggtgcagatggggcgaattgaaaagatgaaagaagaaaagaatgacagggtcgagaaggcaacattgattgagtgaaagaatgagaagacgcagtcagtcagaaggtgattctcactaagggtaagtggggtggtgatggcacaccattttgagtatactgaatgctgctgtgtggttcacactcctttggttaattttgtgttatgtaaatttcacatcaacaattacttgtttgaaaaagagaaaacaaggctctgagaaacaactgcaacccataaatttttattatccttcttctctgcttgataaatacttgtgtgttgcgagcctgccatggcaattcctgcccttcccctggcccagcttagttcttaagtctccccactgagctgctgtacttcagagatttacacacctgcccccctgcctgcccccatggggtcccctcacctgagctcctcagcttgcttgagctgctctgcaagcttctcctccttgaactgtcgctcattcctcagcatagattttatgaggtctttgcactcttcattttctgagaaaagacagacacgcctgcctcagtggaaggctggacatgctgctgtggtcattgcctacagggcaggagccaggtccatcccaaggacaaaactctccccagtaccagggtctagacagggatttccacatctttactcttcagtctcctgactttctggcatctgatcctccaaaatttagagatgaagagaacctcaatggcacatcaaggaagttgacaagatgattcaaccacaacgaagtggagtcagaattcacagcccctgaggtctgactctgaatgcagggccactttcccaagacttgcagcctctcctctaaaacactgcactggggcatgaagtagtgatttcttgtacagtcgggaaggcccctaggactatgggactgatggtttcccttttactgggaatttcaaggacaagtatgcaaaagattttaaaaatctttgatttttaaatcatatcttcagttatgattttaagaatcatatctgaagcataaagtgtgacacataacaccataaggccatgaaggaaatatgcccaaatgttaataaagtttgtgttaatttagaaacagcagaatgaagaactaatagatagtgtttactgtgtgctaataaatgttctaggagattgacaagaaatagctcatgtaattcactgcagcaatttacagaggtaggtattattgtagtaccctctgaacaggtgaggaaacagggacagaaaagacaagcaacttggatggagcccaggagacaggcccacggtctctgctctgtacactgcactgctatctccacacattctcgggtgcgatctttcttcctctttaggaacaagactctgtgccccaggaagcaggacttcactctcaccaagctacattctgcttcttattcttatttttatttatcattattagtattatttttttaacagtcttgccctgtcgcccaggctggagtgcaatggcaaaatcttggctcactgcaacctcagcctcctgggttcaaaggattctcctgcctcagcctcctgagcaggggtgattacagtcacctgccaccatgcccatctactttttgtatttttagtggagatggggtttctccatgtttcccaggctggtctcaaactcctgacctcgtgctctacccgcctcagcctcccaaagggctgggattacaggagtgagccaccatgcacagcccctactccctgctcttgatgctgtcacttatagatagcacaggttctattaggagcagactcctcttgaagcccctcagagcaggtactggctactatcaccaagtttccctcagagtcactagaacagagctttgcatattgggcctcaacagaaacttgaactgaataaaagttcactagtctcagacatttagaacaacagactagatgttatttgtctgcaggatcttacatggtacagagaggattcttgaaaacatgattgagcctcttggagaaaacaggtcattctgtgcctgtgtcagaaatcaataaatggcagtttaactctagtcccacccccacctgattgcaaacatggaaagttgctaaatattttgggacctctgtcttccaactttaacaaaatgttaaaatacccatttctgttttcctagaagtatggggaggatgacattattttagatggagagagcacttagtttctcagagagaagacaggacttcgttcatcactttcgtgatggtgagcctatagatcttactgtatttgttctgctggttggccaggaagcaggccagttgagttacaaaacatttctctttgaggtttctgaactgctgtttcttctctgccagctggggatgcaatttctcgttgatttctagaatgttcatctctgccttctcgctggacaaagggccggctgataccaccatgctgacgtttgtggcagaagaggtggggccagggactggggagaagaaaggcaaacacatgatgggttaaaaactggtgaaatcaaataggtttaatcacactgagggatgtcagcggcagccttgtctacttatttgaagatgatgtttccctggtttcactcttgtcatctccagtcttgatctcctttaagtcaacttatcttagctatgcagtcaccttgaaaccaggacataaacacttctacacttttcttgcttataagtttctataaagcaaggcttggccctgagatttttaccccatgagtggccaatgtttctgtgtagcacaaaaggtttcattttgcctttttaatttttttcttttttggttttttgttttttgtttgagacggagtctcactctgtcacgcaggctgcagtgcagaggcacaatctcagctcactgccacctctgcctcccgggttcaagcgattctcatccctcagcctgccaaacatctgggattacaagcgccaagtaacatgccagctaatttttgtatttttagtagagatggggtttcgccatcttggacaggctggtttcgaactcctgacctcaggtgttccgcccaccttggcctcccaaagtgctgggattaagatgtgagccagcacccccggtcagagacttttttttttttttttgagatggagtctcgctctgtctcccaggctggagtgcagtggcacaatctaggctcactgcaaactccggttcctgggttcatgccattctcctgccacagcctcccgagtagctgggactacaggtgcccaacaccgtgcccagctaattttttttttttgtatttttagtaacgacggggtttcaccgtgttagccaggatggtctcgatctcctgacctcgtgatccacccgccccagcctccgaaagttctgggattacatgtgtgagccaccgcgcccggccgagacttcttattaatagctaagacaagccaatgaaaaggagagagagtctagcctgagaggagtgaaccagggtgggaggatcgtctcagccgatcctcccacctaagtctcctgagcagttgggactagaggcacgcagcaccatgcctgcctaattttttgtattctttgtaaagatgggtttcaccatattgtccaggctggtcttcaactcctgaactcaagtcatcctcccacttgggccttccaaagtgctgtgattatatgtgtgagtcacagaacctagctccatcctagtttctgactaaaacaatatgtgcgtatacagcctgtcctcagaattgatcttccatagcctagacagaggtatgagacacaaggaaaatagaggctacctgggagaatgtttacagcatcctgacattcatcatgagaggattctctgtctacaaccagagctgagttgactttgtcttcctcaaaggtgatgttgatgttcttgtgaggctggttggagtcacaagggccgtggctatttgaacaagtgatggcacattcctccagtgagtcctcagggactttgctttcttcagccttctgcacctccctgatgagccaggtgggacagagatgacagaagattaaacacagagggattggaccccagggagtcctagctggttttgacaggcggcattaagacagtggtcccagaaagcaaaatggaggttccctttaagggggaacaggcaatcctcttctctctgcaacagagcatggctgccatgggagccagagaggaagagagcagctggtgttcagtgcactggacagataggagctgaggaggatgaagactcagctatccctgtatggtacagacatgacacttggcacacatagagaaacacgacagctgccacaccctgtgtctaagctgggttgaatttcacatactgtggccaagcgaatgcgggcttttggcccatcatagatgccagagagggtgtgcctcctagacattttcatatgttaccacccattacttgctcctgagtattcagtgttacctgggggcagatgattccagtactttctcagcctcctcaacttgaacatcttcatcctcatcttcgtcattttctgtaaatacaaaatgttcgttcagatatttcccacttcccattctccaagcacagtcagcccaatgtgcacagagacatgaacatctatgtgtggttcagcattgtactgaaaactgtcatgttttatctttcacaaaatgccctggcatggtttcctggtccatcgggcaatgcatttctgatctggagggccaccatcaagatgtggccaaatattgaaaagaccttttgcttcccatatcactggaggcttgtgcagcctctctctggactttggcagctgtctcccccatcctgccacagatctgattcccaggaacaggtttggtgtcctgtcacagttcgcatttcaaacctcattctttctcttaggagaggacaaacttgtcccacagtcctctatgtgtcatgagactgcacaggccctccatgtggcttctgctgtgttattcagggacattctatccatggggagtgctccagtctgaagcacttcctaccaccaaatgcccccacatcaagtgccttctccaacaccaaacggagaggggctgcatctcattttaaaaagcattcgtaagtgttcccatatttggatgcttcagacccttgcaagagacaatttgtttgcctttgcagatggagagagagaaactctggaaagataaatcactcactcaccgacagttactaagaacattgccaaaaagacagcctgggaaccttcattcttagcccagagctcttttcactccaacaagcgccctcccatcacagcctccttcctgtcctttaaaactagacagatgctgcctcttgctccaaagaccaccttccatcaaggaaggagggacacttgcaatactgtgacctccaaccccatgggtttcccatctctgttcttacccaggaagtcctggtcatgtcatggccacatatgtgtagcagaaaataaccccactgatacaactgtcattgtgaaagtatggaggtctggagcctctcataagcctggggttttgggtcatcagggcctatggccaccttacctgggctgagcttctggaaaagttgctgtgccagtctacacccctcagccagctgttcttggaggtcctgcccctgggacttgtctggcttatccggagtgaggagggcctggagatgctgattcaatgagcgggaggcatctctcccttcccgtaacttctcccttaactgggtcagctctcgttcctgagagtgaaccaggactttatattgcctaaggtgagacggtagagaaaatttaagagtggaaagggttgagtgatccgttcaaatattgcaacagagatttctgagacaatgtcctcaaggagacctccaagcagaaggtcagcacatgttgaaaggaatgactgtggccaagagaaataatagaaaatggtttacaggcttcctctgtatcagagagggctcctgcaagatcctcgatgatgttccattcatctttcccttctgtaaacaaaagtaggtgtcttcctaattccgtttcaaaaagacatcctttcagttcctcactctggccatggacatttccatgtgaaaatacacatagtgcaacttgcagccactagatacaaagccatgtacagaaatgaggccaggtgcagatggggcgaattgaaaagacgaaagaagaaaagaatgacagggtcaagaaggcaacattgattgagtgaaagaatgagaagacgcagtcagtcagaaggtggttctcactaagggtaagtggggtggtgatggcacaccattttgagtatactgagtgctgctgtgtggttcacactcctttggttaattttgtgttatgtaaatttcacatcaacaattacttgtttgaaaaagagaaaacaaggctctaagaaacaactgcaacccataaatttttattatccttcttctctgcttgataaatacttgtgtgttgcgagcctgccatggcaattcctgcccttcccctggcccagcttagctcttacgtctccccaccgagctgctgtacttcagagatttacacagctgctcccccacctgcccccatggggtcccctcacctgagctcctcagcttgcttgagctgctctgcaagcttctcctccttgaactgtcgctcattcctcagcatagattttatgaggtctttgcactcttcatattctgagaaaagacagacacgcctgcctcagtggaaggctggacatgctgctgtggtcattgcctacagggcaggagccaggtccatcccaaggacaaaactctccccagtaccagggtctagacagggatttccacatctttactcttcagtctcctgactttctggcatctgatcctccaaaatttagagatgaagaaagggaacctcaagggcacatcaaggaagttgacaagatgattcaaccacaacgaagtggagtcagaattcacagcccctgaggtctgactctgaatgcagggccactttcccaagacttgcagcctctcctctaaaacactgcactggggcatgaagtagtgatttcttgtacagtcgggaaggcccctaggactatgggactgacggtttcccttttactgggaatttcaaagacaagtatgcgaaagattttaaaaatctttgatttttaaatcatatcttcagttatgattttaagaatcatatctgaagcataaagtgtgacacataacaccataaggtcatgaaggaaatatgcccaaatgctaataaagtttgtgttaatttagaaacagcagaatgaagaactaatagatagtgtttactgtgtgccaataaatgttctaggagattgacaagaaatagctcatgtaattcactgcagcaatttacagaggtaggtattattgtagtaccctctgaacaggtgaggaaactgagggacagacaagacaagcaacttggatggagcccaggagacaggcccacggtctctgctctgtacactgcactgctacctccacacattctcaggtgcgatctttcttcctctttaggaacaagactctgtgccccaggaagcaggacttcactctcaccaagctacactctgcttcttattcttatttttatttatcattattattattattattattattattatttttaccagtcttgccctgtcacccagagtggagtgcaatggcaaaatcttggctcactgcaacctcagcctcctgggttcaaaggattctcctgcctcagcctcctgagcaggggtgattacagtcacctgccaccatgcccatctactttttgtatttttagtggagatggggtttctccatgttgcccaggctggtctcaaactcctgaccttgtgatctgcccgcctcagcctcccaaagggctgggattacaggagtgagccaccatgcacagcccctactccctgctcttgatgctgtcacttatagatagcacaggttctattaggagcagactcctcttgaagcccctcagagcgggtactggctactatcaccaagtttccctcagagtcactagaacagagctgtgcctgttgggcctcaacagaaacttgaactgaataaaagttcactagtctcagacatttagaacaacagactagatgttatttgtctgcaggatcttacatggtacagagaggattcttggaaacatgattgagcctcttggagaaaacaggtcattctgtgcctgtgtcagaaatcaataaatggcagtttaactctagtcccacccccacctgattgcaaacatggaaagttgctaaatactttggtacctctctcttccaactttaacaaaatgttaaaatacccatttctgttttcctagaagtatggggaggatgacattattttagatggagagagcacttagtttctcagagagaagacaggacttcgttcatcactttcgtgatggtgagcctatagatcttactgtatttgttctgctggttggccaggaagcaggccagttgagttacaaaacatttctctttgaggtttctgaactgctgtttcttctctgccagctggggatgcaatttctcgttgatttctagaatgttcatctctgccttctcgctggacaaagggccggctgataccaccatgctgacgtttgtggcagaagaggtggggccagggactggggagaagaaaggcaaacacatgatgggttaaaaactggtgaaatcaaataggtttaatcacactgagggatgtcagtggcagccttgtctacttatttgaaaatgttgtttccctggtttcactcttgtcatctccagtcttgatctcctttaagtcaacttgtcttagctatgcagtcaccttgaaaccaggacataaacacttctacacttttcttgcttataagtttctataaagcaaggctgggccctgagatttttaccccatgagtggccaatgtttctgtgtagcacaaaagattgcattttcctttttcgatatttttctcttttggttttttgttttttgtttgagacggagtctcactctgtcacgcaggctgcagtgcagtggcgcaatctcagctcactgccacctctgcctcccgggttcaagtgattctcatccctcagcctgccaaacatctgggattacaagcgccaagtaacatgccagctaatttttgcatttttagtagagattgggtttcgccatcttggacaggctggtttcgaactcctgacctcaggtgttccgcccaccttggcctcccaaagtgctgggattaagatgtgagccagcacccccggtcagagactttttttttttttttttttgagatggagtctcgctctgtctcccaggctggagtgcagtggcacaatctaggctcactgcaagctccggttcctgggttcatgccattctcctgccacagcctcccgagtagctgggactacaggcgcccaacaccgtgcccagctaattttttttttttgtatttttagtaacgacggggtttcaccgtgttagccaggatggtctcgatctcctgacctcgtgatccacccgccccggcctcccaaagtgctgggattacatgtgtgagccaccgcgcccggccgagacttcttattaatagctaagacaagccaatgaaaaggagagagagtctagcctgagaggagtgaaccagggtgggaggatcgtctcagccgatcctcccacctaagtctcctgagcagttgggactagaggcacgcagcaccatgcctgcctaattttttgtattctttgtaaagatgggtttcaccatattgtccaggctggtcttcaactcctgaactcaagtcatcctcccacttgggccttccaaagtgctgtgattatatgtgtgagtcacagaacctagctccatcctagtttctgactaaaagaataacaatatgtgtatatacagcctgtcctcagaattgatcttccatagcctagacagaggtatgagacacaaggaaaatagaggctacctgggagaatgtttacagcatcctgacattcatcatgagaggattctctgtctacaaccagagttgagttgactttgtcttcctcaaaggtgatgttgatgttcttgtgaggctggttggagtcacaagggctgtggctatttgaacaagtgatggcacattcctccagtgagtcctcagggactttgctttcttcagccttctgcacctccctgatgagccaggtgggacagagatgacagaagattaaacacagagggattggaccccagggagtcctagctggttttgacaggcggcattaagacagtggtcccagaaagcaaaatggaggttccctttaagggggaacaggcaatcctcttctctctgcaacagagcatggctgccatgggagccagagaggaagagagcagctggtgttcagtgcactggacagataggagctgaggaggatgaagactcagctatccctgtatggtacagacatgacacttggcacacatagagaaacacgacagctgccgcaccctgtgtctaagctgggttgaatttcacatactgtggccaagcgaatgcgggcttttggcccatcatagatgccagagagggtgtgcctcctacacattttcatatgttaccacccattacttgctcccgagtattcagtgttacctgggggcagatgattccagtactttctcagcctcctcaacttgaacatcttcatcctcatcttcgtcattttctgtaaatacaaaatgttcgttcagatatttcccacttcacattctgcaagcacagtcagcccaatgtgcacagagacatgaacatctatgtatggttcagcactgtactgaaaactgtcatattttatctttcacaaaatgccctggcatggtttcctggtccatcgggcaatgcatttctgatctggagggccaccatcaagatgtggtcaaatattgaaaagaccttttgcttcccatatcactggaggcttgtgcagcctctctctggactttggcagctgtcgcccccatcctgccacatatctgattcccaggaacaggcttggtgtcctgtcacagttcgcatttcaaacctcattctttctcttaggagaggacaaacttgtcccacagtcctctatgcatcatgagactgcacaggccctccatgtggcttctgctgtgttattcagggacattctatccacggggagtgctccagtctgaagcacttcctaccaccaaatgcccctacaccaagtgccttctccaacaccaaacggagaggggcttcatctcattttaaaaagcattcgtaagtgttcccatatttggatgcttcagacccttgcaagagacaatttgtttgcctttgcagatggagagagagaaactctggaaagataaatcactcactcaccgacagttactaagaacattgtcaaaaagacagcctgggaaccttcattcttagcccagagctcttttcactccaacaagcgccctcccatcacagcctccttcctgtcctttaaaactagacagatgctgcctcttgctccaaagaccaccttccatcaaggaaggagggacacttgcaatactgtgacctccaaccccatgggtttcccatctctgttcttacccaggaagtcctggtcatgtcatggccacatatgtatagcagaaaaaaaccccactgatacaactgtcattgtgaaagtatggaggtctggagcctctcataagcctggggttttgggtcatcagggcctatggccaccttacctgggctgagcttctggaaaagttgctgtgccagtctacacccctcagccagctgttcttggaggtcctgcccctgggacttgtctggcttatccggagtgaggagggcctggagatgctgattcaatgagcgggaggcatctctcccttcccgtaacttctcccttaactgggtcagctctcgttcctgagagtgaaccaggactttatattgcctaaggtgagacggtagagaaaatttaagagtggaaagggttgagtgatccgttcaaatattgcaacagagatttctgagacaatgtcctcaaggagacctccaagcagaaggtcagcacatgttgaaaggaatgactgtggccaagagaaagaatagaaaatggtttacaggcttcctctgtatcagagagggctcctgcaagatcctcgatgatgttccattcatctttcccttctgtaaacaaaagtaggtgtcttcctaattccgtttcaaaaagacatcctttcagttcctcactctggccatggacatttccatgtgaaaatacacatagtgcatcttgcggccactagatacaaagccatgtacagaaatgaggccaggtgcagatggggcgaattgaaaagacgaaagaagaaaagaatgacagggtcgagaaggcaacattgattgagtgaaagaatgagaagacgcagtcagtcagaaggtgattctcactaagggtaagtggggtggcgatggcacaccattttgagtatactgaatgctgctgtgtggttcacactcctttggttaattttgtgttatgtaaatttcacatcaacaattacttgtttgaaaaagagaaaacaaggctctaagaaacaactgcaacccataaatttttattatccttcttctctgcttgataaatacttgtgtgttgcgagcctgccatggcaattcctgcccttcccctggcccagcttagctcttacgtctccccaccgagctgctgtacttcagagatttacacagctgctcccctgcctgcccccatggggtcccctcacctgagctcctcagcttgcttgagctgctctgcaagcttctcctccttgaactgtcgctcattcctcagcataaattttatgaggtctttacactcttcatactctgagaaaagacagacacgcctgcctcagtggaaggctggacatgctgctgtggtcactgcctacagggcagaagccaggtccatcccaaggacaaaactgtcccccgtaccaggctctaggcagggatttccacatctttactcttcagtctcctgactttctggcatcttatcctccaaaatttaaagacgaagaaagagaaattcaaggcacatcaaggaagttgacaagatgattcaaccacaacgaagtggagtcagaactcacagcccctgaggtctgactctgaatgcggggccactttcccaagacttgcagcctctcctctgaaacactgcactggggcatgaagtagtgatttcttgtacagttgggaaggcccctaggactatgggactgacggtttcccttttactgggaatttcaaagacaagtatgcgaaagattttaaaaatctttgatttttaaatcatatcttcagttatgattttaagaatcatatctgaagcataaagtgtgacacataacaccataaggccatgaaggaaatatgcccaaatattttattagtatgacaggcagcatcaagatttagattagttgtgttaatttagaaacagcataagattagtttgtgttaatttagaaacatcagaatgaagaactaatagatagtgtttacactgtgccaattaatgttcaaggagattgacaggaaatacctcatgtaattcattgcagcaatttacagaggtaggtattattgtagtaccctctgaacagatgaggaaactgagggacagacaagacaagcaacttggatggagcccaggagacaggctgagggtccctgctttgcacactgcactgctgcttccacacattctcgggtgtgatctttcttcctctttaggaacaagagcctgtgcaccaggaagcaggacttcactctcaccaaggtactctctgctttttatttttatttttgttttatttatctttttgtttgtttgttttttgatgagtcttgccctgtcacccatgctggagtgcaatagtgcaatcttggctcactgcaacatctgcctgctgggttcaaaggattcttctgcctcagcctcccgattagtggtgattacagttgcccgccacgacgcccatctactttttgtatttttagtggagatggggtttctccatgttgcccaggctagtctcaaactcctcacctcgtgctctgcccgcctcagcctcccaaagtgctgagattacaggagtgagccacgttgcacggcccctactccctgctcttgatgctgtcacttatagatagcacaggttctattaggagcagactcctcttgaagcccctcagagcaggtactggctactatcaccaagtttccctcagagtcactagaacagagccttgcctgttgggcctcaacagaaacttgaactgaataaaagttcactagtctcagacatttagaacaacagactagatgttatttgtctgcaggatcttatatggtacagagaggattcttgaaaacatgattgagcctcttggagaaaacaggtcgttctgtgtctgtgttagaaatcaataactgtgagtttaactctagtcccacccccacctgattgcaaacatggaaagttgctaaatactttggtacctctgtcttccaactttaacaaaatgttaaaatacccatttctgttttcctagaagtacaggaaggatgaaattatttttgatggagagagcatttagtgtctcagagagaagacaggacatcattcatcactttcatgatggtgagcctatagatcttactgtatttcttctgtcggttggccaggaagccggccagttgagttacaaaacatttctctttgaggtttctgaactgctgtttgttctctgccagctgggggcgcaatttctcgttgatttctaaaatgttcgtctctgccttctcgctggaccaagggccagctgataccaccatgctgacgtttgtggcagaagaggtggagccagggactggggagaagaaacccaaacatatgatgggttaaaaactggtgaaatcaaataggtttaatcaggactgagggatgtcagtaactgaaattcttaacttactgttgtgaaaaatgtgatcactccccacagcactttaggatccttcaccacaaaaacaaggttcgaggtgcctgaactcagagctgaaagcactgccagtagctcagactctgataagagtgaggtagactgtggccagcgtgccaggtaaccgtctgcagttgcaataacagaattagaaggtgggggtgtcatggaatcttaggagccctgcattccaattgcccaggctttcctgaaacacaggcaccctagtctcacctgagggtcaccaccaatggggatcattccttcagcattcactctcagtattcgtgtacccttgtgatgatgccacagacccgtgtctttcccaatacatctaagcatattcctcactgtttatctcttgtctgtacaacatcatcaaggcagaaacagtttcccaacaggttgtattttcttaatggtagtcatgaagtcaccccacctgctctcagttaaaacagagcttaaggcctttccacaggtgtaagatatcaaacttttagcctgccctgatttcctctgggtcttctgcagttttgtctgtatccactagaaagtgaatgaataattcatttgtaaaaaatgttgtctttcctgtctcagtattcttcttgctgtttcccattgttatgttgatttcttttttctcactggggcaccatctttgcttttcattacactctagaccagtttgacatccctatgtccagagctcttcctctatgtgggttgatttggtttttgatgtcactgagcgctacattttatacttgtcacttatggatgtcattctagtgtcacaagagctcttttcaaggtatcaagtgatcaaaatcatttatatagagatctcctgaaaacatgtgtgaccatctatcttgggaagtttcataaacctgatgctattttgttgtttccattttgttttcccatatactgaaaagaacagggccatgagcggttcttatgcaatatggtttgatatatattttgttgagatgacctaacaccattgattttgggttgcattccactaacagaacatggcaagatcaaggttatggtcacggttggttggtgatcctcagtgttgcagtagaaggtgagtttgagatgagaggaatgagtaggaaagagtgatcccctgaaccacctcctcgctttctcagctttcaccccacctaggttttgtgagcctggaacttgggagactgttctgtagcccaggtctcctaagattggctgctggacttgcctgagttgagggtgcggtgggttgaccctgggctgcccagcattcatgtggtagtgaaggaaggaggactggatcaatcccatttcaaagcatgtctctctgcactccacactgtcctccaatgacactgtaaggaaaccgctttaagacgtatcaacggctttaagtaaatgtattttctggcatctgggagacctgacattctgtgtcataatgaaaatctgtcatgtttctttattttaaaaatgataaaactgcaggttcacagagttacatggcttacttgaggtcacacggggatgagttttcagcactgccaataaaagcaatcacatgaattattcagtaattattcataggatccatataattcagtaaatattcacataattatttactagttgttcattgaccaattcgtacaaggcattttgctcaaaactgtgtttatatttggacattgtatcttcatcataatcctgtggtaatgctgttatccgtaagtaacaggtaagaaacctgaagaggagggatagcaaatcatgtatttggacatatttcctttttttttttttggtttttgtgatgctggaagaatgaccagaatgagtcataggaagagtatacattcctgtagtattttccaggacagaggtgtgacctcctagagtactgggaccaaaattcccaagtgtctgcaaccttgctttaacagtatgggagatcacctctatcacctggaattcccctggaactctggaatatacaagagaagtatgagacttgggtcttcccttggctgtgtttaattcactcttctatggaataccaatgattctcactaagactggccttttcataagcacaatgtgcattttatggagaagattttacactttgctctatttagaaagaataaatatgagcagtggtttaggttttatgccctggacttaatatgtttctgattcctgttttgagattaaattctcatgtaaatagaaaaatacttattatttctcataaggccaagtttgttattagtttgagtttttgaagatgaagcacaaacttttgattttatctttgtctgtctctgtcagcgccactcgttgtctctcagtatgacctggacttgcccctgcacttacccttgtcctgctgaaccatctccatgcactgtccaattccatcagtgattcgggctccttccaaggctccctgaaaagggcacagagatcaggacattaggcacattccggacacaaaggcaacccatactgtagagtgggcagctgtgtttccacttccctaatattccagtgatgtcctcaaactgaaaggaacactttccctttttaggggtctgttcttcatgtctcagtgcctctgatctagtcaacacaactgtcctgaatgtgaaagaacttgctaaatttctagtttcttgttaggtggctaaaatagatttataagacttccttacttacccatgactgctgaagtttgaattcttagcagtacgattcgttttcttgtaaggtgagcagcttaggaaagattggccatcttcctgtgcaaaaagaggcaaacttaatttctactcaaagcatgcttgaatttggaatcagggcttccactcttccgaagttggagtgtcactgcgacaggcatgtgtcccgaagggctcgtgtctctgctatactcaaagtttaaatggagcccagcaagccagatgtcctttacttctaggttccctcaacagtttctcctccgctttagagaccgcattgaaaatattcttgttctgctgttgtgttttggctttggaatgatgtgatgcagctcaatgggtcccacccccaacttgatcaaagtaagaaacagctgggaaagtcagtgcaaatacaagttcattgtcctccttgcagggattctgattcagagggctcaggtggggcctggaatgtttgttaacatgactcagatgtgcagtcaatttggggactcactgacagcattgaccttacagtttatgggatgattctttctgtttggtgatgaagaaactgaggcacacagagtctgtaacttgcccaagttccccttgttgtaagtcctggagccagatctcaggtggaccagtgcttctctcccctatacctcatttctgagaaaaggaaatcttctgcaatttgacttctttcatctaacacatttcctcacaacatgcagccagcatcatattttggccacttactattaaagtgagatgcttttttttttttttttttgagacagggtcttattctgtcacccagggtggagtgcactggtgattatagatcacggcaatcttgaacttctgggctcaagcgatcctcctgcctcagctttccaagtagttggaactataggcacacatcaccatttctggctaattttatatttttcatagagacaaggtcttgctatgttgctcaggctggttttgaacttctggcctcaagcgatcctcccacctaggcctccaaaagtgctgggattacagaagttagccactgaacctggccctgaaatgcttttatttctttcttttttttaatgaaaatactggacatggagatgtggaaagacaccttgctttattacttttgttgttattattatttctacagtagaatttatacatcacaaaattcaccatttttaagcatacatttcagtgtcttttaccatattccaaaactttcgcaaccatcgccactacctaattccagaatattttcataatgccaaaaagcatgcctgtacctatgggcagacactctccaattccccccttcttgcgctctctgacaaccactaatctaccttctctatatattgatgtacttgttctgggcacttcctctatatggaataacaaagtgtggtattttctatctgcttcttagaatattgttctcaagtttcatcctttctagcctgcgtcagtacttcaactttttatggccagataatattccactatatggttataccacattttgtttattcatcaactcatggtggtttaagatgtttccactttttaactattaggaataatgctgctgtgaacagctttgtacaggtttttgagtgaacatctgtttttcattttcttggttataaacctaggagtgcaattgctgcatcatatgtcactttatgtttcactttttgaggaactcacacactgtttactaacttcagtagctatatcattttagattcccaatagtaatatatgagaattccatattctccatcacttttgaaacatgtgttgtctttatttttttcttaagtcatactgctgggtgtgaagtggtatctcattttggtttaaatttacattttcctaatgacgaaaaacattgaacatctttgcatgtgcttcttggccatttgtgtgtttcctttagagaaacctctactcacagctttttttccccattgttaaatgtggttgtcgtttattgctcagttatatgaattccttatacactctaggtactagacctgtgtcaaacatacaatttggaaatagttctcccattatgtggattatcttttcacttccttgacagtgtcctttgaagcatacaagttttttattttaatgaagtccatttatctatttttcggttgtttgtgcctacttaaaaaatgtctaatccaaaatcacaaagatttgtacctaggtttccttcaagacatcgtcttttgaatgagaactttcctgggttttagaggagggtggacattgtttattgatgcctcctgtccattaccgatgtttctcttgattgttattcatatgctcaccacccctccatggagcatccatggcctgtgacagagctctggggactgatatccttccactgactttggcgctggtgagagccctggtcatgtgattcagcttggccttaacccgacccagttgcacatattcctcaggccctttagagttgaagtcgagacctctctgagaacgcttgccagcccatgctcttctaaggctggagcaaacttcctccatctattccagacagaggggactgcaggggttggactcactcaagatatctctggtgttagaaagaagacctgtttcaggctttggggaagattgttcaatatgaactaggtcctctctaattatttttaccgtatgtgtgacttctttctagaaacaagggaagaatatttatgttagaacattttgtctattctttgtcaattgttgtttatctacaattttaacatggataaaggagagttcagtgtcaatatattcttaacaactaattacggctcatgtccaccgccatgcgatcatatttaaatctgtcaactatcctgttacttaggtattatcctgttcctgatgagaaaacaaactcagaaagattgcaaaatttccctaggtcacaaaactagtgaggagaggagtaagaattagatatccgttccttttggccttcaaagctaaccttgtaccattagatcaaactgatttacatacttttgctggaattagtctcagacttgtggttctcacttgattttcccaaggaaacagtgtgccactttaatatcatttcaaactttgaaatttaaaactctttttattatacttttttgtctttgttctattccgttgcttttggtttcttctcaacggatccctcttatttatatgctaaatatttgttacctattttctgtcaattttcacctttttgagtgtttgttatctgtctgttgtatgctaacagtttttcactgaggtaaaatttgcgtagagtatactgcaaaaaaacctaaaggcacagcttaataaattttaatataattataattgtaaagtaacacccagttaaagacagagaacattttcccccatgccacaaagttctgatgtggtccttgccagtcaatactcatcccccaaatgaagaatatattctgaatgttgtcactgccttagcccctttgtgttgctggaaaggaataccagaggctgggtaagttatcaagacaagaggtgccttttgctcatagttctgcaggctgtacaagaagcatggcccccgcatctgctcctaatgagggcctgaggctgcttccacttgcagcagaaggtgaaaaggaaccagggtgtgcagagatcatatggcgagagaggaagcaaaagagagcaaggaaaggtgagaggcactttttaataaccagctcctacaggaactaagagagtgagaattcactcactaccttctcccagggtggggattcatctattcatgagggatccactcccatgacccaaacacctcccatttacccccacctccaacactggggaccacatttgaacatgtgatttggaggggaccaatatttaaacttagcagccaccatagattcattttgcttgatcatgtgcttcataaaaatggaatcattttggctgggcctggtggctcatgcctgtaatcccaagactttgcaaggctgaggcgggcagatcacctgaggtcaggcgttcaagaccagcctggccaacatggtaaaaccctgcctctactgaaaatacaaaaaattagccaggcatggtggccggtgcctgtaatcccaggcaccagatatgtactggtatctcatatgtacaggacatgtactggtatctcattgttgtattgattgatgttcctgatggctaaactgtagagcatcttttcctatgctaattgaccattcatgtatcttcttttcttaagtacctattcaagtcttttgagaaattgtttcattgtgctgtttatcttattaaacttatatatatatacatacatatatatacaaatacactctaaaaaacccctttgttggaaataaatatatctcctatattgtggtttcttttaatgttctcttaatgttccctgtttggagataacgatagataatcttcaaaaaggtgaatatacacacccacacccacccacacacatacacacacacacacacacacacacacacacacacgtgagccaccggatccagcctgttgaatttatttctaagcacaacatgtatttagatgttacttgaaatgaaattgtatttttatttcattttccaaatgctcattgctaatacacagaaatacaaaagactacttctattgagcttatattctgcaacattaccaaactcactaattacttttggcagatttttatagatttctaggattattaacatacacagtcattatctgtgaataaagacagcttcaattctttcttttcaatcttttcaatacttttatttttcttactttattgcattgatttagatctctagtataatgctgaattgaaagaataacaacagatattctacttttttctctgatttaatagaaaagcattcaatcctatgccatttaatataatgttacctctgagtttttttcaaatctacccttaatagggttgaaagtgttgccttctcttcttatcatgctgagagttttctggggtttgtttttataaatcatgaaaaaagttttcaattgtgccaaatgcttttactgtgtatgacaaggtaatcatatggtttttctcttttgccctgataatacataacattacattttcttaaatataaaaaagatttcttgaatcaagctaggacagtttttttaattataaacttttaacaaatatattgaaatataacttacatgcaattgagatgcatgaaagtgtataatcattaaagtgtataattttaagagtttgagcacactatacacgagtcaaagagaaaggacagaaaatactaacgatggctcagcacatgtggtctatcttgctgaatgctctatgtgagtttgagaagagttatttgttagctgttcttagatgtattttgcttaaatatcgacctggctaacatgtgtcattgattgtgtgaattaattttgttctagtgggcagtaaaattactgtctgatcactttggacttatgtggactggttcatgttttattacaacggattcatggaaagcccacagcatttcccaagaccctctaatttggcaggactcaatcaccaatccacccctttgtgaatttgtcagggtttgcttttaggctttagcaggttggtctacaataggccttattgaaaagtgtgacacttattcctaaagcacatccattctagtgtctcagttggatacctgggtgctaatgaggtgtgcatgagttcttcccaccatggatggcagaaactccatcatacattccccaaccctcctccacctcaagtacctctggtccaaactcaatttcatagcagccacccctctgttaaatctgttagtcttttccttgtgcaggtagagtccactccttgataagtatgcacatggaaccccacatagactttgagagctgcacctttgatcagctgtctcctcactggtgccctgccctgcagattgcagttgcttcagccgtcttgaactctgatctctgccttctcagctcagtgagctgccctgccctgagtggactctagctcactatgcagctgctgagaaattctccccaaacaactaggaaatcatggggcttcccccttaagttttctcttggactgcctgttgtacactgctgaaaacaattttacgtttgtttatggaggcagggttagtctgatatgatttattctaacagacagaagcagaaatctgttatactcttttaattactgtgtctttataatattatggtagacagaatcctaagatgacccccagtgatctttgctcttatataatcacttcctcctgagtgtagacaaagctactgaggagatgtcactcctgtgattgtgttacaatttatggcaaaaacaagttaacagatgtaatcgagatcccaaatcggtccaatttaagatagacagattatctgatgagcttgacctagtgaacgtgagttccttggagggactgaggacttcctggagagatgtgaagtgcaggagggtttccatgcagggcgatcctcctctgctggctggaggaagcatgcagtgggaacatgggaggcctctaggagcagcgagaggcccctggctgacagccagcaagaaaacagagatctcagtcctacagtcacaaggaactgaactcagctgacaacctgaggaaacttgagaggaagttcttccccagaacctccagaaagaaacccagcctaatttcagcctgtgaggccctgagaagaagacccagagaatccaggcctgaacttctgatctgtggacactgcaagaaaataaatcattcttattttacgccgctaatgcttgcagtaatttagtatgcagcaatagaaaattaatacaaataaaatggagaaggctttggagtggggacaagaaggaaacggtgggagagggatgcctgtatgctgatatggttgatgcctgtatggttgaattgggtctaccgttcctcatctaattagctatggtctattaaggtgcatagctacacacaaatattggtactacgttcaattcagaggaataagatattgcattcttgacagtagacaagaacaccctgaatttggggtcactgtatcataagtcatgttatcaggtccctctaggaaggcttagaggaagatttccaggatacacttgtgacaacattgaaggcttcttttttccccaaagggacccgatctcccctcagtcgagaagctccaagtctctgaactggatgccaggttataaattccccctatactgactccatcaggcttctgtcctcagaactagagtttatcagtaaaagatagactcatgggagtctaggcatttattctcttattttatataaatcagttaatgtgcaggaacaaaacagactttgaagaaagacactcacagttgccacaggaaaacaccttcaacatcctcatgagtcatcatgggtgttctgttgggaggacttgataggaggctttcctcctcacgggctagtgcagatccaggggaaatgtcatcaagtcctccattcggagggtagcagctgaggctgctgattcgttaggcctcctgcagctggagatgcaagtagtgcattttcatggccaccgcagggccctcagtttagcattcttcagagccagcatccaacaagccacagaagctctgagtatttccctttcttcagtcacccacataaatggcttcagggccttctggggaaggcctgaaggaagatttacagcatacacttgtggcagcattgaaggcttcactcttcctcaagggatccaatctcccctcagtcaagaagctccaggtatctgaactggatgccaggtcataaattcccactatggtgactccatcaggtctctgtcctcagaactagagcttttctaagtgtaacgtaagttgatttcttagtagatgtcccatccattacattcccagacacctcacaatgattcgaatgattagtaaccaccacatatccctgcctctcagggaaatccctcccgccttgtctctagatggccaagtcccacggcctgtcctctactcttccagaaccctgttgttctcactgacagcagggagggcaaatccatgcagcagctcccgccatgacctccagcctgcagaggatgggcgccacaggacttttaaacgcatgccgctgttcccctcacctgtgcatttcttaacgccttggtgaggagaatgtctctggatcttccttgatgggagctaaaggaacaaaggtaaataatgctatgggacccactgagaactggggctgtggaagagtggccactgaagtaatagacagatgcagctattgccagatactcagtgccagagcagggagggacagggaagaaatacggacctcaccttcctctcacttccaggatccatcgggggccctccattgctaaacctaactagaagtgtgcacgcacgggagccagggatgcattctaggagggacgagccccgagtggcatgagacaggatggaaatgagtggacagtggatctgtgggaagaaggaggggatgttatgggaaaacaaaaggagaatactagctaagaacgctaggtgacattaatattccgaagtctgtgctcatattcagcaaagaaagttcagcataaagcactaaataaggagtcaagatattgtacttccaactgttgttccaacagctgtattatgaagggccactttatttcatgcctttctaatttgacctaaagtgccaggtggcactggggctggcacagccttgctcaattatgtgttgcagagtacacagagactgccaggctgagggaagatgcaagagaatagaagagatgctctcagggaacaagagaccacatggccccagagtcaggggcagcatcagccactgtcagctgctcattttcccagacagagcccacaagcctcagccatgctttgcttctgcaagacgcttcttcaccttttcaataaacctgcctgaatttaagctgacagggtttatttctccttcatcataaatgaaattcttcaccacaacaatctccaatgaattttgggcacagcaggcaggcccatttctgcttctgttccactatctctcctgtaggttgaaaaggaggaggtactgaattacctccaaatgttcctctggctctgatattctgttattctggttcctttttggctactttgtttttggtagcgtgtatcctaaggcgtccagttgaacaacttttgtctactgtgtccaggcattcctggtggtatttcagataagactctcttgggttgctgaactcacaaccactgaaccaattctatgaccatctgtttcatggccacatgtttgctcattttatatgtacataaagggaggggacagacagcaaacttgcgtgttacaaattgtatcatcttaaaaaggaaacaaggcaacactttgcaataaaaccttaagatgcatgaaatttgagcctaatgcaataaaggatgcccataaaattcttatctaaagaatgtttcgaaaattgttgtacaaggacatcatcatttaaagtgatatgaagaaaccttctcagctaagcatatgggctagattagagagaaaaataaaggacccatctctgccctggaaaaactgctggtagcatctttcaaaaagctctctgtgtttgagtacgcaccttgatccataggctcacatttgatcccaactggcagctgcttcttggcattaacattggattcccaactagtaaatcttaccaagatctgactttctgcagatataatattattttgtttgaccatccttatcttcaagggctaccaagaaggaaccaagaatttatttacctccccaagggaaaaggttttaccaatgagaccctttctcaccatgaccccaggaccccatatgccctgttcacttgagtgccctgtgtggcctgatagaagctcatgctggtcacaggattccttatatgactagcctccttcctgaatcccaatttcatggtggtggtcatgacaggtgtcctgtatcccatgctcatgtccctgaagtcaccagcctatctccagttagaaaaaattacatgtatatagagaggcctctttggaaggagcaaaagctttctcaccttcgtacactaatggttggaaggtacaacagcatatgcactttgggaaaaaatatctggcatattcttacagaaacaaacaactacctattctatgactcagtaattcctaagcatttatccaagagaaactaaaacctatgtccagaaaatgacttatacaagaatgttcatagcagttttattcataatacaaaaaactggaaacattcaagtatctgtcaatacaagaatggatcaataaactgtgatacactcattccatggaatggctaaaggaacaaactggtgacacacagaacaacatggatgaatctcaaaaacatttggagtgcgatagaagccatacccaaaaaagtgtgagaaaaaaagataaataataatggttccaagaaatgcacagcagacagcccagaggcaaagacccacaggacggcgggccggtcccaggctgtcgatcctaattaagaaacttctgctggattttgcccagctccatttccaaactattttgggtcagtgacttctttatcccttccatgttgcctcattttgaactagaatcactgtaagtgttattctatgtctgtcacatcattccacagtaggggcagataagctgtttagaatggctaaaattcaaaaaggtgaacacaccaaatgctgtcaaagatgaggagcaaccagaactttccatcgctagtggaaatcaaaagggtacagtcactttggaaaacttaagttcactcaaaatcctgcacagaagtacttacagcaattttattcatcatcgccaaaacttggaagtgcccaagatgtctttcaccaagcgaaagaataaacaaactgttgtagccatacaaggaaatctgattcactgattttaaaaaacaagttatcaagccatgaaaagacatgaaggaacttaaagtacataatgctagaaagaagccagtctggaaacccacatactgtaccactccaactctaggacattcttggaaagtcaaaaagatagaagtagtaaaatggtgagtggttgtcaggggtggaggagaggaggacgcgtgaaatggtgaagcacagggaattttcagcagtgaaactctttcgcatgatgctgtattggggatttaggacattatgtaattgccaaaacccataatctgtgaaactcaaagaatgacctctaatgtaaactatggactttagttgataatgacgtatcaacagtggttcatcaattgtaatgaatggaccacactaatacaacatactagtagggaaaattgtgtgctggaggacaggggagcctaggagaactctctgtattatccactcaagttttctgtaaacctagaactgttctaaaaaataatgtctattaactgtttttttaattaggatgcagcagccccatatcaaggttttggtggcatcctgtaattgtgtggttagtacttggcattgaagtgcaccaacctggagtcagagcagttggagatttcaaggcctgtgccatttacctctaaccctggggtgcccctggaatacagatagcagatcggttaaggagaagcagcctcagcaatctagacagtgcaggtttctggtgaggacaggtaaaaaccatctgggtgggcagaacttggtgaagaccagaaaccactgagactcagcagctgccgcagtggcacccacaaatcaaaggagggggctgggaagagctaagggctactggatgagctctctgcctgcaagacagaagcagatccagagattttggaaaataatgtaggtttcagtacagtgtgatctcttcaaaaaagtagagagaatgaaaaggaaagaaaaagagagagcatgagagagaaagaagaagaaaagaagaaaggaagaaaggaaagaagggagggaaggagggaaggaggaaggaagggagggatggagggcgggtgggaaggagggaaagaataaaaagagagagaaagagagttggagggaagtagggaaggaaggaaggaaggaaggaaatgaacaaatttacatgaagatgagaacagtggggaaacttacaccaccaatattttccattaacaggaacacgctaagtagttattagagaaagacacgctactgtaaaacaatatactgtttccatggggtacaacaaccccttcctcctcctctgaaacacattctatctctggctcactgttgccagagacactgagtcttgtctttggatacgttctggtgcccacaagaatgagatgagacagtggatcccagaacaccaggccacgaacttccctgttgctccttgtccactccagaagctacccagctgcagttggggacctcagcccctgggtctgatgtcatccatttgcctttctcaatggacttctctccttgcactggctcctactcccccaggacctgtgggtgaccacatgagaagaacacaaacaggccatgcccctttctttctccccctctcaatgcctgcagtagtgggttccatggggtagtgacctgagatttactcattgtggggcctctagcccagagcagggcctactacctcacagtcaccccatgaatgctcagtgaaagaagacgtccaccacaaggtcctggggaaccaagaattccactgtggcccataaattctaagtctacaggattctggaatgggagatgggaaaggccttcaaaagtggccacttttaacccattatactggcaactgagccatgtttccccatcctggacacatccagagggcactgcctaaaaccagacacatctccccacccaggacagtgtaggagccttagcctgggggatgcaggtggacagggagggggtgagccaccaaagctgaagagcagaaagcaggtgaaaggggacagcagggtggaaacagagagaaatgggggcagagaatggggggtgagaggggaagagtgaggagagggatgcagatctagctagtaaggaaaagtcctggagagaacactgtcctctcctgaagtaaaatcacttctacctgaccacggcactgcagctcatgggcagcacatgctgtggatatttgttcattcatttaacaaatatttatttaatatctgttgcatgccaagcaaggccctgcaatgtttagggaccttgacatcttcccttcacatctgagtcataatacaaagaggactctctgaccccactgagctggcaatgcctcgggatttttacctgttggatctggcagctcttgatgtcagcccacaccatgtgaggctgctcttggtgcacccaatggggaagtttctacatcagggcctcggagaatccactggaagccctggacagtgggagtcagcggcatccccagtgtggaggccaagagcacacagtgcttaagctccaggcaccctcaggaggacggcaagggacaattggctggtgagagcccgggtcaccgggaaccttcgcctgggtctaaacaggatttgccttcagattgcctgtgagataaaagagagaaatcaaggttaacgttgagatttagggcttcggtaacttgaaggatggagctgccatttacggagactgggaagacccagggaagagcagattgaaaggtggtgggaactagaggtggttgggtttctgtcatatgtaatcaacagtcctgaccagcctgggcaacatagtaagaccccgtctgggaaaagaaaaaaggaaaaataagctgagcatggtggtgcacacttgtagtctcagctacttgggaggctgaggcaggaggattccttgagccttcagttagcggttagtgagctatgatggcaccactgtactccagcctggggggaaaaaaataaagagtcctgactaaatactagagtagccagggaagttttcacaaagtaagtaatatttgaggcagatcttagtgaacaagaattccattatttctgttagggaattaagagagtgtgggtgtcgttagttaatgcttattaaagtagctttggaatctcatctactggtctagctggtctatctgtacacgtatattgtatatgctgtctctctgagctttcgctaggttatgctacggtaacaaaagccccaaaatcttagcagctacacatacgaaggtttatttttcattgacatgtccttttatggcaggttgactgtgactctactctatacaagctactttatttgttagatggtgaaaactgtgatactcggaggttgttgaatatggtattagtatgttcattcattcattcatttaagaaatatttattcaatatctgtttcatgccaggcaaggtcaagtactgagaatacactggtgaatcaaagagacaaaatctctaattgccaggagcttatattgaaaatcagattaaacacatacaaaatcatcataataacaacaatgaatactatattcataaataatagctgtaagagattttagtacatcttttaaattagaaaaatataaaaattattaaaactaaaatggccaggtgtgatggctcatgcctgtgatcccaacactttgggatgccaaggtgggaggatcatttcagcccaggagtttgaaaccagtctgggcactacaggaaaaccctgtctacaaaaaggagaaaattagccgggcacagtggtgcatgcctgtagacccagctactaaggaggctgaggtgggaggagtgcttgagcctgagagatcaaggctgcagagagccatgatcataccactgcactccagcctgggcgacagagcgagacactgtctcaagaaaaaaaaaaaaattatttgatgtagtcctaaaactattatgtagaatactattgtttatatcacagcacgtgagccccttaaatggcttaacacttatttaggtatgatccataaagcttttctggtaattaagtatacttaagaacaattaagtataaaagagttactgccttgacaggaagattgtaaaaattttaaaaagacaaataaataaaagagtaaaaactgtagctctgtgaggctcaaataacatctaattcaagtcacaatgaacatctagcaatcattctgaacaccatataattcacttaatacgttttgcctgaacacccaacacatctgaattaccaacacccatatgtagccaagaaactggcaatcatttataaattatcacctatgactccatctgctctacgcacttattttttaaattttattcatttatttattatttttatttgttgtagagatgggatctcactatgttacccaagttggtccagaaacagaaacagacccacactaatttcataaatcagatgaccatacagtcattcgatttatgaaaaaaagtgccacatggtgcggaaggaaaaggatggtcttttcaataaatggtgctggatcaagcagacacatccatgtagtaaaaagtgaatcatagccaggtggggtggctcacacctgtaattccagcactctgggaggctgaagcgggcagattacttgagcccaggagttcgagaccaacctgggaaacatgttgaatccccatctctacaaaaaatatgaaaattagccaggcatggtggcacatgcctatagtcgcagctactcaggaggctgaggtgggaggatcacttgagccaggagatggaggttgagtgagctgagatcctgccaccacactctagcctgggcaataatagactgaggccctgtctgaaaaaaaaaaaaagcaaaaactaaaataaaatcgttataaggttaacacagaaaaatgtgttcatactcttaggttaggcattgatttcttaaacaggacacaaaaaacagtaaccataaaggaaaagattaataaagtataatttcattaaaatgaagaatctcaggctgggtgcagtggctcatgcctgtaatcccaaccctttgggaggccgaggcaggtgtatcacttgagcctaggaattccagaccagcctatgcaacgtggcaaaacccatctctactaaaaatacagaaaacagctgagtgtggtggtactcccctgtaggtcccagctacttgggggctgaggcagggggatcacctgagccttgtgaggtcaaggttgcagtgagctgtgattgtgccactgcactccagcctgggcgatggagtgagatcctgtctcaaaaagaaaaaaaaaaaaagagaatctcccttcatgaaaaaacaccataaaagagtgaaaacgcaagctacagattgaaaaaagggaaatgcaatacatataaatcctagaaaggaggcatatccagaataaagtattacaaatcaacaggaaaacaagcatatcaatgaaaactggataaaaagatttaacaggcacgtcacaaaagaggacatataaatggcaataaaagatactcaatctcaatgaaaccacactgatatattactgcacccctactagaatggcaaaataatttttaactgacaggtatcagcgaagatgtggggtaaccagcatatccctgctaaatggtacaactactttgggaaaatgttcaacaatatgtaatactaaagttttatcattcatatacctctaaaaccaacaatgccacccctacaaatataccccagactagtaatgttcaatttcttgatctgtggtggttcacttggtaaaaattcattacttttttttttttttttttgagacagggtctcactctgccatccaggtcggagtgcactgccatgatcacggctcactgcaatctcaacctcccgggctctggtgatcctcccaactcagcctaccgggtagctgggactacaggcacacgccaccacacacagctaacttctgtatttttagtagagaaagggttttgccacattgcccaggctggtctggaaatcctgggctcaagtgatctacccaccttggcgtcccaaagtgctgggattacaggtgtgatcactgcgcccgggccacctgcacatgtaaaattgtgaacttctgtatacttcagtaacttttccaagatttctttgacgcaaagttctcagaaatcttaaagctagcatttcagaatagaaaaagtagcttctggttcactagtgaaattttaccaatagaatttaaaaacaaaaagctactaacgcatatcagctcagaacactaccagcagatcttttctttaacttcctgaagcactgggattcattcttttggcaaagaaaggatgaacaacactgtaacccaaagaaaagataccactgccagaaaagacttcttttcgaaagcagctctaagcaaaagataggaggaaaacaaggaagccaggccaaacgtcttggttaactctccgctgaaaggacgccacatgagatgatctaagaagccagccagccagccagacgcagggaaatcacagcaactctttggagtgcaaacagcaaccccacaatccaatctacccgaaatcctgcggttcatttgaggcttgccccgctagtcaggaggtgattcagtgatggctacaaatgctgctcatgtgcatcctggagctggcacacctggcttgcccatcaccagcctggagacaccgccaggagcagaagcccggaggccagtaaagaccccaactttgcaagtcaggggcgcgagcgcgctcgcctctcaggtccgcagagggaacggatttctggcctggagggtggggtgcggggtcagtgtcctctacaggatataggaggacgtgcccccgaagctgctccgtccctccaccccctgggatgccacagaacacccgccagcgagtttcttccccagcgcccacgagagttgggctgcgggcggcagcggcaggcgaagaatccagcgcggggaactcaggccccggcggtgcacgaccccccacagcccccacccgcccccgcgctcgcgcaacaaaacttgccacggccgcgcctcgacccagctgtgcgcccgcgggtcccggattcaccgcccgcccagcctggcgcggcgccctcacctcagaaacgctgggtggacttcgcgtaacttcccattcacagggcagccggcagccgcgccgccgcgcctcggcccagctcctggcgccgcagatcgcccgtcccgcgttcccaaaagcaccgcgctcgctcagaagctcgggcagcctcgcgaccctcacctacgcctcccagtaccgccgctgtctcaaccgccacccagcccctcgcctgcgcctgcgcctgcagcccactggctcctcaggatcccgatgggcgtgtcaggataacccaaggcgcaggcgcggcggggccttaaagggacccggcggcctcttctgcacaacgggttcgagcaggttaggggccgcgcaggcggaggaaaggagtaacccaggggaaggaccgagtgcagcggggacggggaaatccctctctcccctccgcctgtctttcaaagcaccagccctcgaccctccaaatcgctggtttccccggccacttgaacagcccctgccaggttgaagaggcaggagacacaccccctctggggctggagcgaccccgcgcttaggactgcaggcctcgcgctgccgcaccgccccgaatctgacttccaggcacgggcacgcggtgcagtcgggcaggcttcagaagagcccccagctctcccagaggtggccttaggtcactctcaaaaagaataaccaatgtgtcaatggcacttgtagttattttctaatttaaatttattaacagattttgcagatgggcttccactgaaataagcctttgagaaaaagaaaaactttttttttcaacaggattagaataccaagaaataggaagtaaagccatgccgtccacccagctaaaaactttgaaaacttgatattttatctaaggcaaatgtttgcataactttaggtcatgccattatttaaagtcaatttcagttaacaatttcattgcaactgaatctatcttgtataagaaaactaagatacatccctgataatctacctctcccctcctatactccatccgtcagcaaatcctactggtttttaccttccaaattttccttgaatctgtcctcttctatctcctccgtcaccaccctagtctaggctgccttcacctggggagtgagggtcgagggactactgacctagtcttcttgtggtttacccatatcccctttatcgcctctctaatctcaacacaacaggcagagtggcttttccaaaatataatgtgaccgtgtcacttcccagcctaaagcacttaaacaccttcccattctcttagacaaaacctcctaactaaccaagccccgaatggccaggcgccttgcccacttcttcatctcttctcactactcagaccaattctgttctgctctctctgctccagccaaactggcctcttttattccctatttaccagcttcctggcctccacagagcttttgctcatgctttgctctgtgcctggaaagttcttctaacccctattcttctgagaacagctgtagtctccacctctgaaaagcaccttctgacctccctatggtggtcccttactcctatcacattgcatgaaactgtaatcgggtggttattttggtgaattttttactatcggctacgtaagcccagggtttggttttgtttgcttcatgatttgtatttccacatttgttaaatacatatttgttcataaatgagaatgatggatgctagaagttgaagtaaatttggcataaagtcagagaaagagaaaatgtcacaatctgacagttggagtcagaatgtagaaacttcagttatattaaaactgattttatatcgttttaggctgagttgtcttaggatgctttgggtaacctttaaaactgagttctcaaagagccttgtataaacacctgaattaataatgataagccatggggtggcccacataaaactaataacattggttgctttaagagaggaagactgagccaggcacagtggctcatacctgtaatccaagcactttgggaggccaaggcccgcagatcatttgagctcaggagtttgagactaacctgggcaacttggtgagaccctgtctctacataaaatacaagcaaaattagccaggcgtggtggcgggcacctgtactcccagctatttgggaggctgaggtgggaggattgcttgagctcaggaggttgaggctgcagtgagccatgatcatgccactgcattccagcctggatgacagagcaagatcttgtctcaaagagagagagagagagagagagaaatgaagactggtgactggtggctactggtgggaaggagatttttactaaatgcccaaaaggtttaaaattgtaacttttttatttcaaagtctgtgaagataaatgacacaaaagagcacataccttcccatttatttgaaattctagaaaggggaaaattaatctgtggtgaaaaaatcatagcagtggttccctctggcaggggattgactgggaagttacatgagagaaatttctgggtggtaaaaatggtctctgtcttgatagggatatgagttatataagtgtattcatttgtcaaaaaacatacagttaacatttcaatgaatgtaaattttaccttaaaaactatacgaataaatgcaaatttaaaatctgctagctaacacctagttgagtactcagtgtctatgggcattggccgaggctatacatacacgattttctttagtcctcataccgtcctcatggggtaggtattattatcataacccccttgcatatgaagaagccaaaatgcagtaaataccaaataacttgcctcgatttatacccctggaaaatgcgggaagagctttaaacaccatcagtcaaatgccagaagttgttaaacattagactctatagcacttctctgaaattatagtatttttggtatatgtatatatatatatatatatatcatctactagatcaagagcttcacaatgattgaaatcatagtttgtctttttgtttgaggtttatgtttttattttacttcattattttaaagactgagtctcggccgggcacggtggctcatgcctgtaatcccaacactttgggaggccaaggtgggtggatcacttgaggtcaggagttcgagaccagcctggccaacatggtgaaaccccatctctactaaaaatacaaaattagccaggtgtggtggcacgtgcctgtaatcccagttactcaggaggctaaggcaggagaatcgcttgaacctgggaggtggaggttgcagtgagccaaaattgtgccactgcactccagcctggccgacagagtgagactccatctcagagaaaaaaaaaaaaaagactgagtctcactatgctgcccaggctggacttggactccttcattcaagccatcctcctgcctaggcttcacctgggactacaggcccaatatttttgtcttaagtttctaagcagtcccaagactttgcacagtagctgttcaatgtattttgagtgaatgattaaaaacaagcttgatgtcgattttattggtacaatttatatttacatatgtaatatttatatgcttttatatatttatgtgtgcatgtatataattggtactaacttagcactgctgtgcctaagtgcctgagatgcatctcaaatgaataggcctgaggagagaagcttgtgtcattagctctgaccctgcagcactaatcctggtttacccctttctttcagtctccctgagcacaatttatttgctgaaaggccacatctcactatggagtgaggatcaagaagtaaaggtctgaaagagagaagctgcggggctggggagactgttggtcggagaggcgtcgggggcccaaggaaaagggaggattgtggggaggaatcggcgtagagatgagaggagcagcagagacagagtctcacgcagaggtgtgcccagacaccctgaaccaagttacttaacctcgtccaccaccgtggcacccgtggggtccgtgggcccgtcggtcttccaggagggattctgtgtccctgttattgtgtgtcaacatgtgttagcctgatatttatatttttaatgagagaaaacgaactctggaatttgcgaactgttttttcgttttgctttatacctcttggacactccttccgaaggattgggtctcaagggcagtggggtgtgactacggtagacagggctgattaattttcatccaaaactctttggcggattcccctgctctccgcttctccggtctaacagtagtttaaaatagaagatcagcaacatttggagagtttttttctttgcattttaatgataaacttgatttattccattccaaaagttttcttattctgaggttgtctttctatattttgagtataaaacaatggccatactatgttggaaccaccaaggttcttctcttcacttgttcatttgtaatgtctctttataatctgagaatttcctgagcaaactgggaactgttatacataattccttgtttttcaacattctttgtaaacaggaatcaggattggggatggggagggagggaggagtaggagtcctgatttgtggaacagaaaatcatggattacttatgtgatggagcaaagggtttaaaaactcttagcatccccagatttccccttttactgtttgctgaagaaaattctgtctttgactcccttccttaccctctccgggcctgtgagaagcttcctccctatccagtttatttcctcctctgctccccgacccaccccccacagccccctcctctttttcagtgaagccgctggaggaaagtcgggtttgggagaagacccacacaggcaaggacagcaggagaacactgacatagttacactcttgtcaccagcacttttattaagacgtgaaaagacaaagacaacagaggagagcagagaataatatctctgtttcagctattccaggatgttatgccaattatccagagtccttgatctgatgtagtaaagagctagggacattttccctgaaggctttgattgctggcaaaatctcattaaacgtgtatacattcataggttggccataggatggataaaagaagagcctctggcctacatctgccacgatacatgtgcaaaaatgctctctgcagcattatttttcattgtaaaatagcagaacaaatttattattcaataattataaaatggtcaaatgtatgtgactatatttggacaatgaaaaatgcagctgttaaaagcagacaatactgatgattcagatgatgttactgatgaaaataataacagatgacaattattgagcatttatggcattcttacaggcattaccttatttaaagttcagaactaccaaggaaaagagtaacttgtggcaggcgtgagaggttccgaggcacaaaaggaagataggcattcaaggaacaccaggatagaagacccagagtaggagaagagagaggaagaggagtccgccagatgggatgctggaaaccgcgggatagctcggtggagagagggcgctcctgctccgcaagcctccctacgacggcaggcctacccggtcctgctcctgccggctctgggcatctggtttctgccgctccatctccagggagatggtggccaggctgtgccgtgtacccatcaacttctctgacagcgccatcttctcagactccttcagagacaaggcctgggcagaggcaggggacaaagggcttgggggatgggctggtcctgggggcatgctcaggcttcttgctgcctaggaaatgtgcccactgggggcttagaggcctgagtgtgccactgcaggtggacccagggcagacatgcagccctggaaaagggcacaacggcagtcacaagaatcccggacgtggataccactcatagagctcactaacccgccacagcaccctgactgcagagtctttctttctacccatcttacagatgaggaaactgaggctcaaggaggtaaagtgactcgcccaggtacacagctggtgaggagaggagatgggcacagtctgccctgtctccgttacattataggaaagttagggatttgttatttggggggacacgtcagctgatgcctgtgggcatcgtggggactgctcagaaggcagccatgaggatccatgcccagcgtggggtgggacgaggcatgggagaatatggaacagctttcctggtgtcacgactgtcactgtcactcagtaagtgctcactgtgtgccaggcatggagcacagcaaagcctcacgaacccccttctaatcctcccctcctgcaggtaaggaaactgaggcccccaagagggcagtggcctgccccagggctcctagctgccaagtggcagagcagggcccggccccagaactggagcagctcagagagcagcagaggccacgccagggctcacgaacctgctgcttctcgctctcggccaggaggaggccctcgtcatgctcctgctgcagggcagcaatctcctcactcagctgttccttctcagccttccgccgggccagcagctcctcctgctcacgctgcagctgactctgcagctgggcccgctcggcctccagctcccgccatgctgcctcctagggggccaggactggacgcgtgtgacacaccaggaggggcccaggcagaccccccaaaacatcagggcagcaagagccatctggcccccataccctcagagatggagggtgaccaggtaaatacaagggactgataagggctatgacggggacacgccagggccgtgaaagtgccaaggagcagcagtgggctggcctgggggtccgaacatgatcccctgcggagagacaagtaactgtcagccaggtaaggagagaaaagaccaccccaggccaagagcacagcccctggaaaggactacaggatgcagggtgcagagggaaacagggcacggtgagtcacagggccagagccccaggcagtggctgggccaggacaggccgtgtgggccatggggattctaaggacagtgaggggagtgggagagaggactcgagccaaggtgacaaggagcaatctgatttttagcttaggggatgttccgacagctgtggaagagggattggggttgggatggaggagagttaggactggctgtgaggaatgaagggggtcaggggttgccagaggagctggagagaagaacacagatttggggacattaatgaggccaagccaggcaatgcaaagggcaagaagagcaagggggaggtcacagttcagatccctggggactggacaggcgggcaggcagagcccacaggcaaatagcagcccacccggggagcccgagggcaggtgcctgcctcagcagttgtccctagcaactctgtgagaagcagacagagctgccacttcttttttttttttttttttagacagagtctcgctctgtcacccaggctggagtgcagtggcgtgattttggctcactgcaacctctgcctcccaggttgaagcgattcttctgccttaccctcccaagtatctgggactacaggcgcgtgccaccatgcccagctaattttttgtgattttaggagagatagggtttcactgtgttagctaggatggtctcgatctcctgacctcgtgatccgcccacctcagcctcccaaagtgctgggattacaggcatgagtcagcacgcccggccaagccaccccttctttaagagcttcaccatagctcatgcctggaatcccagcactttcggaaagagctttaccgccccctgatggagaagcgtgataaccaccacccaaggccatggggactgcagggtgagtggcatgccctggagccatgtagtcatagcctgcacctctgtcagaggaagccctgtctaggatttggtggctgagggcccctgttctgagggccactctggagagcatgccagtgccagcaatcataactcatggagcatttgctaagtaccagtcactatgttaagccctctatgcagatggtctcagctcatcctcaataccttccactatcctatccctatttctacaggtggggaaatgaaggcacagacaccttgggtagcatcaccagtaagcgaccaagattagattcaaacccaggcaatataaccccagagtcagtgttctagtaacttccctggccccttgcctttctacatgctcaggtctgcgtggcccttcatatggaaacttcttagcaaatgaaagtgctttcctgctgtgcattaggtcaacatttcccaaatgtggttgtggaccctctgcatcaggattaccagggctggaccagatttgggacctgggtatctgaatgtctaataaggaccacaacctccccaccacccctccagtcctcccagctgtccccagggcctccacaacagagagggagtcccatttcacagatgtacagaccgaggcagagcaagaacgatgatgaaacactggctcagacttctgcccacccctccccagctgcctgaaccttttcacgctggagtcactgtaagtcctcctcctgggctgcccactgctcccgcagagaggcctgggcctcccgctcagcctgcaccagcttctgggccatcagctccttgtctagactggctttctcctgcgtagctattatttgctgccgcaggcccgccaactcccctgcacgagaggaatgggggaaagggcagggttgggttgaaatttttccttgggccagcagacttaggccagttgagccatatgggcaaaatcccagaggcagagggcctgcctggcatccagtttgggtcctcttgaagaagtggcttgtcctctctgggcctcagtttccctatctgctacatgggcccactggccctgacccctttcctgcctacctagaatggcattaaaggcataaaatgactgatgagaaggcctcccaaatgggacggatgtcaaacatataacaaccctaggccaggtgccatggctcactcctgtaatcccagcactttgggaagctggggcaggtggatcaccttaggtaaggagttcaagaccagcctggccaacacggtgaaaccctgtctctactaaaaatacaacaattagctgggcatggtggcggacgtatgtagtcctagctacttgggaggctgaggcaggagaatcgcttgaacccaagaggcagaagttgcagtgagctcagatcgcaccactgcactccaacctgggcgacaagagtgagactctgtctcaaaaaatcaaacaggctgggcgcggtggctcatgcctgtaatcccagcactttgggaggccgaagtgggcagatcacctgaggtcgagagttcgagaccagcttgaccaacatggtgaaaccccgtctctactaaaaatacaaaattagccaggcatggtggcgcgtgcctgtaatcccagctacttggaaggctgaggcaggagaatcgcttgaacctgggaggcggaggttgaggtgagccaaaatcgcgccattgcactccagcctgggcaacaagagtgaaactccatctcaaaacaaacaaacaaaaacaaacaaacaaacaaaaaccctattactgactcagcacttactatgcgtcaagcacccagctaagtattttagacataacctcattttgtcttcataacatgcctatgtagtttatcctcatccccgtttaacagatgatgaaatggaggatcagaggagatcagcagcaacttcccacagctgcacagctacacataaagcatctcctttaatgactgacatgaacatacctgtcaagcattaactatcagcattaatggaaacgactacagggaatggaaatggtatagccatcatctaaaaaccatctcccgggttggaaacccaccagcatttcccttcctggttctgtctggctcaggtgtacatggacaggaaaattaatttccatgacccaagtaggtgcttagttaatgttagatgagcagaaagaagccctgagttcagagattcgatggggaacggtgcagggaagtggggctcggattctggggccaagagagtcatctgaaaaccacagagaactcagactaacaggcctgatgaccgatgaacagcagttactgttgactcagccaggcaccgtgccacggccttacacgcttttcccatgtcatcctggcaacaggcttagaaggtgggcattgccacctccaatcatcagctgaggaatctgcagcccagagaggaaaggggcttgctcaagggaaggtgagatctaagtggtggcacaggactggaacccaggccagccagactcctactccagtgctcccaacttctgtgagactacagacattgggaggttgcagtctgggctggaacctggtgttccccccaagtccccagccactcgtaccagtcagggtctccttggccagcagcagggcctgcccctcggcttccagctgctcccggcgggcctcaagctgggccagctgccattgcacctcaaacaggctgccctccagggcttccttctccaagctgcagcacatacagtgcgtgaggccctgggactcagcctccctggccccaggaaactgtggatctcagggagtggccaggcatgggccaagtgccaatctacctgcctggccaggcccacactccctggggaagcctgagcccacagctaggacgagttggcaagccagactccttagtaactgcccctgggggcccgtgcctgggtgaggctgttcatggcgtggccccaggaggaccgcccagggcgggttgggcagagcccaaggccttactgcaggtgtgtggcctcctctgacacggtcctgccttcacgctccgcaggccgccagctgcacagccaggccagcgtgctccttggctagcgcctccttctcccgggccacttgccccagcgtctccacctgtcactgggcctcccaccgggcctgctccagctcctgctcccgcctgctcagctgccaggagagctggctcccacccagagactgagtagcactcccagcatcccccagcttgttcatcgtgcagtaccccaactctgggcctaacccagtcctggcagaaggcctgggttcgagcccagggtctgccctgatgtgctatatgtacttgggcaagtcatgaccttctctagatctgcaatgcacgtgtgtacaaaaaccagggcccggccggacacggtggctcacgcctataatcccagcactttggcaggtggatcacttgaggtcaagagttcaagaccagcctggccaacgtggtgaaaccctgtctctactaaaaatacaaaaattagccgggcatggtggtgcacgcctgtagtccctgctacttgggacgctgaggcaggcgaacagcttaaaccccggaggcagaggttgcagtgagcccagatcgtgccactgcactccagcctgggcaacagagcaagactgtcaaaaaaaaaaaaaaaaaaaaaaaaaaagaaaagaaaaatgagggtcctcactcagctttggaagtaacagaacccttgtattactctaagcagagaagctgaatatataaaccagacccaaatgcagctgctcagcaggcctcaaggtggagacttgcaccctgcttcctgcactccctaccccatcctctagaggcacctcccagaaacccaggccctccaggatggaccttgcatgaaggtccctggatccctgaaacattaaggtctcttcgagatgtgaagttcccaaaagtctaagattccaattctaaaaagtctccacctattattaatctgtatcattattattattattattgagacggagtcttgctctgttgcccaggctgcagtgcagtggcacgatcttggctcactgcaacctctgcctcctgggttcaagcgattctcctgcctcagcctcctgagtagctgggactacaggcgcgtgccaccacacccagctaattttttgtagagatagggtttcaccgtgttagccaggatggtcttgatctccggacctcaggtgatccacccgcctcggcttccccaactgctgggattataggcgtgagccactgcacccggctagccccatgttataaatggggcaactgaggtatgggaggttgggcagcttgtccaaggtccccagctaggagaagtgggactggatttaacccagaagcaggctccagtgcctgtgacttaacccaggactggatgcaggaggctgcgagcctggcctgccccacatgctctccagaccaccccacacacagtttggcctacctgtgctagctgctcctgcagccaactgagctcatggtgcagtgtggggagctgttgctccagcgcctcctgggcctgctccgccactcatagggagccctccaggccctgccgtgccacctcctgctccaaccacagctcctccagccactcctgctctgccggcgccactgtggcctcctgctccgcctgccgctgccggccctgcagcatggccttttcttcctccagctgtgggccggaaaggagtggggcctcatgagcagggcgtccctcccaggaccaggacgcctcctccacccacccaccagccacgatagcccaggggaggctcccagggaatgagggacagtgcccttgggtgtgtgggacactggggagggggagatgaggagggcccatggagcgtcggtgctttgactcctagagaggacagacagacagacggagatagacagagaaccagagacagaaagggaggcaggggccaagacaggtgcagggccgggcccagggtgcctcactgagtggggaggacgggtgggcaaggtaggtgggcccgcaggtgcacagtgtacctgggtgacaaggcagttcagatccaacttgtcctgagcaaggctctcgttgagggcgctcagcttggacagggagtcctgcagggaggcctcctctgccctcagcttggtcacggagagctcgagctccatgcggccagcctcaccctgcagggtcaggccccaagagatgaggaagggcagaaaggtcgggaggaggtgaggagagacaagaagagacccagagagatggaccctcggagacaggggaggggagacaaggaggggatacggcgtgagatggaaaaaaaaatcaccgcagaaagcctgctgcttatggagccatttaaaagccatgcaccgcaaagctgtgcaaaaatagctcaagctgcagggcagggccagagttcagaggatcccctgagtaaggtctagggatagcactgctcagagcccaggctgcagcggacagcgcaggcccccccgccaaggaccctctgcgctgtggccacaactctcagactccaggagctgaatctcaggatgaccctgagctataggcactgcccccaggagcatccagaacagcagggatacggccataaagagaggtcagtccacttatggctgggaccagaggtccagaggtctgtggcctgtgacaaagatcagcctgtatccagaaggaaggggtcagtctgtgaccaggctcagaggtctgcctgacactgggaccagtctgtgccagagtgacaaggcttggggctgggggtcagaggtaggtttgtggttgtgcagcagacagggacccaccttggtcagcgcctcggccacctcggtcttctcggcctgcagcatgtcccgttgcagcgtggcgcggctcagcgcctccctcacctccaccagctccttggccaggactgagcgcttcccttccagctgctctagttgtctatggctgtgggacaaagggtgggtgggtggcccatgtcactttcctgcccgaacctcctgtagccagcaagatgctgggccggggaccaggcctgaggcacgagtttggagagaaacagcctgagccacagggcaaccaagcccactaccgcttagctccatgaccctgggcctccgttttcacatctgcaaaatgaggtaacacttgcctcgtgacattgtttgtttttttgagacagagtcttgctctgtcgcccagtctggagtacagtggtgcgatcctggctgactgcaacctctgcctcccaggttcaagcaattctcctgcctcagcctccctagtagctgggattacaggtgctcaccaccacacctgactaatttttgtagttttagtagagacggggtttccccatgttggtcaggctggtcttgaactcctgacctcaggcgattcgcctgcctcggcctcccaaagtgctgggattacaggcgtgagccaccgtgcccagcctgttttaaggatacaaacttcacatgtgcttaaaatagtgcctgacacatctccccaaggaccttcagaaacaagaataacatgctccaccacagtctactaaacatcatcagcgatcacgtccctgagaggtaagcagcgcagtggtgaagaggttaactctgaaggcagaatgtctgggttcaaatcctggctcttctgctaactgtgtgacctggggcaagtgacatggcttctctgtgcctcagtttaccatccacaaaatggagataacagcttctatgtcacagagttatcatggagttaaatgagagaactgaattgcttaaaatggtatctggcacttagtgaaattagtaaggatattattattcttctaactaaatttttaaaatactactactaatattactagtgttattttaattattcttgttattatcatccaagttctaccttttaactagttctctgactccaggtaagtgactatacctccctgagccccagtttcctgaaatgggtctggttagaaaacccgacatcagaggggtccagacggtaggaggcccaggacccagtgggtgtcacctaaccccatgggggcactgtcaggggacccgaggcacatttgaagggtcctggcagggaggtgagatgctgctaacctgcgctcaagctcccggcgaacccgtgcgccattctgcaccgcctcttcctgctcttcctccagccggtcccgctggcgctgcagctcctcctgggcaacctgcagcttctcccgctcctgcggcagctcctcggcctgctgctgggccacctgcaggctgtggaccaggttgctcttctcccttcaggacaaggggagcgggagcagaggggatgctggggctgctctctccagggaaggtggctggctgctcctctagccatgagctacatcctcccgtcttccaaggcacctgcctccaggaagccttccctgaccctgcccatagcagactcatttcactcacacactccagcagaagaacctggctttccttctccccagcccgcccacttagagtggatggaggtgctggcgtgatctctaagcactctaccacgtagaagaggccaggctaggctcctgggacacacaggcaattgtgccaccagttctgctaggccatgtgaccaggaaatgtcccctagaacaccccatgcccctcaattctgggaagcctgatagagctgagtctgcagatcccacagcttcctgctacacaggcacatggtggccacggcaggggagggaggagaagggaacaactaggaccccaaagacttgctgtgagctgccactttccccactggtggtaggtgcaaaaaacttcaagacgtgatttttttttttttttttttttgagatggagtctcgctctgttgcccaggctggagtgcagtggcacgatctctcctcactgcaagctccgccttctgggttcacgccattctcttgcctcagcctcccgagtatctgggaatacaggcgcccgccaccacgcctggctaatttttttttttttttttgagacggagtctcgctttgtcacgcaggctggagtgcagtggtgccatctcggctcactgcaacctctgcctcccgagttcatgccattctcctgcctcagcctcccgagtagccggaactacaggcactcgccacgatgcccggctaattttttatatttttagtacagatggggtttcaccgtgttagccaggttggtctcaatctcctgacctcgtgatccacccgcctcggcctcccaaagtgttgggattacaggcgtgggccaccgcgtccagcaatttttttgtttttacacacagtctcactcttgcctaggctggagtgcagtgacacaatctcactgcactccacacagcttgctgcaatctccacctccagagttcaagcgattctcctgcctcagcctcccgagtagctgggattacaagcgcctatcaccacgcccagctaatttttgcatttttatttagaagtggggtttcaccatgttggccaggctggtctcaaattcctgacctcaagtgatctgcacgcctcggcctcccaaagtgctgggattacaggcgttagccactgtgcctgggcaattttttaaatttttagtagagatggggtttcgccatgttggccagtgcctgcgggacaagaccgacggcgccacgcaggtgttcctctagggcccgccgctcactctcgctgtcgctaagctgcttccgcagggtgcccagcaggtcctggcttgcctcatagcgcccacgcatgttctggggcgtggggatcacagagtctagcgggggtcctttgaggcctccagagcccacctactctcttctggttccagggatacacactagcctacgctaggcggggtccagggcctggacctgccctggggcaggataggggcctaggcctgagagccaggcttccactcccctcctatgtgccctcaccaccctctgaaccctcatctccctggggtcccggacaactcctatcaaagcccccgggatgccagacaaactcccaggcacactcgtctcctgggttctgatcccacccccagggctcccaggctcctcccccttgcatcctggttccactctcacactcctccctaccctggctctgcccctagttcccaagctctcatcctaggctgtgatttcccttgctagaccttttcccagggtcctggctctgtatgaccagggacctgtctccctctctaccaggaccctaacactgtcgcagcctcctccctccaccggctgcccaagcacccacccccagctgcccaagcacccccacttctgggctggcttcagcgcagagccctcgaccacctccttgggggtcctgacaccctcagacactatttctcagggctctggctgcaccccagggcgctcagactcctcccccagacacgcccccacccccacctggagggcgcgagcccctccccctgggcctctggctgcgcccagaaaactcaagccccttcctacctggaccttcagctggcaaaagtgcagggcggagagaatcagggcaagcgagcgtggagtcttctgagcaggccggggaggggcctctgcggggcgaacggcctcggcccggcgaggagcgccgcggtggagacggggtccgctggcccgagagcccccgcaggctgcggtcggacgctgttggacgcaggctgccgctctcagcgtcagacaggacggcctgagggtaagggagggaagcaggaggccgcagagttaggaacttcggggttagctggcaaaaacgaccaggggaggctgggggccgcctcatcccaaatgctcccgcttacaagaagccttctgatttcacctcctccactagctcagtcctcagctcgccgctgaggcatcccatttattgcgaagacatcatttggcattgctcacaggtgggctccgagagggccgtgcctcccctctgagactgggggctccccagggcagaggccgggtgagctagcaggggtgctgagcagctacagcctgggtcccagggccccacccatctgcagttcaatccgaagccaccgaaaggcgaggcgggggagcccaggaccgcctggcagggccctgtcttcccgcctttctgggctcacacctgtgccaggtcccttaggctccgctgtagcccctctccatcctctgtctccagggccgcctgctcctgtagccgcagggattcctggagtgcggtgagggagacaaagagtggtcggggttctgtcttacctgaaacctcccctttccctccctccctggcccaccactgatcaggtggcctctgaagccatgtccataggccagccacctggtagaccccacagcaggcccgaggccctcaatgaacagaccaggcccagagaagagctgggttctgccccaggtcacacagtcgattgcaggagagctggacctagaacccaggccaggccccacacagaggggtgactaaaccaggctggaccctgggggagtgagtgtcccactggtgggggtggacagttgggattccaaaggcagcatctggacctggagagcgtggatgggagttcaagtcccaactctcctgcttactggctctgagactggacaagcatttcccctcttgggcctcagtttcccatccgtgtcattaggattactctacagggctgctgggagggagaaatgggatggaggaagtgagtgtgcttcccacaaagcctgcacacctgtgtgggctgaacctgagtgtgagtgggatgctgggggtggcccaggcagcccagccctaagcctgtgtccatggatctggccggtaccccatcccaccctgccccatctcaggggcagctgaagctcaccagggcctcaagcttctcggtgaggtccttgtcgacctgatccttctccagattctgcttctgtagacgcttcactgccaggcccagctctgtcactctggagttgggggagcaacagaggtgaatacgggaccaccccagcctctcaaatccactagctctgtgtccaccatgcttctccaaacccgaggcagggaccctaacatccacctccctggctgtgtgaccttaaacaagttgtggctcctctccagacctcacacttctcatctgtgaaatgggaatgaggttcccaccagctttatctcatgggaaagcactggaggacttacccaggtggcaggagtaaggggcacaagttgtttttttgtggttttcttttgagacagagtttcgctgtgtcgtccaggccggaatacagtgatgtgatcttggctcactgcaacctccacatcctgggttcaagcgattctcctgtctcagcctccctcgtagctgggattagaggcacacaccaccacacccgactaagttttgtatttttagtagagacagggtttcgcctattgggcaggctggtcttgagctcctgacctcaggtaatctcccaccttggcctcccaaagtgctgggattacaggtgtgagccacagcacccggccacaagttctgtcataggaggctaagctgtttatgataaacactgggcaactgccttcggaacctcagtggggtgcctgggaaggctggctgagctcacagaggaaggccctgctcctagtgaacagatgctcccttctccccaactctccagttttaccttctgcagtgacgcctgcctcatgcagcacccaccagggaccctcctggcactgaggtcagccttgtccaggtcgctttgcatctgctgctgggacaggtccttctcgtggagcaccttgtcccgcagctgctcctccagctgggcctgcttctccagggctggctcgacccggctctctgccagccgcaggcctgtgctcattcccaggccggcctcctggacagctcccctcccagctgcagcgggtcccttgggaagagaacacaggatggggatgggatggggctcactcccaactacaaattaaaactagtctggggctgggtatggcggcccacacctataatcccagcactttgggaggccgaggcgggcagatcacctgaggtcaggagttcgagaccagcctggccaacatggtgaaaccccatctctaccaaaaatacaaaaaattagccaggtgtggtggtgcactcctgtattcccagctacttgggaggctgaggcaggagaattgcttgaacctaggaggaggaggttgcagtaagctgagatcatgccactgcactccagtctgggcgacacagccagactgcgtctcaaaaaaataaataaataaaaaataaataaaactacactgggctgggtgcggtggcatgcacctgcagtcccagctatgcgggaagctgaggcaggattgcttgagcccaggaatttgaggccagcatgggaaacatagtgagactccatctcaaaaactaaagaggaagaagaaaaaaacaacaaccctacactgggatgccatttgtccactatcagattgggaaaaaaaaaaagggacacataatacacaaagagaggctctggggcaacaggccttcccctacacagctggtgggagggtgagtacaatcacaatggagggcactgagggagatcttcgaaaactatgcaggcataggaccttccccaccggctcctcctctaagaatggatcctacagatataccccagcacagaggagatggcttgtggacaaggaggttcactgcagcattgctcatgtaagatatcctggtgacaacctaaatgtctatcaaaaggggactgctactaagtacatgatggtacatcctttaagtggagaactgtggccaagaaaaaccagtggagaagttcttcctggcctgatccagagccacctcccagttataactagtaggtgaaaaaagcatcttcaagaactgtgaagatgaaattttaccaggcgtatatacaaaaaagtgtgtgtgtgtgtgtgtgtgtgtgtgtgtgtgtgtgcgcgtgtgtgatctcatttgctcatataaaataaccctggaaggtcacttaagaaactgataggccaggcacggtggctcatgcctgtaatcccagcactgtgggagaccgaggcgggagggtcacctgaggtcaggagttcaagaccagcctggccaatatggcgaaatcccgcctctattaaaaatacaaaaattagccaggtgtggtggctcattcctgtaatcccagctacttgggaggcggaggtgggagaatcacttgaacccgggaggcagaggttgcagtgagccaagatcgtgccactgcactccagcctggagactcgcagcacagcgagactccatctcaaaaaaaaaaaaaagaaaaaagaaaaagaaactgacaatgcttcttacggtaacttggtggccaaaaaaaaaaaaaaagaaagaaaataattgtatatataaaaagaaaaagaagctgatgatgctgcttgcctccaaggaaggaatgggaatatctggggtcagaggtgggagggagccattttactgtgtacccttttgaaatgtgaataggtgacttcatcaaaagtaaaatataaaaatttgaaaggctacttacaaaatttttttttctttttgtttctttttcagatggagtctcgctctgttgcccaggctggagtgcactggtttgacctcggctcactgcaacgtccgcctctccggttcaagcgattctcctgcctcagcctcccgagtaactggaattacagatgtacgtcacaacacccagctaatttttgtatttttagaagagacggggattcaccatgctggccaggttggtcttgaactcctgacctcaggtgatccacccgcctcagcctcccaaagtgctgggattacaggcatgagccatgacgcctggccttaaaatacattaaaaattatttgtattttaaaaaattaaaatgtattttaaggccaggcgtggtggcccatttcttgagacatagcaagaccctgtctcaaaaaaaaaaaaaaaaattagctgggtatagtggtgaacacttatagtcccagctatttgggaggctgaggtgggaggatcacttgagcctgggaggtcaagcctaacatgagttgtgattgtgccactgcactccagcctgggcgacagagagagactggctcaaaaaaaaagtattttaagtccataatacaggttaaatcctttcctttcctttcctgaatgacctgtaccactggttatccaatagtaaggagggaaagtgcctcattatagaattctaattaatatacacaggagtgactaaatgagaagctcacagttttgcagcctctaatgagtgggttggatcttgaaaagagagacagctggcatagggacatcctgatggaagaacacattctacttatggagtcttgatcaaacgaaaaagcaagcagaagagcctgaatctgacctagctttacatccaacatccaatttacaggaaatacatgggataaagaaatatgttaattgacaccataaggatgcaaccagcaaaatccagaccatgagaatctccaaggacaactagcccagtttcctgaacaaataagttaaaaaggacttcaaagacaaagcatgggccgggcacggtggctcactcttgtaatcccagcactttgggagaccaaggtaggtggatcacctgaggtcaagaccagcctggccaacatggtgaagctcccatgtctactaaaaatacaaaagttagctgggcgtggtggcgcactcctgtaatcccagctactcaagaggctgaagccatagaattgctgaacccaggaggcagaggttgtagtgagccaagatcctgccactgcactccagcctgggcaacaaagcgagactccatctcaaacaaacaaacaaacaaacaaccaaacaaacaaacaaaacaaagcaaccattcgcactttgtgaatgtctatggatccggattcaaacaaattgtaaagaaaaaactaaagcaagactatctgtgactttttatttatttatttattttgagacagagtttcactctgtcacccaggctggagtgcagtggtgtgatctcgactcactgaaacctccgcctcctgggttcaagcgagtctggtgcctcagcctccccagtagctgggattacaggcatgtgtcaccacacctggataatttttgtatttttagtagagatgggggtttcaccatgttggccaggctggtcccgaactccagacctcagatgatctgcccgccttggcctcccgaagtattgggattataggtgtgagccactgcacctggcctatctgtggcatttatgagacatatggaaaatttagacgctggctatttgatgatattaagaaaagattattaaaccaggtgcagtttctcatgcctgtaatcccagcaccttgggaggccaaggcaggaggatcactggggcacaggaattctagacccgtctgggcaacaaagtgagaactcgactctacgagaaataaaaaaatcagcaagcctggtggcatggacccgtggtcccaactgcacaggacctgaggtaggaggattgcttcagaccaggaggccaaggctgcagtgagccataaagaaaagaaaagattactaactaaaagtaagtccttgatatcagccagatgacactaaatcccatccattcccctgagctcacaggggggctgcctagactccagaaaaaaggctgtgcctagtcctagactctggcatgcaggaggtcagaaggctgaattctccactaaactcaaaagtataaccagtccagactgggtgtggtggcccgtgcctgtaatcccagcactttgggaggccgaggcgggcagatcacctgaggtcaggagttcgggacgagcctggccacatggtgaaaccccatccctactaaaaacacaaaaattagctgggcgtggtggcacattcgtataatccccgctactcgggaggcagaggcaggagaatcgcttgaaccttggtggggcagaggttgtagtaagccgagatcgtgtcattgtacttcagcccgggcaacaagagtaagactctgtctcaaaaaaaaaaaaaaaaaaaaagtatgtggccgggtgcggtggctcacgcctgtaatcccagcactttgggaggctgaggcgggcagatcatgaggtcagtagttcaagaccagcctggccaacatggtgaaattgcgactctactaaaaatacaaaaagtagctgggcgtggtggcatgtgcctgtaataccagctacttgggaggcggaggcaggagaattgcttgaacctgggaggcggaggttgcagtgagccatgatcgcaccactgcactctagtctgggtgacagagcaagactccgtctcaaaaaaaaaaaaaaaaaaaaaaagtagccctctctaagtcttaattccttcatctgtaaaaacagaataatgacttatgttagagatgctgtgaagagcccagggaataacaagtgctgtctgcataccacataacctgtccgctctcaaaggtggctgggctgatgatgtctggaagaagaaggctgggagaaatgctggttcccaaagtggtcagtaccaaggccacctagtccaacccttgcccctaggcctgtggttcctttggggcagattccagtctcgccaccacccagccaggggagtctgtgttgaatgggccatgtcctggaagtatgaaaggctcagccctctgagctgctggatggctctgtcctgtacccgccagtccataaatggtcagcagagcacatggcccacctacccgagccaaaggagttgggaaaaatctgtctgggtggccccctcatcctctcaacacacaggcctagagggaaaagggtactgtctaatgccagtcagtgctgtcctgagctcagctgctaagaatagcagggagtgaggtggtggtaaccagcaggactcaggcagaacagaggcccattacacacctggctgcccacaggctgccaccacctgctcttccacctttcatgccagttcctaccctactcatccacacagacagaaagctctggaaggggacgaaggtggcacaaagcaccctgacaaagtagccactacccaggctcagggatcacatattcccccagtgtaagccactcccagccctgagctgtaggagcagagatgcacaaaggcccctccccactgctgctctgtcccaggccaaggccaggtggtggctatgcagtcggggtgctcagctagtagcatagaaggctaaagccaaccccatctctgaataccccagtggaccaaggataaaggagcctttctcaaaagcagttacaggccaagcatggtggctcacacctgtagtctcagcactttgggaggctgaggtgggagaatcacttgagcccaggggtttgagaccagcctgggtgccacagtaagaccctgcctcttaaaaaaaaaaaaaaatttagctgggtgctgtggcatgtgcttgtggtcccagctatgtgggaggctgaggtgggaggattccttgagcctggaactttgaggttgcagtgagctatgactgggacatagcgagaccctgcctcaaaagaaaacagttcttaacaagcccacacttggagtggctactcttgtacctgacccccaaagtcgtgtgcctgatcctgagagcagactgcacatatctgtgggcagtcggcctgagacagccaccactgagtgcctacagcacggcccatttggccaagaccagcaacttccctgacctttttggatctcctaggtcccagttcagggccctgaatccccacaaccactgactgacggccctaccacctgctgtctctcctggcggccacagcagcagcagcagcagcaggaccatctctggtatcacatgaggtagggatcagatggctctgagaacaggccaggactgagtatggggtgggggtgggcaggaactctctgcaagcaggcactttctgaccaccacaattgcttaaatagaacaggtaatgatgctgccttttggacctgcctaaagagcagaagtcgtaaaagacagaacagctaaggctgataagggggtgagagacagggacaaccgtgcctcactgcagggacggagaacctacttgatcctttgaagaagtaatctggcaacagtcttaaaagtgactgcagttcaaacactctagccacacgactccagccctgggcatcctcacagcattgtttacaaaggcaaaagtccttccaaactagggcacttgtatgggccacagcagaccccctggccctaaagatgctcagtaagatacattgataatgtggaaaaatactcacgggataacatttgataataaaaataggatgcaaacttctggaagtgagggacatgtccattaccttgatggtactgatggtttcacgggttttatctatatgttaacacttatcaaattgtacactttaagtgtgtgtagtttattgtatattaatcatagctcaataaaaatgttttaagaaaagaactgaaggtgacaaatttttttaaagttttctatacagcataatctgaactacatacattataagataaacagacatgaagttaaaaagcttctgcatagcaaagtaaacgatcaacaaagtgaagagacagcccacaaatgggagaaaatatttgtaaactacccatctgacaagggattaataaccagaatatataaagaacgcaaacaactatataggaaaaatactaatagttccatcaaaagatgggcaaaagatacgaacagacatttctcaaaagaagacatacaaatagcaaacaggcatatggaaaggtattcaacgtcactggtcatcagagaaatgcaaatcaaaactacaatgagatatcatctcaccccagttaaaatggcttttatccaaaagacaggcaacaacaaatgctggcgaggttgtggaacccctgtacgctgttagtggaaatgtaaattataatagtgcaatcactatcgagaacagtttggaggttcctgaaaaaactaaaaattgatcaggtgtggtggctcatgcctgtaatctcagcactttgggacgtcgaggtgggaggatgacctgaggctaggagttcgagaccagcctggccaacacagcgaaaccccatctgtactaaaaataccaaaattaactgggcgtggtggtgtgtgcctataatcccagctacacgggaggctgaggcaggagaattgctagaactcgggaggcagaggttgcagtgagccaagatcatgccactgcactccagcctgggcaacaagagcaaaactccttctcaaaaaaaaaaaaaaaaaaaaaaaaaaaaggccaggcacactggctcacgcctgtaatcccagcactttgggaggccgaggcgggtggatcacgagctcaggagatcaagaccatccttgctaacacggtgaaaccccgtctctactaaaaagacaaaaaattagctggacctggtggcgggcgcctgtagtcccagctacttgggaggctgaggcccaagaattgcgtgaacctgggaggcggagcttgcagtgagctgagattgcgcccctgcgctccagcctgtgcaacagagcaagactctgtctcaaaaaaaaaaaaattttttcaaaaagaaaaaactaaactaaaaattgagctaccatatgatccagcaatcccactgctgggtatatacctgaaagaagggaaatcagtatatcgaagagatatatacctcaaagaagggaaatcagtatatcgaagagatatctgcattcccatgtttgttgcagcactgttcacaatagccaagatttggaagcaatctaagtgtccatcaacagatgaataaataaagaaaacacggtacagatacacaacagagtactattcagccataaaaaagaatgagatcctgtaatttgcaacaacatggatggaactggaggtcattatgttaagtgaaatgagccaggcagaaaaagacaaacactgcatgttatcacttatttgtgagagctaaaaattaaaacaattgaactcatagaggcaaagtactggatggttaccacaggcttggaacggtagtgtagggcttgtggggagatggggatggctaatgcgtacaaaaaaatcgaattaataagacctgtctggtagcagaacagagtgactgtagtaaataataattgtacatttaaaaataactaaaagagtataactagattgtttataacacaaaagataaatgcttgaggggatggataccccatttaccatgatgtgattattacgcattgcatgcctgtgtcaaagtatctcatataccctataaatacatatacctgctacatacccacaaaaattaaaaattaaaaatgtaacacaaagaaagaaaacagaaaagaatcgcatttgaatagtcatgttaaaataacaagatagcaggtgcttttccttctttttttagagacagggtcttgctctgtcacccaggctagagtgcagtggcatgcagaggccagctcactgcagcctcaacctcctaggctcaagtgatcctcccacatcagcctccctaacagctgggactacaggtgcacaccaccatgcccaggtaatttctgtattttattgtagagatggggtctggccatgttgctcaggctggtcttgaactcctggactcaagcaatctacccaccttggcctcccaaagtgctgcgattacaggtgtgaaccactgtgcctggccctctaagtttctgctaaaatgtacttgtaacttttacactgactacactcaaaagtattaaacttgtaaagaaaaggccctggaggagtttgttctttacaaggtcagtcagaagctacaaggggccaggctggggccaaggtgagggcaggtacatgcaggggcagatgctgggtgtggagtaggtgccaggtgctagctgggcatgaatgtgcacccgctccctgacctctgctccctgactctcacaaggaactagcactgcctggagacaggaagaagcagcgtacggaaggcagactctctggccagagatctcgcagccaggagcacagtgagaacagagcctaagcctatctgtccagagcccaggctccctttccctacaactgcagcctccttattctgctctggcccagcagagtgaggaggggccgcccacccagccatacctgccggtggctgctgggggtgcatggtcagaagaggaaagatgcggttcaggtagtcattcagcagcttctcctgcacaatgcctgagccacaagtcagaagggagaaaagggccacacgatgagtgcagctcctggcccctgctggccccagagacttctggtcctaggccagccacaggtgcagcaaggcctgaggcctttgtcccttccttctcctcccaacaagaggagcctccttccttctctgccagcccttacctgtgaccctggatttctcagcatctgaggtcagcctacagctcttgcgggagaaagacacgccggcccccttggatgccatccttcgtctctcatgggcagccagtggtcctggaggctgaggcagacacagagcctgtctactcagggccagccaggggcccccacacctgacctcagtcctgccatggcaggaagtcttgggagcaggtgaggccaggggcatgcacactaacacataggacaggggaatgcaggggctcccagcttcctacacaggcagggtagccagggtctaggcccatgtaacagggaccacttcttgttctccagtgtccctgtgcccagcacagggctgggcagagagcaggtaccagatatatttttgccaaaccataacaaaatgtctcagctctgtggaaatcagaccaaaatgtccaaagtgaggtgtcctaggggcagagcccctgtattcatctcggttgtaagccatactgagtccagctcacaaccagaagcgacaatcctacacattcccccaagtgcagaccaccactggtctggtcatctctagccataagtcccacttactccccacaaggctggagcctctttcctcagccctgggttcctcccttcttttatccatggtcctgatagtttcactgttcccactcacacatgtggcctcccacctcatccaagcaccacccttgcccagccctcatggcaaactccattggtcctcctagtgcatctatccctcacatcatgttgctgctgcagctgctccaaaacctgcactgagtccctggtgctggcctcactgatgtgtagctgtgctgtccaacacagcagccgtcatccacgtgaggttacttaaatttaaagttttaaaaattaacaattcgatttctcagttgcctcagccacatttcaagagttcaatgaccacatgtggctaacggttactctattggacagcacaaaggtagaacattcccaccatcatataaagttctattagacagcgcaggtctagagtttcgctctgcagcactgccttagccagcactccctactctgccgttcagtctcttatctcgccccaaacagaccctctactcccgccacaaacccctgtgggtctgcaccacgcctgctcctcgggaaggtgattttcccgacctcgggccctcggtgggcctccatgatcggtgccccttcactaccacagtagttgaagatctgattaaatgcagtcattcatttgatgagcagaccttccagacacccactccgggtgtcagttgctgaggacccaggtgagaggcggaccttgtccccgcccggggactccctgtcacggctatcccgtccaacctcgccggggtatccgggctcagaactgaacctactccgtctgggagcccaaggatggctcccccaagtcgcccccgcctggccccaagctccagaggacctgccagaccagcttccgctcggagtttcgcactcagatcccggcgctgcaggtgccctcgcagtggactaaactggaccgcgaagggaatagccggaacccgccaggctcagagccctgccgcccctcactcaccccgagcctcggccgccgcgacccggttcacaacatccgcccaacctctcggctacggcgtccgttcagggccaaatcacgcgcacgctcgcgcgctgagcctccagccgcgcacgcgcaccggcccgcgcccagcctccgctaggggaccccctccgtggcttcccaccgggttgttccaggcctcagcttcgccgaaaggcctcaccacctccgacctccgcctgccccggggatgctcccagccctgctgcggcagaacgcgacgtgctaaccggaatccctaggccgcctgtctcctacccatacttggaggccccgctcagacggtcctgaaaacgtctgaaaggcggttcctgccagagtccctgctacctgttacctccacccctatttagtcctagtggacagcttcgctcaccttccctgggatgacacttctggcggctgagatgagcgagcctctctgggctctgccgccgggcgtgggctgacctgcctacagctggggcctgataaggcagcagcaaaagggtggaggggaggcagtgttgaagctggggcaagtaattttccccaatttacagggaaaaaccgaaattcagaaaagtttaatgtcagccaggggctggaacccagacctctggcagctgtcactttcacaatgcccttgggctgactaggctgcagaggggtttcaccccaaccccagggcacctcaagtggccccaccaaaccttcctaacacctgaccactaagtagggaggcctctcagggggctagctgtgctaggcccttgcaactgacctgtgggacctgaggcctggcccctcatggctcctgtcaccaggtctcaggtcagggtccagcaggccctgagctgacgtgcggagccagagccacccaatcccgtagggacaggtttcacaacttcccggatggggctgtggtgggtcacagtgcagcctccagccagaaggatggggtggctcccactcctgctgcttctgactcaatgcttaggggtccctggtgagtgcccccaaccttgatccccatctgccttcaggaggggcttggccccattctcctattctgggatgagaaaaaagtcagggagccagaggctcagtgggcatggggcagtgaccttggcctcttgagcacagctgggaagccctaggaacacatagacatggcccacttaggcctctattagcacgtctgctctagcactgaagcagtgttaggaccacacagatgcacgcacacagcaggcagtgacccctcctgagcctgatctacccctctaacctagcgtatgcctttgtgcaggtgagagcccagctttggagtctgaatgcctagccagggcccctggctgggtaatgtgatggctctgagccttagcattctcatttgagagatgagatggggcaagctccatcacccactgctctcacagagcgtgtgtgttagatctgagcccggtgcctgggccactacacagaggcaccggtgataactaccaagtctgggcctgcttcccaggggaaattttttgacaagtatctgtgcaggggggctagactggcccttgaaagtgcatacagggtccatcccagaagccttgtagctttgatcccctgaatgaacaaactgtggacatgccaatacacattactgacatgtatgcccacctgacctgcacccactctgcagggcagcgctcgccattgaatgacttctaggtgctccggggcacagagctacagcgccgctacaagcggtggtgcccgggccttggcaggaggatgtggcagatgctgaagagtgtgctggtcgctgtgggcccttaatggactgccggtgagtggccactgggcatagataagactgggggcaggggagcctgggccgtggcgttaccttgtgccttcttctctccagggcgttccactacaatgtgagcagccatggttgccaactgctgccatggactcaacactcaccccacacgaggctgcggcattctgggcgctgtgacctcttccaggagaaaggcgagtgggggtggagaggggcagggtgggagacaggggacctcagcccaagttgatcttctgtctcttgctcccagactacatacggacctgcatcatgaacaatggggttgggtaccggggcaccatggccacgaccgtgggtggcctgtcctgccaggcttggagccacaagttcccgaacgatcaccagtgggacaaacaccttccctccgtcccggcctgggaccttcccccagcacacactatagtgatgctctgggccctcaggtacatgcccacgctccggaatggcctggaagagaacttctgccgtaaccctgatggcgaccccggaggtccttggtgccacacaacagaccctgccgtgcgcttccagagctgcggcatcaaatcctgccgggtgggtaagcggcgccgggtcaagctgggagagtggagggacaagcccacgcccatccacgaacccactggctctttgtctccagccgcgtgtgtctggtgcaatggcgaggaataccgcggcgcggtagaccgcaccgagtcagggcgcgagtgccagcgctgggatcttcagcacccgcaccagcaccccttcgagccgggcaagtacgcgtaggcggtatcggcgccctgggggccgggctagggaaggtccaggactccaggggcagggctccgtgtagggcaactgggcggggccagataagccagagtcccagggtcttcttcacgccccattaccgcccccaggttcctcgaccaaggtctggacgacaactattgccggaatcctgacggctccgagcggccatggtgctacactacggatccgcagatcgagcgagaattctgtgacctcccccgctgcggtaggcggcggggaccaggcctgggagggtacctgggaaccttggggaggggcgtggcttggccggggaggtcagaggggctgggcgtgacctgagagcatatcccgtggagtaccgtacacctgggaaaggcgggtttggtcccagccccagagggatctcagctgtcgctcggggccggacctatctcggtccatctaagggtccgaggcacagccccgccaagaggccacaagtgtcagctgcttccgcgggaagggtgagggctaccggggcacagccaataccaccaccgcgggcgtaccttgccagcgttgggacgcgcaaatcccgcatcagcaccgatttacgccagaaaaatacgcgtgcaagtgaggtgggggggcgggcgttgggacgtgctgctgcgggtgagacgggaggagggtagtcacgggcttagggctggaggctggcgggctagggctgagtgcagcgcctgcttagagaccttcgggagaacttctgccggaaccccgacggctcagaggcgccctggtgcttcacactgcggcccggcatgcgcgtgggcttttgctaccagatccggcgttgtacagacgacgtgcggccccagggtgaggcccaagcttgggggctacagagccggggctggaagcctggaaccggagggccggggcggggtctcggcctgatggctgcccgcaccggccgcagactgctaccacggcgcgggggagcagtaccgcggcacggtcagcaagacccgcaagggtgtccagtgccagcgcgggtccgctgagacgccgcacaagccgcagtgaatccctggtgctcccggccccgccagggccctaaccctggggcggcatgctttgatgtctgggaccagagcctggaaatggttgagactaccctgccacgacttcgctcccgctcccgcctcggttcacgtttacctccgaaccgcatgcacaactggaggagaacttctgccagacccagatggggatagccatgggccctggtgctacacgatggacccaaggaccccattcgactactgtgccctgcgacgctgcggtgagcactagtgacgcttgccccatgaccctgcctcagccctcaccaccaaaggctggctcccttaaccgcagtgaactttgtctttcagctgatgaccagccgccatcaatcctggacccccccaggttaggagttgggccagttatgggtcaggccctttagcccacgacatccacacagtctgggtttcatccagcccaccccatcctacagaccaggtgcagtttgagaagtgtggcaagagggtggatcggctggatcagcgttgttccaagctgcgcgtggctgggggccatccgggcaactcaccctggacagtcagcttgcggaattggtgaggcacaactgcctgtctcccacagagaggagctgaggttgtgtcctctgtggttatgccactgggggctgggaatctatccctgcccccagaggtcctagccagaagatggcaggtctagcatctgtcccaggagtctgttccctgtcctaattccccactcctctaggcagggccagcatttctgcggggggtctctagtgaaggagcagtggatactgactgcccggcagtgcttctcctcctggtgagcctcccttgtgtttggggacccagtctcatcccaccttcccctttccccaggcaagctaacaagtgagccttggggcaacggactgagagtcacaaatgacctagcagagcttctctcccagccatatgcctctcacgggctatgaggtatggttgggcaccctgttccagaacccacaacatggagagccaggcctacagcgggtcccagtagccaagatgctgtgtgggccctcaggctctcagcttgtcctgctcaagctggagaggtatgtggacaacctgggagggtgtgaggtggggctgagccttgtggcctcagaccctgagtgcccccattcttgctaaagatctgtgaccctgaaccagcgtgtggccctgatctgcctgccgcctgaatgatatgtggtgcctccagggaccaagtgtgagattgcaggccggggtgagaccaaaggtaagagcatagtgcacaggactgctggtggccaggaggcccagccctggatcttcctccaggaccgtctccttctccccattcccctcactgcaggtacgggtaatgacacagtcctaaatgtggccttgctgaatgtcatctccaaccaggagtgtaacatcaagcaccgaggacatgtgcgggagagcgagatgtgcactgagggactgttggcccctgtgggggcctgtgaggttggtggcagggccctgggccagccctggaagggtatggggggctagaaatgaactattttatcatgaagcaggctagtcatggctgtggcccagggccctcatcagttctcctacctgccagggtgactacgggggcccacttgcctgctttacccacaactgctgggtcctgaaaggaattagaatccccaaccgagtatgcgcaaggtcgcgctggccagccgtcttcacgcgtgtctctgtgtttgtggactggattcacaaggtcatgagactgggttaggcccagccttgacgccatatgctttggggaggacaaaacttgtaagtacagtcaaggacaagacttgtactcaaggctgagatttaataaaattcatatttttactacttcaccaaggactttcttaaatgaaaatggtttttccccctacaagtaaacagtaataaagaagagaattattcctagtgcagtttgttttcatggtcttaatttttgctaagactccactgcttttgccttatcaatacaagtgccaacacagtgaaaaggcaaatatcatcttagtattactctgaaaatagttctgagctaatggcctactgaaaggaaaagagtggctcctgctattctattagacttattacaattatcttaagtattctttctaccctcctttaattgaatggaaacagggatggattggaggagctgtttttctcctttctttcccccggcaatatttactatttaatgccacttactaacactcaaagaaacaaaaccaaacttctcaattgacagtgcagtgacccaacaaagacacgggttcttgaattcaaagtggagcaggagagacggtaaatacacatttactttaatatatatatatttattatttatgtgtttaaagcacaaattagtttggtaaaaaacatctcatgtctgttttatttccacatccctgagactgacaaggggatgcctatcaattaattcatttagagagccatacaccccaagaaataaattatttgtcctctggagcttgtcacagggggatttttaaaaaaacattaaacagaaagacaactgtgcatcttagaaagataaaaggccaattcttcctctccggctgataggttcttaataatagtgatatctactaataagatgttttacatagtgtaaagcatgttcacatacaaattacttagcctctttgagcctcagttttcttatatgtaaagctggattaatagtacattttgtgtttaaaaagatgatgtatatgaagtgtttaccatttttcttggcatctagttcagttctcagtaactgatgtggtggtggtggtggtcatagtagcagtaagatccgtagtaatagtagcagcagttgttttagaaattagtaactgaggcctggcaaagttaaaggctctttcattaacacccagaggggaagaaatgaagctggtcttcagaggcaggctattttcactctgtgtcccaaattttcccccctagaccgtttttatacttctggggctctcagaaaatattctcagctattctgttagcttgatctcctaccatctgagagtgggcttccttcaaacaaccaaatttccaggtatttctaaactgcccttcccctacaccattctttgattcagtatttcaagacccctaagagaaatggtacatttacgtgtaagcacaggatagtgaagtatttacaacaagtgctttggagccagcaaatatggatcagaatgcagctttcctttcctacatacatgacattgggcagctaatttctaagattttacttctttgtctatgaaagtggagtactagtacttgctttgtgcaactctgatggttgttacatgaggtagcatctagaaacagcttgcacattgccagacacccagtggaaggtcaatgaatgactatttgaggactaactattacagaaatgtttactcttctgagtcctgatttctagtctcctggactaaataggttcactgttttcctcccggttcagtttccagacacatcacagaattataagaatattaaaaactcaggcttatacctacgcaggattttctataaccctctttctgctttgagctcctaaaggtatttcatagaaaaatgaccttatttttaaatagagggggcagttgaaaatcagtgaacggacctaccccctaatgatttttttctcagacataattataataattagcattataaagtgctaattatctttggacacagaggacctgcacaccagagacagaggtccgcattaagtaaagtgaatttcactttcttcagttgtgagatttctcttttttcttctttgtaatgatgcaaagatatatcatccaccaagcctcatttaaaagctttttccagttaaggaaactatctcttggccatccacagccagactccatattgagattatggatattcaaagaaattgtctttcccttgtatattgtcataactttttgtgaaatgttcgttttatagttccaggccagcacctagaaccttgctagaataaaaaactgcagaaatcatgagtttctagtttggatgaaagagcacacctattaacaaatgatagacggctatcctactgtgagtcctgaaaactggtggtgtgattgttgaatgggttaggggtatagcagagaaactcagtgtgggctacatacaatttcagcttgaatcacacttaacagatcctctgttccaaccatttaaatttacaaagaagaaactaaggcacagaactacttgagaagagaagcagaattgaaaactagagctcctgattgttctcaaaataatttttatcatactgcatcgggttctaagtgagagggcttcttatttagtaatgccaaggtcatgtgttaacatgtaaaaaaattagacgaggaatggggcattggtgtaagattatacagagtgtaaagttgggctttctcttatcatctgttgtcaacaacaggatgattgttactgttacccactccttaccatcattcacacagagacattggatattgaggagagactttaaaacagaatattagtaatgcagagctataaagagccacgatcatattaatacaatcctccatacacatagtgacctgtctgcagctccagcctagagaaacccagttattcatttgtagtgggcagccccattatcagaaagcgctattcaattggaagtgctcatctgtgttaggtcaaaaacgacttcctctaaatatccattctgtgtattgaagtataaatgagtcccacttaagaaaaaacaaaacaaaccaacttccaatgatttaaaaatactaacgtgaccctcttacgtttacctaaagctagtgtttctcaaacatcagctgtatcagaatccctgaaggacttgttaaaacaaattgctggtctctactctgagcttctgattcattaaatgtgggatggtacctgagaatctgcatttctaacacgttcccaggtgaccctgatgctgttgctctgagaaccactttgagatccacatctctaagctcatcagtctgtccgttacaccttacaagacatactttcctaatctgacacccttctatttgtctttttttggaatgctttagaaatttagcagttatcttttttatgtattttacatttgttacagctttccttggtggacagatatgagttttctacttgaaaataaacacgtttttctttaaaatatcattaaataagagtgtaattagtgatataaagcaagatgactaaaaagaatctctcattattatgtttgcacagcctgtatagaaattatttgaactagaaaggatttgctaagtaaattatttctatttccctcacttaatagtgaatattatggtgattaggggaaaaaataagctttcttttttcttttgagatggagtctcactctgtcacccaggctggagtgcagtggcgcgatgtcggctcactctgtcacccaggctggagtgcagtggcgccatctcggatcactaagccatctcggcctccccagctcaagtgattctactgcctcagactcccaagtagctggaattacaggtgtccgccaccatgcccagctaatttttgtatttttagtagagatcaccatgttggccaggctggtctcgaactcccgacctcaagtgatccgcctgtcttggcctcccaatgtgctgcgattacaggcatgagccaccacgcccagctaaaagaagcttttctgatagtaactttgttttcccattctggagtttatggcagtatgaaaaagactgaatttataagcagaagatctgtttttgaaatccggggacctgtatttcacaatggctttgatgtgttttgattgtgcacctttagacaacttatcagtttcctcatttttatacagcaataaaatagtaacagctacccattaaattctgtacagaagctagggacagacgcaataacacttgcatatctataaaggctttgtaaatgtgggtattatatctaatgtttatgcacatgctgtttgattattttcatttggaattccactccattaaaggaaaagtaacatacgaattcagattcttgtaagtcttcaggcatgaggcctccattgactaagtacattgcctacataatttctcctaacccaaatgaatctccagttaaaccaagctggtggttatgtactgtctccagaggatgccaagcataaagtccttgagtatattcatcttggatcctctgattggacaactgcggtattgagacttcaagttcccccttgaaggccccagacggtacctgtaattttactcaagttttaaatgtatgctctttgttaagaaagagtgacaatgatttgatttattttccgtgactggggttagggatgggggagactctaggaatgtgacttaccagtgaggttctagttttataaatcataggacaagttttgataggcaaatgttggactatagggctgaggttgttttccaccacaacatatagacttctactagcccttgaaggaaaaaacacgagaaaatcagttgggtcagctgagtattcctttacgagtatggaacagacttacataacaattctgcaggtaatggctctggaaaggtcaaccacttagttttggacaactcttttctattctgtataaccactttttcaccaaaatgatactaaataaatatgctataggaagctatattttgacatgactgttttaggcaaagatacactcaccaacttactccacaagagtttctaatcagagaatatcatatggatctatttgaattgctcccatgcttggctgagcccaaaataatttactgtgcatatgtacaccaagtgagaaggttgaggaggtgtcacttgtacatctctttattcttttttttttgtatgtgtgtgttattttcatgtgttttgaaaggctctcttgcttagcttttattttgccattaaagatttttttctgtgctataactgtatttttaagtctggtttgagttcaagaaatccacaaattcacaaaagattaggaataatttgtgaacaaaatgatgcagaaataaaaaatgcattttccaaataactcccttgcagtccttctcgcccaactaccactttctattaagtttcttcttcctactctatgaagtgccatgagctttcaattcattgtattttaagtataagctatacttactaaccttcacgttattctttgctacttaaataagcttgctttcatagttcaattgacgtattgtttaactgatatttttaattggtatattttgatatatattgataattgatagatacataattcatttgagatattttgggtatggagggttggaaggaatcctttcataatttttctacttaaaagaaatcttttttcatttaacagcttttcccatggggatagagttttcatgaataaagcaaagtcattaaatgaggtatatggtacatcttttaagagtcacagaaagaagcaacaacaatttacccaggcagagggtataagtttagaccttggttgcctgatttgtgggacaagttctttaattttttttctttatattttgacttttttttggactctctcctccccttccaggctccaggtcaaatacttgacacctgaatgatgttcaattatttaaaagatggattggccagctcagctcctgtctcagacagactgtctttaaatgtattttcaacatgtcttcagacagttatttttcctctgttcaattttgttcatcttcttacttaaccgttcaagtgctcctatttcctttttaaatgtagtattgagaagtgcaaacattattggaaaagagagtctcactagcataattgtgcattatcttcctcttatatcgccggcctccctgcacccccatgcccacctcctcctcgcgcctccatgccgcctcccactgctccagctccttgcagctgcgagtccagtcactggtcacctttcgtatctcctcactcagagcctggttggccaaacctgcctggtccagctgttctcagagcatggcattcacctgggccaggctggcactcctgaatggggcacaggggatcagtaggcgctcgcccagggggccatgctgccagccctggccctccctgctgctcctcctccagccagatgagggcactctccaggtcttggctgtgctctgcgtcctgggtggcacagaggttaaagcatcaggctgggcaggtggagggcagggcctgcctctgccccaccctggcacccaccctcagctgctgctgctccagctctccggatctctccaacagctgctccagctccgagaacctcttcttgtactggagaatctggggattgggagctgatggtgagccccaggggtgggggcagggcaaagtgaacacgtgggagggaaagagcaggaatgggtggccctgaccttgccctgcagccgctgcacaagctgggcctgccgctgctggccctccaggtaggcctgcagcttgcgccactaggaggcctgctcctcctgcagctgcctccgcaactccacgctctggagtaccagccccctgggctcttgcgtctccagctcaccagattgcagccacagagcctgctccagctgcagggaagggccctgggtgagagtcctgggcctcctgggaaggcaggctcaggcctctgtagggggtggcaggctgggcccagacccacaatgccttgtaggctgatagcctggcgccctggggagcagcacatgtgggcaagcccaggggcagtgcacgtgtgcatggggtgatgcagccatgcacgggcacgcagatggggcatgcatggacacatgcaggtgagcccacaaacccaaaccatgcaggcaaagctcaaaggtgcacctggggtctacgtcaggggcctcagtacaccatgcgcctctcctccagaacacttagccctgtcgtggtttctgtttattacattgatgcctgtgtcttcccaccatgcccccaccccagtgtgagctcagaaagcctggattttttgttcctcattgtatcttagtgctataatggtgtctgtggaatggcatggctcacgctcagtaaatatttcttgtgatggtgaattaatggcatgagctcatgggaatacattcaaacagaggtgtcaatccgcctatgcatatctgagcttaaaaatatgcacacacataacacatacaggcaacctcaaacatccccagggggacacgaaggactcccctcatatacacagcattaagatttgtaagaggtgcacacagatgttgccctatacggcgcctgcatattaatgcccacttctggctgggtgcagtggctcatgcctgtaatcccagcactttgggaggtcaaggcgggtggatcacttgaagtcaggggttcgagaccagcctggccaacgtgatgaaatcccgtctctactaaaaatcgaaaaattagccgggtgtggtggcatgcacctgtaatcccagttactcaggaggctgaggcaggagaatcacttgaacctgggaggcagaggttgaagtgagccgagatcgcaccactgcactccaccctgggcgacagagcaagactccatcttttatttatttatttatttatgtattcatttatttgtctcatgggctgagcgaggggaccccggctggtggagggacagctgcgccctgcaggccgctgcgtccgggcagaccccggcctcttgtcgtgcccccggcccgcgacaacccgggcaggatgggcagcaggacgcggcggggcatccgcggagcccgtcgggaacgctctcttggcctccggtgccgggcagcggtgggtgcggcacccacagtgcccacagcgcccccagccctgggacgtggctccagcccgcccccaggcaggcggcctccttcgccgggagcacgtcgcctgggcaacatggagaaacttcaactcttaaaaaaacaagacagccaccacaacaacaaaaagaacagatataagccggctgtggtgactcgtgcctctgctactccagaggctgaggtgggaggatcgattcaaccaagatacagtgagactgtctctcagagaaaaagtcaaacaaacaaaaaaagaggctgtgtaagaggtgactctggggacagtggaaaaacactaaggttttcaagtggtgttaaaagccactaggccttggggaccattgagcaatctacaaagcacggaagcctagatccctgagctctgcctgccaagtaccaccacagctaacatgggagacctccccgacagagactgaaatttgcctcccgaggaaacaagtgactacagacatctgtcccaggacagtaaacaagaaagcaaggtctcacaaaaacaaaaacagctgaccacagcatacaatcactgagaccgagcctgcgactataggtgaaaaaaaaaaatgctgtccattattcataccatgaaagaccaggggaaagtgggaacgcagtcccctactactgttgtgggaatcaggagaacagagagaccaatgggtggaacaggaggatttattgactgcactgaggcccagcagatgaaaatccaaaggctgagccccgaacaaagacagggcttaactttatagacacttctgaaagggggtcggctagtttgaatggcgcggcgggaatttgatggcatgaaactcgggggcaggcaagagggcttatagaagcagaacaaaggcagctaatcaaactgtcacaggtcttgcaatgcaagtatagctggtgaccttgcagctgcactgaagggaaatcaagaacttaacaaaacttgaataattagaaatgggaagggggaaagagaaggtagtaaaggcatttgttgttttttcctcttatctttgttggggcttactgtgttgagagagtctccggaactcactcctcgcggctctgacttttcagatcgtgttaccgaggatctactagggctctatctatggcaggtcttggagtcagccaagtacagggaacctgtcttttccttttaacttctgccttattactacaagttgtacagcacaccatgcctggttttcatcagcaatgtttcctgaggttacagaaagatttctaatcctgggaggaaacactcccttgaagcaaaagtgttctcccccaaaaaatgcaaggagctatcttctagatagccaggcagataattctcaggttttgccccacagaatctctatctaaaatacagcagtggtcatgcctagtgaaaagtttgagggaactcgcccagtgttgggtttcttcagagccatatatatagatataaccaaatatcctaaaagacactgcccttcatcattccatgctgttagacatttacaggaccatggatggtgatctcctccagacaaaaataaatgctggtgcagaataggtaagtgtattataatttgaggacatcagcttttgggcattttaaaccatgggtcagacatgttagagcaagaggccaggttgatagcaagagggagtgtttttcttttaatttgtcaatagcaaagtgatgtttgccactgtgatttcagagtgaggtggcaatttgttgttgtttggttttgtgggtttttgtttgtttgtttgtttgtttgtttttgagacaaggtctcactgtcacccaggctggagtgcagtggcatgatcagggtttactcctgccttgacctcatgaattcaagcaaacctccttactaatcctcccgagtagctgggattacaggcacgtgaccccacaccctggggtgtgaactgggatttgatgttttcagttggctctctaatggaataggttcccttactcttgtagaatcagattgtcttcatgattatcattcttgtgtgcattatatttctactaccctgctatttttttttctatttttcttttttctttttatttttttctttgtgagacagagtctcgctctgtctcccaggctgtattgcagtagcaggatctcagctcactgcaacctccacctcctgggttcaagcaattcttttgcttcagcctcctgagtagccacctggctaatttttgtatttttagtggagacagggtttcaccatgttggcaggctggtctcaatctcctgacctcaagtgattcacccgcctcagcctcccaaagtgctgggattacaggcatgaactaccacacctggctctcaaaccattttagttaagcaaagacagatttgtctggctttttagtacaatgctgaattatcctccaatctatatttttaggaaggacctcgggaatggcaacttggagatatttggtgaaaatgtgaacctttcatgttctgcttcagtccctttttgaaaatccttccaatttaccttttgcaaccagttagtggccttcccttcttcaccagcatgtgagttaattgataaagatcagaatatttgggctcaaaggtttcaacagttaagtcaaattttctgccaaagcctacaggatcttggagcctgctttagaaacagaagagtgaaatgtatttaagtttagatcagggaagtcctttataatattcttaattcacgttttggtgaagtggtatacacaacggtaggctcccctcttcctgtgggtttgggttttaccttgaaaggggctgtcagaacagaagtttcagggaagggaccagatccctggggactttccttaggtgatggtgatggaagaagaggcaaggcaggacaggaaggctcaggtaagaaagactatgcaggtgcaggggcaggaggagaaggagcagttggaggtgaaagagacaaagcctcctcaatatttctcaaatcagaaaacatgacagtctacctccttcagcttacttcctcaatggaggcaattttctcagttcttttagaaattttagaaatttagacatttctaggtctcattggaattaagtctcctatttaatttgtctggttcaaaaaccaaatttctctctctctctctgtttttttttttttttttttgagacagggtcacccagactggagtgcagtggtgtgatctcggcttactgcactcaccacttgctgcatgacagccaataagtcgagagttgaggtgtaggggcagggaaggtgactttattccagagagccaccaaactgaacagatggtgaagtaacatcctgaagaaccatcttaaattaatactattttccggctccttgtacattagggaagggaggaagaaggaggcgattgaggtgaagaggtctgacaatgacagacatgggctgcagtgagagcccaaggggatggtgaaaattgttggtcctttgtcaggtcacacttctcttataaatcttcagcataacactgttacttgtgtatacaacctctctatcttctcaggagttagtttggggaagggattattatcatctgtgctttaaagttaaactgtaagctaaatccctcccatagatagcttggcctatgtgcagaaataagaaaaagcagttagcctggaagatgtcaccacacggtaggaagggttaggagcaaaatgcagtcagtcatgctaggcctccttttcattgccatatatttaatgtatttgaacacgtaagtttaattttttatactttatttttatttatttatgatttttttgagacagagtctcactctgttgcccccccaggctggagtgcaatggcgtgatcttggctcactgcgacctctgcctcctgagttcaagcaattctcctgcctcagccttctgagtagctgggattacaggagccccccaccatgcccggctaatttttgtatttttagtagagacagggtttcaccatgttggccaggctggtctcaaactcctgacctcgggctcccaaagtgcttggactacaggcatgagccaccatgcccagcctaaccaagattattaaaccattctaatttgtcaaaagagtcacactgatttttaaaaaataatgtaatgggccaggtgcagtggcctatgcctgtaaccccagcgctttgggaagccatagcaggaggatcatgaggtcaggagttcaagacagcctgaccaacatggtgaaaccccgtgtctactaaaaatacaaaaattagccaagtgtggtggtgtgtgcctgtaatcccagctactcaggaggctgagacaggagaattgcttgaacccgggaagcagtggttgcagtgagccgagattgcaccactgcactctagcttaggcgacagagtgagactacatctcaaaataaataaataaataaataaatataataataatgtaatgaactttttcatgtctttatataaaaaatattacattatttaaattgttcaaaagcatcaaagattcctctctgctatcaacttcatttattttattgtaccaaactaccaggaccattaatttaatctacagctaaatctattattttttcatgttagaaattcaacaagaaaatttttccctaatgaaacctcacatttcaagcataaggagcctgggcgagttggctcacacctgtaatcccagcactttgggaggccgagacaggtgtatcacttgaggtcaggagtttgagactagcctggcaaacatgatgaaaccctgtctctactaaacatataaaaattagctgggcgtggtggcgtgtgcctataatcccagctactctggaggctgaggcagggaaatagcttcaacctgggaggcagagcttgcagtgagctgagatggcaccactgcactctagcctgggctacagagcaagactctgtctcaaaaataaataaatagataaataagcataagtagtaaaaaaataacataaatttaaaaataaggcacagggtcttgctctgttatccaggctagagtgcagtggggcaatcatagctgaccaacttggaacttctgggctcaggcaatcctcctggctcagcttgccttgtatttttttagagatgatgtcatgccctgttccccaggctggtctccaactgctggcctaaagcaatccttccgcctcagcctgttgagttgctgggagtacaggtgcaagacatgcagcctagcattgtagtaaaacaattttcaacaaattcttaattttctttccttttttttttttttttgagttgggagtctcattctgtcactcaggctggagggcagtggcacaatcatagttcactgcagcctgagattacagtcatgcattatcatgcccggccaactttaaaaaattagctaatacttaaaaatttgtagagacaggggtttcactgtgttgcccaggctggtctccaactcttaaagtgctgggactgtagctatgagccaccatacctggcttaattttcttattttaattttatataagtgagtattattgttcctaagataattggggcagtgactcctttacaattttagagatctaatttgtctattcacttcactgaaagagtatgccaatttgtttcatgagaaaatatcctatatttgaaaagaaggaaaattccttccaccaaactagggtgcattctaaagaaacgaattgttctaagtaacatcacttaaagtgcaaacagaggcaatggtatctattaacaatgtttatcagtgaaggaaataaactgaaaatatgaacatcattagatcctcggagggccttcattgctgaaaatctgagtaatattgtgatactcttttgagtctggcaggacattctctttccagggcatgtaacagtgggtgaataatttcttttcattcatttccattaagggctgaacttccttaatgttctggagattattaaatttgatttgtatagttgtgaaaagtactcatattgctgattccattgcttatatgtgatcatataaatcttttctctttctgtagtgtggtttaaacttaatccttaaagggcatgtatttgaatttttcagctggttagaaacctgaatataccaatcaaataaaactgctccttacatgctacagatttagttttcttcctgtactaagatgtcttttagatacagtaaattcgttaaagccaagagcccctaggaaatgaagttgggtgggaggggggacatcgagtagtaagatcactcttgtaacagagatgccactcttgcagatattgacaaaaattgggcctataaaatgtttaccaaacattggaaagacaagatctgaacaacttatcattgctgcagtctcaaatatcaggaaatgccattattctcaggacaataaatagacaataaagaagactcacagaccagattagctgtcatgtatcaccaaacagggactggatccttgttaacacgacccaacagagattgtccccagaaattcacttcataacctcaaaaccaaaaacccacactgatggcaaaaaataatgatgcaaagaatgagagagaaagagagagagagagagagagagagagagagagagagacctgtcctatagccatactcagtgggtaaaagccaaagagctcaatttctgctcatgatacttaatagaacatagggaacatgagccaatagctcaatgggttcagatctgcaccaagtgcctgttggacgcaggattctactgtctccaataatatgtctcagatgcactaattttttttctctttttgagacagagtcttactctgttgcccaggctgcggtgcaatggcgcgatctcggctcacagtaacctccacctcccgggttcaagcgattctcctgcctcagcctcccgagtagttgggattacagacacacaccactgcgcccggcaattattattattatcattattattattattgtgcgtgtgtatgtgtttttagtagagacggagttttgccatgttggtcaggctggtcttgaactcctgacctcagctgatcaaaagtaggtgaggtcagaaaacataccctgggagaggctggcacaatgcccagaaccgctatcgctaggcctggggttttcctctgtagtggaatactagtgttcatgtagtgcagggacaaaaccaattagatagttctgggagttaaaaagagatgatttacagtgccatttgagaaggggtattaaggaatttgccagggcactgatgcgtgtcaggtgtaaacctcaggttgagagagagctaagtattttctgtccatgaaggtgataagcgagggcctgaagaaagagggactggggaggacactggcaccagaaataggaaagggcttcttgggggtgggaaggatgggtcacggtgctatctataaagttggctggcagtggatgtaggatgtgggagtgagacatcaaacatgaagcagtcgcttaaagtctaaagaaacactagatatatgaactgcaggagatagtagggaaactggaccggctcctcataaaacttcccgccttctatctccgggaggatcgcagggcatttccgccaagacaggtgagactgcggttctgacctgcgggcctccatgcatatgcgctagggcacctgggggccggcagagccgttcccctacgcaaagtaagagtgttatgtctacaacccaacggggacactgagagccccaaaggccctgctttcttcccagagaacagcgcccatctgcataatttctacctggctctatgaggtgagaacacactccccgctagcacagaaatcctacaaactcctgtgggggctgcgcttggaagcagaggctgtgtaagaggtgacttggggggtagggaaaaacacgaagattttcacacagggtgagaacccaagagactggagaccacggaccaatccctgcaaaaagcagccagggtagaaatggaagagctgagcggacttcacgatagctaatttgtgttacaaagccgatacggctgatgctcgctttttctcctatggcgtgcaggccacatgttacttcttattccccaggcctccactgtaggattaacaactaagacacaaaccaatacgaaaaaagacatgacccttggcgtacggtctgtttttgaaactccagaaagtcaggggaaagcgcgaacgcagtcccccactaccacaaattatgcagtcgagtttcccacatttggggaaatcgcaggggtcagcacatccggagtgcaatggataagcctcgccctgggaaaaccaccttcgtgatcatggtatctcccctgccaggtaagtatgagatcttcgggctctgccccgacacagcctcatacgcctcactctttacacacacggtcacttgccccgcgcactcccgagccctttccagccctgacacacagctgggattctcacttccgatccgcggtcctgaacccgctcccagggcacgggaactccttcgtggcgaagcagcaagtggcgaagcagcagcctctgcgctgcctcatctacatagaagtcgccctgtccgtgatgtcaccgacagtgccttgcccagtccccgtctgcctttctgccactcaaccgaccaatctgctgccagagccgccaaggggaagtgacgtctgcctctccctttttccctcccgcccctgcgtctgttctctcccaaagaagctggtccttagcctgtgttaaggagcaacctttcggtggccagatggagccggggcatccttcttcaaataatggcttttaattcgcagactagaatgtttcggattacaaaagaaaccggttctcttcacatccttatccttgtgatgcagcattccgcttgcaattggaagccgtttaatatcagagagaaaccatatttatgaaagtaaagaggctgcttagatgactgcaaaccagccgtccttactggttttatcactggtaatgttataaagacagttgtccagtttcatgaatcttgtaggtttttttttttttgatgttgttttttttttcaaaaatccgtattgtagaaaaatatgctgtcccagaagagatgattggacactctcaagcgtggtgctggactttgtcatctcttgcacagccatctccacaccttagtgcttacctcatgttagttttttatattctgcaaagacgaaaccaaaataatccaaatttgacacaaatacctgggctacatcttatttgagatgtttaacaaatgtctggatcatcttttcttatatattacgcaggaaacactgtgaagtaagcaaagttggaatgcccaagtgaaagaccatttgaatatttacaagtagatttcagacaggaatactacagggtggtcacaggataacaaattctaggcagcagatttacatgacttgaggctgtgggctgttaagacgctgaaaaaccagggtgtggaccaagctggctaaggctgagtggacccaacgtggtgctggattggatggaggttttacctaggccctcattatatgctcattaacatactaaatcacacacccgccagtgccatgacagttctgagaccagtgtttgatgtaaaaatggcaccacagttccaagaaatctccacctttacccaggaattttcgtgaatattccaattcttggttaaagaaacccatcaagatgaaaccccagaacccattattctctcttgggtatgcccaagctcccctttcttgagtgtgtactttttgctttgcaataaatctcttctttcactatctgctgactcatctttgactttgttctcacgatggtgtcaagagcctggacaccacggctggggtcgagatcccaccagtgtccagggacctcccccagcccaccagtatcagattctattccattgctcaaatcacaaaacatcgagtggagagttctccttggagatcataaagtaaagattctgtggcatggtggccagttaggccactggaagcatggcaaaatattgaaaatgagggattaggtgacagtgtagtaactgctgaatactaaatacttgatccaggccccattccctggagattgacagggagacacattgtccaggtagtagtggagaaatgttttctgggtatctgaccagcctttgtggaaagaactggcaccatcctgcagatgtaaccgcctgatgggttcttcctgaccaatgtacacaaaaactcaattcatggagaccatggcactgcaggaaacggtttcattgacacaggccagccacgacatgtgggagacagagttattactcaaagcaatctcactgaaggcttggaggtaaggggtttttcaaagatagtttggtggggagggggctagggcttgcgtggtgctgattgttggggatgaaatcacaggggcgtggaaaatggccctcctgcatggagtcagcttctgggtgggggctaagggactggttgattttcgggccagatggtgccttccagcagtcagaaatgcaaaagcctgaaaagacatctcaagaggccaatcttaggttctacaatagtgatgttcttcacagcagtaattggggaagctgccaatcttgtgacttctggaataatggctggtaattatttaacgaggcatacatcttagtagaaatcaggcccctttcatccttctaacttggtggcctttcattcattttacaggggtaatttagttttggggaaggttatcatttaaagcagcctttttggctgtcctcaacctttttgtcaccagggactggtttcatggaagacaatttttccatggaagggggtggtggatgttttccatatgaaactgttccacttcaggtcatcaggcatcagttacagtctcataaggagtgcgcaatctggatcacgcacatgagctgtatcaccactcagctctcactccagcctcaggtatcagcaagacctcaccaaagattactgtttaattgtctctgtgtgtgtttttgtttgtttcaggtaacaactaatgttggaattatgaaaagctcttctctacttttaacaaagcttagtcacaaacagttccccagttgatgagaaaaactaaaacaacagaacaattgaaagtccgaatctgcaagttcatctctgagaaccgaattttacagccactccagatttgtactccaaatggatagtttgattgtagaaatcacttcccttcagtctgccaatgtgataactgcccaagagaaagtgatgcctacattcgtagataatcccctttcccccatcctatatataactggagtcaacagtagctggaggaaaatggcaagaacttggaatcaagattaggttagaataacactgctgtagacagtttatcagctcttcagcatatgtccattttccttgaaggatgagcctttagaaacctctgacaataaagtttattttacatccattcccttgcctatgattttttcatacaaatcacaattataaaactttcttgctccagctaaaagcaagaaactcaatcatgaatgtgttcactaaatatataccacagaatgatagcaaccagtctgaatgcatcacttgattccaaaattaaatgttagccctcagtggtgcaactacatgtatctccaactctggaagccacaggcaacatattcctgtttccttgcagggaaacagatctataagcagggcggcagtctcacacatgtacattcctgggaaacccaaggaaacaatgatagtgacgcagggcaggcaagcccccaaactgaaagagttttgctaatgtcgcgattggctttctatgttatttgaagactgagatctccatgaggaatgaagacaggtaatgcctaaggctgaggcatgacctcactgggtcaccttagctgtgaagtgaggtcagttgtcaccttgcaaaccttttggtaatccaaatcttggaatgatttctttaagaatttagacacttccagtacttttcctgtccttgtggggaaagcttctatccacctggtgaaagtgtctataaatactagcaaatcttgtagttccctgtaaggtggcatctgggttaagtctgtctgccagtcttcaccatggtatgttccttggtgttgtacaggtttaagcagggatcggggtatggggtggcttcctgagtggtaaccctttttatagtttagaacagtcccttcccgaagaatatttaggaaactaatttgaatggaaaatcccgtcccaaatgtgaggaatcatgaaaatgtttaattatttcccatctgtcagcctcaggaatagagtttgttcttttgtagcaaccatccagaggggtctccctggaagccttttactcagtccctttaatttccttaggggtatagtatggtgtcactgacacggatgcagtacctggtagtagcgcagcagcttgaaataccagggtttccttagttgtggccttagctgctctttccaccagggaatttcctctaataataaaagtgtctcccttctggtgtcccctgcagtgagtaattgttatttctttgggagttggacagcatctaaaagttccaagatctgagtaaagtcgtatgggggatcccttggctcttgatagtcccctttccttccctatggctgcatgagcatggagcaccaggaacccatatttagagtcagtcaacacattgactcttgagggttcatcctccccgcaggcaactggagatgtattgtccccagagggtacaatagagaatcttccgtcacaagtcagcaaccagcatatgtgagtgacagcatgtgtcccactcagaaatgagagtgtattagtccgttttcatgctgctgacaaatacataacagagtccaggaccaaaaagaggtttaattggacttacatttccatatgactggggaggcctcagaatcatggcgggaggcaaaaggcacttcttacaaggcagcagcaagagaaaatgaggaagaagccaaagcagaaacccctgagaaacccatcagatagtgagacttactggctatcaggagaatagcacaggaaagacccgcccccatgattcaattacctcctcctaagtccctcccacaacacatgggaattctgggagatacaattcaagttgagatttgggtgagggcacggccaaaccatgtcagaaagggatgaagtgacagcatatcctgatgtgtgtgatggtttcatgagttattatctatttcaaaatttattgcaatgtgtggaaaagaacaaggacttgtactatctgactttaaggtttactataagctatcagacacaaggcatcaagagtgacaaacggataaacagcctgagttagaaaacctgaaattgatccacagctatacggtcaataaatgggttttcagtaaaagcagttcaataaaagaaaataaatcatttcaattaatgaacttctatatggatgtggggagaccaacaatgttattctccctcacgttacacacaaaagtaatttcagccgcattacacaccaaaacttaaaagttaaagatataaagcatttcaaggatactttgtgacttgttggcaggcaaagattagcctaccaacaagcaggacacagaaaaaatacatatataagaaagacatgataaatgagacttcatcaacattagccacaccttctcatcaaaagataccactaagaaagcgaaaaggcaagcaagccacagacagagagaaaatacccacaaaacgtatctgacctccacatcctgcaattataattatagtggtctggtacactgcacccagtttctgctggatggagtattttctgggtgtctctaatgagtaagagagggccccatgggatattccttcagttcccagatgaacagtgggaaagactccacattgaccaacctcgggggcctgaaaacccaggtcctcaaggagggtagagtatacctggaccctgacccagacccctggatgggctgtgccaagagacccagcaagggaagggatttcctcctgcctcaggttctctgttcttctgtggttagaccacctgaacccaactccctccccaagcactagagatgggcttttccaagggctggggatcttgctgtcctgaggacagctgagcaagggggtcgaggaggagcttgggttgtggaggagaggaaaccgggtaagatgcgtgaagcagttggctataccaggcacagagaggacccgctgggacccaagagcctgcatgtgaagccaggccttgggccaccttgtctgtcaagggggtgcctacttccatggtgtcttcaaagggactgtggaaagagaggccttcagcccacacctctgaatgcttttccaccacagcatgccctgtggcctttatcctgctggtgtggaacagtcagacccctgcagggctgcagagcctctgtactgggcggcatcccagcctgagtgccagagctcagagggcaggcccccgagcaagcagagaggagggcaccttttggacagaacgtgtgggacaagagcgatggctcatccgttcaggttcctcacaaaatgagagtcaggaagatcagggcgccggcctgatttcccaggcagggctgaaagcagacaaccggagggagagcagcacctgggccaatgaggtagaagacagaagaccacagtgtactcctgccctcaacctcaccccctcccacccacatcctccacactccctgaccaccttcctcagaagtgtaataggaatccagattccccctggcctggttgctgcaggaggcacagtagcctgatggagcctgaggcaggtgtgggaagatgtggattgtctaactggaggttgggagtccagggtgtagaagcagcttggagtgcaggatttggtggtacgtgtgtggcagtaggcaaaagaaagagacaactggccgggcgcggtggctcacgcctgtaatcccaacactttgggagaccgaggcgggcggatcacgaggtcagatgaagaccacggtaaaacctcgtctctactaaaaatacaaaaaagtagccgggcgtggtggcgggtgcctgtagtcccagctactggggaggcagaggcaggagaatggcgtgaacccgggaggcggagcttgcagtgatctgagatcgcgccactgcactccagccactgcactccagcctgggtgacagagcaagactctgactcaaaaaaaaaaaaagaaaagaaaagaaaagaaaagaaaagaaagagacaactgagccacttgaaataccaagagaattcaaatttagaaaattcccagggaactatgcgtgcaggcactcaccagatccacaaaacagctgctgcataactgcatgttgcaagcaagccctaaattgctgattttgaaacagcctgatgggttcacaaagacaatttctgaatagtcgtaagagcagaggtgcactaaagccactgtgccccgcaggcccggatcccagtaagttctttaaggagtaagtcttacttccatttatggaagatttttggagttgtccttggtcacccccaggaatgttttggttaggagtagaattttagatgtcatcaatttaaaaattaaaactaaaacgctggaactcatagagagataaaattaagagaatacattcactatcctgagtagaaagatttcttatagaacataacaggctttaaaaataaagaaaaaaggccgggcgcggtggctcacgcctgtaatcccagcactttgggaggccgaggcgggtggatcctgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagattgcgccactgcagtccgcagtccggcctgggcgacagagcgagactccgtctcaaaaaaaaaaaaaaaagaaaaaatatggcaaaatttcatctaattaaatgctttgagaactaaaattaaaatccaaagccactggacagactgcttcttggccaaggagaccccagagaagtcttaaatactgagttcctgcccagtagttggaatctcagacacctctccttatactctctccctttgtggtttagacacaactgaccagcattattgttaaaatagagatcctaagactgacagaacagactccttgcagtaggaagatacggtatgataaacgagacctaaggccacgccaggcaaggtggagtcatgcgcccctcaacttaaagaataaactatgttctaattgccacaggtctttttcttcttcctttttttctctagctaaacaagcactggccttgagataagcaatgctgaagcacttgcagctcacccattaccataaactgactgagccctccctacacaagccataactacagctttgattggacaagagactgatttcagtaacttccccttgataagagagcactggctgtggacgggttctggacggtttacagaggctgtgcacttgactgcctttgtgtccctgcttccccttttgaagcatagggcctaattataatgtatttaaatgttgtctccaccccaaagtgaacatgggttgcatgtaacaggcatgtttactcagcatgcatgcagcaggatcccttcatgaatattcagagctcctcctattccctgttgaatatgtatatgtggcccaccacatcaacataaatccctgttcccccctcccctccctggaaacgtacttttcaggtttcagcagcaagagggtatgcctccctgtctgtcagaatggccaccttgcaggctgtaaccctttataaaaaataaaatctcccttctaaatttataaattgtgtgatttttcagttgacagctttcagtcagacttttcactgactgggaaaagtcatttgcaatatatttattttaaaaatgactcctcaggatacaaaattcttgtgcaaaaatcacaagcattcttatacaccaataacagacaaacagagagccaaatcattagtgaactcccattcacaattgcttcaaagagaataaaatacctaggaatccaacttacaagggatgtgaaggacctcttcaaggagaactacaaaacactgctcaacaaaataaaagaggatacaaacaaatggaagaacattccacgctcatgggtaggaagaatcactatcgtgaaaatggtcatactgcccaaggtaatttatagattccctgccatccccatcaagctaccaatgactttcttcacagaattggaaaaaactactttaaagttcatatggaaccaaaagagagcccgcatcgccatgtcaatcctaagccaaaagaacaaagctggaggcatcacgctacctgacttcaaatgatactacaaggctacagtaaccaaaacagcatggtactggtaccaaaacagagatatagaccaatggaggagaacagagccctcagaaataatgccacacatctacaactatctgatctttgacaaacctgacaaaaacaagaaatggggaaaggattccttatttaataaatggtgctgggaaaactggctagccatatgttgaaagctgaaactggatccctgttctcattgcttgcacctgggagacacaggttgcagtgaactgagattgagccatggcactccagcctgggtgacagaacgagactacatctcaataataataataatagtaataatttactgttctcataaaaattagcggatggggaatggaggcaagccggtgcaaaccatgacaactagtttagattttattgtcaactcatgaaaaactcgttctcattttgtgtttttaaaaaattccactgatacagccgttttctctaccgaaaaagactataaccgcattatttcatcactggaagctacagacagagggcccttgagaggcggcatcttcacctacgggaatgtttcctgctcaattgtgagacaaagagcatgtccaagttttcctataggccaggccgccccctagtttctgcgctgtgggctaaactccagaagctggcgcccttcagggccagaggtttcctgtgctctctggaggctgctaggattaaaggcaaagcaaacgacaggtctattagccacagttgcaggatagaaaacactactgtgactcagattagaacagaggttgtggcaaccacaactacaagtattaaccactacacgaccacaaagtctgctgacaaccattgcacttcttctatttttttaatgtaaaaacactcacactattttatctggtttattctaggacgtccgcagatttttgtgcttttctgtctttcatgtgcttctccctttctctccccattctgctacataatttaaaaaaaatctcttctctcaggatccagccactgcctctacaacaagcctcctgggaggtctctttgtcccattgacatctctgccttctttcgctgcttttttttttttttttttttttgacggagtctcgctctgtcgcccaggtggagtgcagtagcgcgatcttggctcactgcaacctttgcctcctgggttcaagcgattctcctgcctcagcgtcccaagtatagcgtcccaagaatagcaggtgcatgccaccacattcggctaatttttgtatttttagtagagatgggatttttccatgttagccaggctggtcttgaactcttgacctcaagcgatccatccgccttggcctcacaaaatgctgggattacaggcgtgtgccaacgtgcccggccaaatttcaggccaacacctgttgacacacattgccagacacacggaatccctcgcggaacaccgatgggcccacaaaacacgcgggggctgcggtcgctgatgatgtgagcaaattcgattcacggtgtctggggtacagccctgagggttcactggccacctctgcgcaaggaccagtctccgccgctcccctcatctccacgcagattcttgcccacacacctcccctttctttgggccgatgacaactcttggacctctgaggtgactgtcctgcccgcagcttctctccttccaagagtgtcatttcttgatcctctccatagtggctcaacggtaagcccaaggtccagcacgcgaatcaggaaactgatggttctttgggtttgcagggatccttccagtgaataaatgaaagtaacaggtaccagtatcaaaactgcagtgactcaccagagacacttcatgcttgccagcttgctaagctgtttgagtccaacaactgcatggggtcctgggttagtctcctgccgctactttggtgagtgttgttgtcactttaccttgtggtggccaagcccctaaatgcactcttgggttatgcagtataattttcagcgtaaaagacaagtaaagagccatagcgaagtgaaaaacaaccacgtgcagtggccgggaattgaacccgggtctcccgcatgggaggcgagaattctaccactaaaccaccaacgcctctctggaactaccccctggaggataacagaaaagagtaaccacaaagatttagaaactgttctaagcggttttttcaagtgtcgactaaaagctaacaaagacatccaaaccaaatgtgtttttataggaaacttttattagacaacgttataaatatcaaaatagctcatttgtcggatcaaactcttaactctgaaaaaggtctttctacctgcattacaaacccctataataaaacatcagaaattcattcatgtttcttttttctaatcctaaatcttccatcatcaacctcaaactgctgccttagaggttctgagaaggtaacctaactggtagtttaggtaagtaaagttcaaatccagggaggaaataagaagcagaagcagaattagaagaaagacgaaataaaaggacagaaccacggtagagataatgaagaaacaaaggttggtccactaagttagtcttttgtcgttggttttttttggcaaaagagtaatgatcggtctcgtaatcattataatactattatttgtctgcttgaagatgtataaagcatttgaaggaaatgtgatgtgaaaagatgaagaacgcttgccgtcaatgtttcattgtttgggagaatcccatttcctaagttaatatgctttgatgtgttagctatgtaagcagtagactagtttaaggaaatattgacggtcaaatattaacatattagtcttttgatgaagttcaaatattagagagatttctttcctcaattttcaatggagacattcaactgaagagacaaatccagagttttctccacatgttgggtctgggagtcattatgactttttcaaagacaggagctgtgacatggaatcatgcttcttctcaagctgagaagccaagctaggtccaggctgagtcataaacttgagcccaccaaggaaatcatccttcacattgacctcgcagagctttggctgttctctgttctttgcccaacacccaagacacacaccagctctggccaacaaaccttaacatatgatctatatcaaccaaagctacatttattcccaaatctccttctaaaatacaaacctgtactttctactctcaacttctaaatctaccaaggcctcatatgcatctgagtcacagatgctaaaacttaaccggttttctgaggattatttgaggaaggggtatgcatgcaaatgtatatacataattcatgtgatttaggaatatggactctatgacttccagatgcagatttagaacctttttaaaaaatattttgtttttgttgtcttgcaaatcagccagatctgcaacttaccagagtaaagccaaaccaagcgggacccttaggaaatgcgctaagatgtcatccactttcagtgtcagcctgtgaaaattcaggcgacagaagagaataaagagaatcttaaggaatttctggaaccaaagctaatattaagcaggcctcttgctggcagaccagtggaaattgtacctggtcaacaatctgtctagattgaggaggtctaaaatgtagccacaggttcaaatacttttctgtttgtttcccaacctcgattaaactcacaaaatttagggaccaaaaaaacaaacaaacaaacaaaaaaaaaaacaaaccacgacgttcccacccagtctcgaatcagggacttttctcgtgtgaggcgaacatgataaccactacaccacagaaactgcatatgcaccaaaaaaggcaaaatatcatcatgaaaatcttagatcagccatttctattatcgtttccaaagtaagaaattcaactgcatttcgaaattcgactgaaaaaagcccaataagcaccagccatcaagaagactatggctcccaataggcccaggcttagcgttccgcgcccacccccaacacgaaaaccatggggacccacacccgggcttcggggacacatacccgggcttcgggctcccgcatcctcccctgggtatgcagttccagaactaagcgccgtgtgcgggatcctcccggctgacactcttcggctcccagaagctgcaggagccggcgggctttgagcctccgagccctgggcgccccgtgcctctcaggagggtggacgccgcccttccagggatgcggaccccgcctcggggccttttccccggcgccggccgtcggggctcttggctcttctcgtcctcccaggaaccgtagaaccctccttgccctccctcccgtaggccgaggggcgtgagctgcgcctgtttcctcacggaccctttggcctcagcgcctcgatgtcttgcaattcttagctcacggctcttcctcctataacaaggcccttccatgtcatgtcccctactccctcttagcaccagagagatgtctcccctgccccacaggtcacattccatgagtggtgaagtttctagagttgtaaccatggcatctccagccctgtgtgttcctctccatgctccccattgagcagtcttgatcctatattagccccaggaaatgaaatagaaacaggaccctacgttaaaaagttgcagtggagatgtggtggccaccaggggctggaactgtggggtgactgagagtatccaaagccctgtggccaacttactggtgctgagtgtgctggtgagcctctctgtcagctggcttccccgggccagttgctcccggaagctctgtcccaggtagtagtcaatgtcattgctccttaggagatcctcaaaagattttactgtatcttttgcatgctgggtgagaagataacaaacacctctcccttctcgtattttttgccgtaggtaagacagttcccgggcctgatcctgaatcagggaatcatatttcctaatgcaggacagaagaggaaagggtggatgataagttatgggggcttctgtagagatttctatgagaacatctctaaggaactcccccaaactgaattctggcacataagccataggaggcatttaacagcaaattctaccctgataaagtatcgcactaaaaattttagtatgggccgggcgtggtggctcatgcctgtaatcccagcactttgggaggctgaggcaggcagatcataggtcaagagttcgtgacaagcctggccaatatggtgaaacccctcctctactaaaaacacacacaaaaattagctgggcatggtggcacatgcctgtaatcccagctacttgggaggctgagggaggagaattgcttgaacctgggaggtagaggttgcagtgagccgagatggcaccactgcactccagcctgggtgacagagtgagactctgtatcaaaacaaaacaaaacaaaaatttaccatgccactgttcttcaactgttatatatatgttaattatatgtccctagataaattttttgggagctgggcctccagctgggatactctctggaggagactcttcaggtcctttttggcctgaagtcctggagagtagaaagccccagtgccatcagacagccacaactcatcctcatcagtgacactatgaggtgaagacccctccagggtgtcaggagctctcagcttccagggtctttccagactagatgaataatcacttgtaaccaagagggactggacccggttcttgaggttttgaatgaccttgttggcattctgcagctgggccttcagatctttgatgtcctttcataggacccagatgttttctgactttccatatacccagaactcttcctgcctccctagttcattctccaagggcttcctctcagaggaactagccagcgttcagccccggcgcccctgctcagagcacagcccctccaccaggaccatttccttgcggctgctgtgctcctcatgctctgaaaaaagacaaagatgtcttcctaaataaaagttggatgtgctgttgtggccactgcctttgagaggaggcaggtttggtcatgaggacaataattactagggaataaggtgaagtcgtactttattcaaccctgacactgtactaggcattcaaatacagtatttcttatcctccttatacccacaagttaggtttcaccactttctattttactgactggggaaaccaaaacttaaagagaggtggtaaaccagcttgttctagatcactcaaactagcacatggcagagcctgaattcaaatcctccaacgtcctgtgttcattccacacacactgatgtttctcaagccattaacatggccttatctagttaggatagccacaagaacgcaggacaagctatttctgcatgctgcaagtttaatgctctctaaagtttactataatttaaaagtttattgggttaccactgtgtgaaaaataggcataggaaaataagacttcgaataaatatatcagcatgttaacatcagtgtattggggcagtggtagtcagaatgagaactaatccacagcattttacctgatgccagacactgttctaaagcattttataagaatttactcatttaattcacattagtatctgatggggtaggtagttcctttattactattttaacatatgaagaaactggggcataggaaagtttacaaattgggatttgaagcaacaagtctggccccaggatcttttctcttaactgccacactacacttcctcaagaatgagagagactgtgtttttcttctcttctggttttctttttttttttttttagtttgtaagcaaacatttatagccatgattccacagatgtggtaagtaaaccaacagccattcctaaataaaatacaagaatttccatcatgcatagtttacaggcttggtaagaagcagtctctttaggggctagatgcttaagaaatattcaacaaacaatgaaatcttggcttttttttttttttttacacaaatgtttggttatttagccacattagtgataaaacatattcatattctaactgcaagtggaataaacattgcaacaaaaatgcaacccaatcaaaatcattagtaataactattactccctcttagcagtaagaaccattattcttggatttcaaacattttattttctgtgcatagcttatagcactgtattataggaatcagagtgtataagcaaaaaaatgaaataaaacttcttgaagaccatttccattatttatgattaaatcaatgaaactatacaatttccacattaaatacaaattagtaaaagaattcctccaagtagtattgcatataagctacaactttaccccaactattttaatcactatgattcgagatttcctaggatttaacagcccaagattgggctgttactacctcagcaagaacaatcaccagtaaatacatgaactggggttatagctgaatttttagaaactctccagacaaaccacgtgttagaggaggtaagtagaaaaactaatgtttgagctgtgctattcctaccaggaactatgtcaaatatgcaaagttcaaacattcttagtaaaataatatgaaaggatctatatatactgtaaatttagcaaaaacacttttatgtacagaagcctaaatatcttaggaggtttagaataccaatgaagagaattgttaattcttcaaggctggtttcttatgaggattaaaaaccagcccttagtctcagatgcattccacctagatgtgttcacgaactccatagagtaagaaatataaaccatgaatatgtactcttaatttccattcttcaacttaatgttctatagtacttcagatttttaaatccagagtttggtgtacacttaggaaattatagtaagagtagattagagaagatttgcttgttttccttttgaagccatgtgaaggtttattaccctgtgtattttcatcactgaaaagttccccggtgactaataaaataaaagtgtcacaagctacatgatggatctcttcttttaatgttgcatacagtttcagtttggctagtgagggctaactagctcagccctagtttcattttattagagttgaccactaaaaactaaataaggaagttaccagtaaagctaattcccaatacaagcaaaaaacaaaaacaaaaaacaaaaacaaaaccattcgcataataaaatatatccttaacacaaaataagggtataacatattctgcagcatgacattttattttatttctcagctgtagctttttcattcagaaattggagaccatcttttcactgagttgttattccttcctcttcccttagcttagggatatgttgaaaaaggcttttcaacaagtattttattttttacaagttgctatgaaattaaaatttatatatatatcttaagtgtttataaagcactcaaaattgtagcttacatgtatatgacttctgaaaataaaaatcacacttctaacataatctttctgctctgcaaaaatattctacatacatgcatatgatcaaaacaatcttttcatgtttggggtatttcttacacatagtaaaagaaaagtcaacaattatatcagtacttcccctgttaagataactgagtgccacctagtgttcaatttctgcaactactaagcttacaaattcaatactgctattaaaacccaggttctgaaaacggcattttggaaatcttttttttttttttttatgtttacggtggcaaaatacgactatgaaaagaacatgatatcaaaatcagtataaaaatagccacaggctacttaaatatgacaaacagacttattttttttcttcaaatgcagacttctgcctccctcaaattgtatcaaaatctcaagggaatatctaggtaactggaatatacacaatgactctatacaatcaagaggccagggcttaatcagattccgtgaggacaaggcaaatgatttcttcaaaacacccattttcttactggaagtggtaggaaaagcagcaatgcatggttttttttttttttttttttgtaattagtagacatggtcttctacccataagctccattacattaaaagaacaaagtgggcttaacatctcacttaagataattcagcattattatcagttttaaaaaaaccaaaaatatcttagaaacaaatcagtctgctttaacaaattgcattcatgctaatgaaattttaatcttctttgtcatgatcaaaatccaaattgtaggacaatcttcagaaaagatggaatgtaaaatgttgagttcaatttagatgtcatcaatatcttcatcatcatctccaatgtcatcaaactgaatttcatcatcatctccaggaccaaatgtatcagtttcattgattttagcatgctctggaagctcgccgtatgcctgcagacttctagcttcgtctgcattgtattttaaaattacatcagctttgttatcctggtagtctcggagaccaaccaaaataatgtccgaggtatttatccaaaccttttttctcaattttcctctgatgtgacataacctctttacaccatcgaaacacattgcttctagccgtccatttcccaacattttgattacctgagcatactcctgaccatcctctttgaataccagttctcttttttcagattcattctcattcttacccctgcgtctatttttacctcctttacctttattcttgggcatggcggtggcggcgacctcgcggcgtctctgacttctttccgggtagcggcgaccgcggcggctgctgctccgaggggcgacacgagggagcgcgcgggaccaagtaggtgctggaggccaggcaacgtgcgcgggagaggctggcgacccagctcttcggagatccgcctgcgtccacgctcggcggcagcaaaatgctcttctggttttcaatgtggtgggtggccctatggttgtagtccttttataatgcaaaacaaaattatttttaacttacggtttgcatgtttccaaaacctcatgtggtctctaagtaggccttagtatttctataataatcagttggctagaactttatattattattattattattattattattattattattagcagtgtgccacaaactaattgtagaaattcaaacttatacgcagcctcattttgggtaagagttctcctattaacctcctgtcctcctcttccccactacttgtcaggtgtggaattggccaacagcacccaaatgtgatagctgactccagggagggaaggtgagccccacaccctgtgctcttaccgggactggtggtttcctcctgttcagcctcattcttgctttggccacaagtctcatagcccaggtcctggaggtccacctggacctgtttactgtcctgcttcagcaagggttcacctgcgtgggaagagacagcaggtgttacagaatgtctgaatttcccacatatgccctcagcctcaatggcacataccctaaccttgtggggcagggagggcagatccacagtgcgagagaagcttctttgaactggtgggagaagagaccaccagctccaggaagcagaatttctttccacaggaggagcctgcatttgccattgataatctccccttcagataacctaggccttagttgggacaaggtatctgtaagtcagggattgtgtactctcatctctagcagccccattgaagctggcaagtgctttatcagcaggggttcaataaatgttgaatggagctgaactaatttagagtcccaagacacctagacctgcactgtccaataaggtagttagtagccacatatggccactttatactaaattaactaaaattaaataaaaccaaatgtccaagttgcactagccacacttcatgtgctcaataaccacgttatgtctgtatagaacatacagagcttataagacgtacaggctagttctttactagtaagtcatagttacctactaagtataactctgtatttctccagctcgttcgcctgagcaaagacagtggcttctgatagcagcagcttctcctggagatcttgatagcgttgtttgcattgtgacagctgggagcgcaggtgctgggtggaccctggtgggctaaacgctgattgggcccagtgtcacaaggctgggactggttctccaactgtgaaaggggccaagacaaggatcaggacagtccgaggccacccccatgcagtgatgaccacggcccgttgtgaaccccgtggactttactcaagtctgtcacagcacttctcatgccatttggcagtgacttgctttccagatggagctcctggagtgctgggataatgttttcttcatatctgtatccacagcacacagcacagcgccaatcaagtctacagaggagctcttaggaaacgttttctcagtggtcaaaaagagaaggggtggaaccctccactcatctcccctcacattctgtgccatcgattctctcagaatcccctgtattccccattttactgaatcttcagcatggctcctcccctaaacaggatcccaataacccatctgaggtccaggaacagacacctgtgatgagctgtgaccaaaaaaaaaaaaaaaaatggcattgataaggaagggatgtcattacatactacttgtctgggctgcctcataacctgatgcatccctatgttacagcagttaccccctcctattaaaattacctgtttatgtgccatctttccttaccatattaagtatctcaagggcagccattggttttattgccccatgccaatgcctagtgtgttatctgaaaaattaagtactcaagaaatatttatattgtaaaaggctttctaaaggctgaatgtaggctgaatattattactgttgtttgtggtacaaagagacctttctcttggtacctcttgattcacatgggagaacgttttaaagtaaacactgtcatctcgagcccttctccagtggtttttcattccatctaagcctacattgacttggtgggcatccactgtgaaggtagccccaaggtcaaggctctggggtctggggcaaggcctcacagtcacattcccctcctcttggtgttggtgcttcccaggagaaccaaccagttctgtgtttattctgtcgatggtgctggtcagatgcacaaggagctctggagtaagtttactattcccttctttgctactcagcacaagttgttcttgaggaggttgatgatattgtgggcattcttcagttttccctggagctttctgaactcagcctgaagactactctcactcagaccctctttggcaaccacagtctcaaccaccaccttgcccttctccttgtcttcctcaatctcccatccctcagacatttctgctctttcagctctgcattctcaaggcaaagatgggttctgggtctccacagttgccagacttttctccaaagccaccttgaggaactaaaagaaaatcatgctttgaagaagttaggccattaaagagggcccaagagaaacatgagattgcaaaggtagtttttgatgagaacaaaaacaaacaaaaaaagcagatctaaaatgaactccctacccagaacctccttagtcaggcaataagagcaataagatctcaagactaagttttattattattattattattattattattattattattattatttgagacagggtctcgctctgttgccggggtggagcgcagtggtgagatcatggctcactgcagccacgacctcctgggctcacgtaatcctcccacctcagcctcccaagtagctggaaccacaggtgtgtgccactacacccagctaatttttttttttttaatcgagacggagtctcgctctgtcacccaggctggagtgcagtggcacgatctcggctcactgcaacctctgcctcccaggttcaagcgattttcctgcctcagccttctgagtagctgggattataggagcgtgccaccatgcccagctaatttttgtatttttagtagagacggggtttcaccatgttggtcaggctggtcttgaactcctgacctcaggtgatcattctgcctcagcctcccaaagtgctgggattacaggcgtgagccactgagcccggcccacccagctaatttttttttttttgaaatggagtctcactctgttgcccaggctggagtacaaaatggcgtgatcccggctaactgcaacctccgcttcccagattcaagtgattctcctgcctcagcctcccgagtagctgggattacaggcatgtgccatcacacccacctaatttttatatttttagtagagacggggtttcaccatgttggccaggctggtcttgaactcctgacctcaggtgatctacgcgcttcagcctcccaaagtgctgggattacaggtatgatccactgtgtgcagccccgtgcagctaattaaaaaaaattttttttcgtaggcctggtgtgaaggctcatgcctgtaatcccagcactttgggaggctgaggcgggtggatcacctgaggtcaggagttcgagaccagcatgaccaacatggcaaaacccggcctctactaaaaatacaaaaattagccaggcgtggtggcaggcgcctgtaatcccaactacctgggaggctgaggcaggagaatcacttgaacccaggaggtagaggttgcagtgagccaagattgtgccattgcactccagcctgggcaacaagagcaaaactctgtctcaaaaaaaaaaaaaaaaaggccaggcttgatggctcatgcctataatcccacaactttgggaggccgaggcgggtggatcacttcaggtcaggagtttgagaccagtttggccaacatggtgaaacccatctctactaaaaatacaaaattagctgggtgcggtggcacatgcttgtaatcccagctacttgggaggctgaggcaggagaatcacttgaacccaggaggcagaggttgcatgagcccagatcgccactgcactccagactgggtgacaagagtgaaaccccatctcaaaaaaagaaaaaaaaaattttttttttttttcagaatgaggtctcactgcattgcccaggctggtctcaaacttctggactcaagtggtccccctgccttggcctctcaaagtgctgggattacatgtgtaagccaccatgcctggccaaagacttacttttacaggaggagtataaaacatctcattagtaattttcataattgattatgtgtcgaaataatatttttgatattttgtgtcaagtaacactactaaaattaagctcacctatatccttctacattttcactgtggctactagaaaattttaaattacatctgtggctctcattacatttctattggacagcactgggctgggtgagatgactaggggcagaaagtacattctgagggccagacaatcaaggtgattgatactggggttaggttaactgaagggtagaaaaggccaggttaataggaggcagggactgagtaaccgggaacaaagttatcagagcatgagagagagattctgggggtcagccgtctgggatattatagggaggaaggaggctgtgctacaagggccaagagacaggaggatgcactcaagttggcctggatgaagggacgaccctctgcgacttgggtgggggtaagggtggcaggctggggccagccctgcactcaccgcttctgcttcctagaaggagaaacagtgtcacttggtacctccacctcaggggcgcagtcaagacccgctgccaggccagcctctgcctgaccgccggctcacctctcttcttccagcttcttccgcaggaggtcccacctccaggcgggcatgctggccagccgggcctcctcctcctcctgaaacacaaccacaaagcttcagagcctgcaggggctgggagatagggggcaccctcaacctggggacctgaaggagtcagggtcacaggaagtgaccctttggatgcatttctgtgggacaagtggatggaggtgcctggtcacaccccctcagagctggcctcctttctcctagtaacccagacccttgtgtcctacaggaggcaccagagagatcagagctgagtgggacagaagcagagaaaaagtagccgggacccagaggtcctgagcctgattccccacaggggcaggtggccaatggccacaggtccaagatctctgggcagacgcagatgcgggcccccacccagcctcttggctcagggagattcaggctgcccctggctcccctgagaaggaccttcagcccatggttgccctcttcccaacagagtggatacgtgctctacaatcgtggggctgcaatgacatcaggggcaggtgtggtgtccaacataggcagtttacagcaaacagttttatttcctgaatattacagaggagaaagggtctgtacaccgcacacttcacacagaacactgcacacgtggctcccttgacctcagccaaggaggtagctgtgaactccagtggaaaaccagagagcaggccacactgccccagggaggagccgcagcccctcactcagaggggcttcttctgctgcctggctccacacagagctcagcaagaccacggggccagagggggacacctggtttgttctgtgcctgccctgcctatccgaccaacgccccacacaacctgctcacgatgggacctcagaggctgaggcagcctggtcctgggccctccgggctgctcaaggccacagtcctgggttcttcccgctgcttcacgcctctggagggcgtcagacaggcgtccaggcccacgttaagacgctcgagggtgaactgcgaattccgaattccgctgctcagatgtcaaacagctctgcctccttctccttccagaaggagaagctgcggtcgatgtagcggcagatgtcctcgttgctgaattcgcccatctcagacactagttccaaagggtcttcggcgggggcttcggaacccggagagtctgagatccggggaggcgcggcggggaggcgcggcgggccggcgggcgggcgggcggtggcggcggctgcggcacaggggccagggcctcgcgctgccccttgggcgggtcccccttctgaaccggagcggcctcttcggtccgctcctgttctttccccttctcttcctttttcttcgcctgttcttcgggggccggcccagcctccaggccgtttccgaagaacctgtgcctgaggtcctcgaagccgtcgctccagccgcgccggccggcctccacctcctccagcaccacgcggtggaagaggcggatgcgctcccacgggtggctgtccagccggtggaacatctcgtagcacagtaggtggcggaacttgcgatcctcgcggctcaggcccatctccggtagctggaagtagccgagcatgaagaggtcgagcgtgaggctttcgtagcgcgggggtgcgccgccgtctaggggcgacaggaagtgctggggccagtacacgccgtgcgccaggcccgggcttggcggcacgtgccgccgcaggctccgccagtggtgcagcagcttgcccactgcctgccgctgcctcagcagctgccgcagccgttcgttggggctgtgggcctcgcccttgctcaccggcagccggggggcgtccgtggcctccagctccggccagcacgggcggccgtcacgccagggagcagtctgcctaggcgcgcctggtccgcggaaggcccggtccgaggaaggcccagaggcgccagtgctccaggaagaggtaaacgatgcgctccttgcgcaggtcgaggtagtcctggacgccgcgcagttccgtgcagaggggcggccggcgcgccagctgctcgggctcaagtagcgccgcctggcaatcctgtgcctcaggcgggcccagggtgtccaggggctcccagtcggccagcgggccgtgggcggcggcggcgctgggctggccagagccggccgccacgtagtcctcctacaggatgggctcgcggaccggggcgccagcggactgcgggggcttgcggcgcggacagcgcgggggcgccgcgtccagtgcgcgcagctcgtaggtggcgcggtgatgctgcacggagacgccgcactcgaggatctcgcgcgccacagcctcgcggcaccagttgagccagtgcgagcggcccaggcaaagcggccccggcagtcagggcgcctcaggcagcggcgccagcggctggcccgtgtcagcggtcggcagctccgccaggtgcgcaggccggccgcccagcgcggctagcagcgtggccatgctcttgagcagcgtggagatcttgctgcaccaggcgggcaggctggcggcgcggccatgcattcggcgcgggtcgacggtgaagcgcggctccacagggcgacggagatgggcagcagctgctcagctccagttgctccaggcgcgcctccagcttctgcgccttgtgcagcacctgcaggttctcgattgctgctcgatgcggaggatgtcggcctcggtcatgagctcgccaaagggccagaggatggcgttgtgctcgcgggagtacctccagccctcgcgggggtacctccagccctcgcgggggtagcagcacgagctggcggccgtcagctaaggcggggaagacaagagaggggagggaggcgcgtctccctctggcccagctcccgccgtggcgccaggaaccttttgcatgtcctgggtggtgtaatggctccgcggggctgcgtctgcagggagggaccgcgtctggccggcggggggtgacgctggggtgaggcttcggcctgagccgccgctccaggctctgggcagtgtccactttggtcgctggcggggggcacggccggttgctgctcgctgctgcggcggcaagaacaggccagcagacggggtctccatgcctggcttgttcgctcattacaccacccaaggaacttgccaaaggccttgaagctgagaggcgcggtggcccgccccaacccatccgagggcggctattgtgaggcctctcctcccagactcatgaccccttctccagctcccctgtggcccaagccttccgctccctgtggtcaatgttttatgtgcagaatgagaggccactcctctcttaaagaggctgcagctgcagcttccactgagctgcccacccttcccctcccttcgtcgtgctggacagctgggcaccgtaatattctcatttgctcacttttctccacctctgatgtccagttttcccccctgggcctgccatcgcctccacagaggtccctgattcatcttggccctatgggatccactccccacatacaaataggaagcagcctcttccctgcttaacactccccgcacccggctccccagtgctccaggagaaagtccgttctcttctgggcctctggccaggtcttggtaacctggcccccactgaggtctctccagctcagcgacccccttcctccaggacagtcagggccacatccactctcacttccagactgccctgtcccacctgcggctcttcagccccctctctgcctggccacccctcactcgtcttccaagtgttaccttagacatcacctcctccttccctaacacaccccccagcccacgtataaggtggccggttagggctgccccagtcccctgcgttccccattgcagctggctgtgttgcatcagcccaggtacttctctccactgccacccactctctcacactgccccattttgtgtgcttggtgactcgcacacatgtccgcagccaccttagagcaggccttgatatgttcaccatgaatccccagaggctacaagcgtgtggggcacataaatggcactcgggggccaggcgtggtggctcacgcctgtaatcccagcactttgggaggccgaggcgggcagatcacttgaggccaggagttcaagaccagcctggccaacatggtgaaaccccatctctactaagaatacaaaaattagccgggcatggttggcgggcatctgtagtcccagctactcgggaggctgaggcgggagaatcacttgaacccaggaggtggaggttgcagtgagtcaagatcgcaccactgtactccagcctcagtgacagagtgagaccctgtctcaaaaaaataaaaaataataaaaataaatggcattcggggaatagtttttggatgaatggaaagcaactcatcctgccagctggtgctgatcagctcaccttacagagaaggaaactgaggctggatgaggctcagtatcggcagctggaaggcggcagcgcagcaatggagaccaggtccctaagactgagaccaaagctctcttggctactcagtgtggtccttggaccagtgtcatcagcagcctcacccaggagctggctagaaatgcagaacctcagccctgcccagacctcctgaatccgaacaggccttttaaccagatcccaggtgctgggcaggtgaaggagagtctgagaaaggctgctgtctcactccaaggacaagctgctgggggtgtgtgtggagactgggacaagccccaaacggggtcgtgccaccctgatttccctaaagaagatggccgggcacagtggctcatgcctgtaatcccagccctggccaacatggtgaaaccccgtctctaataaaaatacaaaaaaattagctgggcgtggtggcatgcgcctgtaatcccagctacctgagaggctgaggcaggagaatcatttgaacccaggagacaaaggttgcagtgagccgagatcgcgccactgcactccagcctgggcgacagagcaagcctctgtctcacgaaaaagaaaaaaagaaaaagaaagaaagaaagaaaataggaggtcccgaggttggtgttgggggtggcgtgggggatgggctgtgcatccagatgcagaccccagggctccctgggcaccccgccccacccactttccacctctgctcctcctcctcctccatcttcagctgcatcttgcccaccatcacctggcgcttccactcgggcttgggacggccctgctcatcgtgcgtggggatgagcgcctccacgtccagctgcacccccggcgcaggagtagtgggcggcaccggaaccaagcttccgttgagcagcggctgaaaccccgcagctggcggtgtggggctccggactggtaacagtgcaggtgacacagacggcagcggccaatcgggctgcagggagaagcggtggggctgagcgcctggtggcctagggccagggaagccgggtcgcaggctcctgctgggcccgcctacctggaaggccggctgcctgctgcctgagaacactgtggtcagccccttgctctgtggcgtcggcttcaggctcttgcctgccttaatctcagccagtagctccgagttgtcgcccatcgggaacatcacgttgaaagacttggtgcctatgcagaggcaggagatgaggcactggccagggtggggctgcatccctgccacccctcacccgcccctctgcagcccccttcccaactccagattggatgggtgcccatcctcggggccagcgggcagctctccagatcccaggtcctgcaggcagctttcagggcccccagaggcaggcccttggttccccgactgtggcaaccccaccatcctcccccaccctactcacgggatggagggcccctgcctggagacccctgggagttcatggtggctcttgggcatatattcctgcccagccactgactgcccagccccaaaacactacctggaatcagccaccggacctttgtcccaggtttcctggctcagcccggctgggtggagcctccctctggccctctccctacatcagcaaagcctcagtgacccttgagctgagtcaattggggcctccatggacatgcagagtccagaccccagagtgccagtaccacctgctcccctccctcgccaccacacccacagacagacgcacaagcagacacattggttgcaagccgggagcacatttatggcaaagcacggctcagctctaggggaaagcagagcccttactaaggccacaggaggcacccaggaagaagggcagcaggtaatatgcaaacacccagggcagagggtgcattttctggcttagccggaggaggcgaatggagatttggagagataggtctcttgagtcccgatgaaggggtcaggtctgggagggaggaataaaatgggccgacagctcttggattcccaggctggggatcccagagtgcagtcaccgggaggagaagagtaggagaaagggaaaatcggtgtggcttactcatttatttaggcaaaaccatcagccaggcgcagaatgcttgggtgcatatgtgggtatgagggtaggtatgaggtgcaaggccccacccatgcatcgaggttctctcgcctgccagcccctgcccctgccctttcctcaaggctgggcccctcctcccgtgcttttcctgcctcttccccccaccccgcgcctcagcctcagccaggagccgcgcacgcagctactcactcttcctgtgcctcaggactctcacttctagggaccaagaggagagaagtgacagcggagttaggagggaaagggggccaggatgagactgggatagcaggggacagggagcgggccagggagagcaggaggggggaagtggagaagagaggaggagcatttctgcccatctgaccctggctcaggctgctctggggccccatgagggtggtccatcgagttcctggtttggctggtgcccctgagggctgggcagggcagggccaccagtggctctagcccccagcaagggcctccaccttggcactgggttggggtagggcacccagccctggctgtgctgggtgggggtgtctggggaagcccagagtatatttttctctgcccttagcttcagccctgctgcagactgtggagggaaggagaaggaggctcggcaggtgctggacatgcttccatgggctctggtctgcaggggctggggctccataggaaccatagggggacaagctctgctctgcactcctagtcagggagatgaagctttgaggggtgccactaagcatgatctctgccctgagtggctgggtgatgaaggcaccccagccaggctgggatgggagcaccacatctaggcaccctgtcctgggccttctaggtgtcctggcagggggacactgtcccaccctacagaaaagaagcccaggaatcctgcgccagtctagctcttaaaaaggatgcctagggaagtcaccggggagggagggggaaacatggtgggtcacagctttgcccccatagccaggctctggctggcccagggcccctggcaggaactggctaggaagagttcctggcatatctaagaaggcttcaggtctgtgctgcttggaaagacaagagaaagacgtggagagaggaagagaggctcaggatagacaggggcagggggaagggtggccagctgcggggcctctctgaagctggttcgacttcaagtgtccctccagtaccagctcatcagaaacaccagcaccagctcatgggaaacaccagcgccagagctggaaggccctttctagcccgtgggaggcaggcccagagaggggaggggacttgtccaggccacacagctagagggtgggaggcaggcccagactggggaagggacttgccccaggctgtgcagcccggtcctgctttggcaggacctcaagcaacccagagccctctcttagggtcaagtactcaatgcggtaggggtggccggaagaccatgtagaagaggaaggacccgggcagtgacagctggggagggggtggtgtctagatttccctcccctttcagggctagcgccgccccccacccctcaacctgcccctactcactgccggtgggcgaggaggagcggcgctgcccgcagccagggccagcgccctcgaggggcagaggcgggaccggcggcggcgaactcgcggcctcgggcaggggcggcggcggcggcggcggcggcagctgctgctccctggacgccttggggtccgcggcgcagccgttaggcacgtggttcccagggagttccgcctgcggggatgaaggtgggggctcacctcccagcttagggagaggctgaggggtctgggtcacatctggccgggggcgcgtgcagagccgcggtcaggtgtggcagagcagttggggcccacgtagcatccgcgacggctgcgccgcctgcgggggagcggaggggccttcgagcgagccgcgggcggcagggccgaggcgcgggcagccggcgggcgcgggctggcgggcacgcacctcctcgcggtgcgccatgcccgggcgtgcgaccagcgtctcgccggggcagcggcccagctgccggtagtagtcccccgtgctgggctgcttgctgaaagcgcggggcttgcggctggagtcctgcctccgtagcccgtcgtggccgtcgcaggagctcggctgcgggaagacagtgaccggtggggctcgggcaagtgcccggtaggcgccccccacgcctccccacccagctcttcacctcctgggaactcgcggccagcggccgtcggggggtgcagcagccgacttcctagaccccctgttctcacggtgggcagcgggcgaggttcatgggggcctcggtggaagggcaggctccgcccgccttacagggaggggttctgggcaccggccaaggggcacagggtcccccactgaggccagaaggggcgggcccaggggcgggccggcccagccccgacgccagggggagctagagaaggggcacctcccagcttagccttcactaggccctcggccgcactccgctctcggctgtcagaaggactgcgggtccccagggctccgcggagccctgtctttcgggggtcccgggccggagggagccccctccagagcctgtgctctccgaggctccggcttgccccggaccccgcttgtccgtctaggggctgctccaacctgccacggtgctggtggtcctgctgtgcacctggcggcgggggcggcaggacccgacacctgctttacgtgatacttcctctcaggttacagacgcccgcgcacggccagcctatgggctccgacggcctgacatcacccggggcccgccaatcccaggccgaaccccccccagccgtcgcggatgccacgggggcgccaactactctgccacacctggccgcggctctgcacccgccccgggccagatgtgaccccgccccctgcgcctctccctaagctgggagctgagcccccaccttcatccccgcccgagaggagagagggctgaccgtgggcagagggggcctctcatatttggctgccggctccgggtcgcgtccccaccgtttccctcctgcatctggaaaccatcgccatccacgaaagcgacaccgacacccgcgctcaagcctcggatttcaggggccgtaaggcggggtcgggtgacagcgcggcttcccgccccgtcgcagctgcccccaactaggcccagctcagtgagggagagtgaggcggccgggccaaagactgagtgaccgggtgggggctgtcccctgccccactctccagcccatgcgtccctgcggtggcctcagacccttcaccccgcccgacctggctcacgttgcaggaaacgcgacaccgcaggattcgttttctgggccagcccgccggctccgcgccccctgcagcccggaggctccgacgccacgaccctgctcccacctgcggtcaggcacccgcgcgggaggcgccgcggcgacacaaagagccctttgtagagcttcccggcccgggccctggcgtctgcggcccagcacgcacacagccgggagggacgcacacagccgggagggggctcgcacagccaggaggtgacctcacagacctggcacttgggctcagcggtggagagggggcactggctgggccacctgtcctgtggatttgggcggggcccacagtctgcgccgggagctcaacgattccagggcccctgcagccctacccgcccggccccctctgcctcccagagatgaaaggggaaagccactgtgggagcttggtctaaggtggcgtgaagagggcagctactggagctggcctgcaggtttggtgtccctcccatgcctcccttgcccactggccttgtgacctgagtcaccttgtatgaattggccctggggtggctttgccttgggcttaagagagaactgcaaggtcccaggctccagcaggaccccagggagctgccacaccacatctggccacctgtgacctcaggctgtcccctcacctcttagaccatccttgctctgttcctgtggccagaacgccagtgttccccagggcaccctgccgaggatacccgcaattgctcagaccagacctctgccccaatccctgctccagagcctcagccaggcgcctgcaggccccagacatccctaggcacctcacacttcacctacccaccctgccctcatcctctccacacaggctcgcttccctccagggctcccagctcaggcctggccctttcccccaggagctcaagccctaaactggaaccagccacagcttcacttcctcccagcccctactgccggtgggcgcccagccctgctagtgcctgctcaccttcctccctccctccttccagcccttacctctacagccatgccactggcaccttccacctggcagccacctcccttgggtgacactctccgactgagcctggggctgtgggggtgggggggcatgcttggggaggggcagtctccatgcattctctgtcaactccatgacaacccggccactcctgtgcaagaggtggcacaggcccagttcctggtgaggaacagctgtctggacctgcgtccttcaccccccagctcccatggagggcagtgacctgctcttactctcctcccagtccagtgtccagccctgacccctcgtgggactcgccaggagctttgactcttgaatatgccatggacccagggacccccaccctgtgcccactagtgaggccaggcctttggcctgactggcccccatcagcccagtacccctgctgggaggcaggcagtgggtgagggctcactacctccttcttgagggcctctgtctccacgtggcggagtttgttcttggtctgcatgtagatgtcagctgcctgtggtcccacaggaggcttgggagatgggtagctaggtgggggtgggggcagttgggtgcctgggggcgggggtggcggggggaagctgggtgggggtggtgggggtatgggcttcccaatcgtgccccaaggcaggcccagctctgggttcagcatgtccatgtagctctgtatgtctgcagctctagtgctggaaagccctggggaggcagaaggaagggccagatttggaagcatgcagacagcctttcccccaagaatgagactctccaccacctggaaacaacttgccgagggccaaggtgggctccgggcaccacttggtacacctgttgtggcccctggcgttgctgggcttcctctccctggccctgccctgccccagcccagcacttattgggggaagaccaggcactccggtttggaggggaagcactggaggctttggtgtgtctagagggcagggtcacctggaaggggagggtctactccttgggagtacagatggccacatccaatctttgcagggcaccctgccaggtctggaggccaccatctggtggcgtgaagcaggcattgcaagtggatggacgcccatgctcagggcacggtcagggtgtgtgtacacacaagcctgcagtctgccgaggcgattgtgaatttgtgtatgtttgagtgtgtacgcatttgtgcacatgcttctttgtattgatgaatgtgtgtgcattgctctgtggacatggtgtgtgtgtgtgtgcatatctgtagtatggaaatagagcattgtgtgcttgtgtgtaaggtgggtgtgtgcagatattagcatggctctgtatgtgtgttcatatctgtatgctgtgtgtacacatgtacaagtgtgtgcttttgtgtgtgagtagctaagaataatgaatggtgggtggcacacgtggattttgtgggtggggagagtacatgtggatgtacatgtatgtctgtgatgagcacacacaagtatgagtgacatctgtctctcaccagaaagggtgtcgcctccccatgtttaaaagcaagtgataagagtagtctccgatattggctgtggcaggctggcccaaggccaaccctcacagcccagcagtctggcttcagtctgctctccctccccctcttcctcctgggcacactcaccacgtggagggtgctggcccttgatgctggagtggctggaggagcaggagtcgtagttggagagggtgctggtgggcgagctgaggtcaaagttcagaggctggaccgacaccgtggtgttgggtgaggacatgcctgaatccggctgcttcgcctccagctccacggatggatcccgggagagcacgcagtgctccatgctctgaaggggaggcagggaggccatgaaggcaactgcaccccaagatgcgttgctctccaggccagggtcctactcagccatgcctttgccgtgggatcttggccaagccacacccctctctggggtctcttccccatcgctagagggtctttcaggttcctccgggttaagattcaagcccagccccgccaggcagaggacccaggttcctgggaaactccctcccctggctcctccctgattaggagggtggagagatcgacgaggagggggccttgagctgcaccccagggggagaactgccaggagatcggccttctccctcacagatcggcacaggctccatggggaagggcacagcacaggcccatccctagtgacctggctggcaagccagctctccttgccagacctgggacctggagcagactcccaacaccagcccggcctgtctcctgatggggcccttggggtaagggtagggcctggatggccagctgagcagtgatgggcagccagagctcaggctgccaggcctgccattcccccgccctgcccggtctgtgcgtctgaccacaggcctgtcccctcccggtgcagagggggctgtggtaggggccctgcttacattgcccatgctgcccctgctgccggcaagcccgcttgctccgctgcctcctgcccaggcctgctcctccttgccccgtgccccctccctacctaagaagtgtcacaggcaccctgggagagagaggcaggcctggcaccaggtaacggctcagcggccgcgctcattggccccgtaattaggggctctgctggagtgtttgccttttctgggccagcgtcttctgtggcttgggtctgtccctgcctcagctgggcctgcttgagtgaggggaccagggcacacacaccccacccattccaggggaccaggccctgttacctaccgcaggagtcaggggagccataggaggtggcatgggcagcacccaaaggtgctctttacctgggcaacagcagtgggtgctgagggcaccaagccctgacccctgtaggcagcagataagaggctgggccacagcaggtgtactgcgcctggcctgagccacccagctctgcagtctgggactgtggcttcaaactttccctccccgacttactagctatttcaggcgagtcacctgtgctttttgtgcctatgtttctttatctgcaaatgggggtaacagcactacttgctctgctgagctccaggacatggcgcccagtaaatgccatactgtcaaatttttttttttttttttttagacggagttttgttcttgttgcccaggctggagtacagtggcgcggtcttggctcagtgcaacctccacctcctgagttcaagcaattctcctgcctcagcctcccaagtagttggaattaaaggcacccgccaccacacccagctaatttttgtatatttagtagagatggggtttcatcatgttgaccaggctggtctcgaaccctgacttcaggtgatccacccgcctcagcttctcaaagtgcaggcatgagccaccacacccggcctgtcaacttttttattttattttattttatttttagacggagtcttgctctgtcaccaggctggagtgcagtggcgcggtcttggcttactgcaacctccgcctcctgggttcaagcgattctcctgcctcagcctcccgagtagctgggactacaggcgtgtgctaccacacctgactaatttttttttttttttgtagttttagtagatacggggtttcaccatgttggccaggatggtcttgatctactgacctcgtgatctgcccgcctcggcctcccaaagtgctgggattacaggcatgagccaccgcgcctggcctgagccactgcacccagccaactatttttttaatgtactgtgaagagtaactgagattacacctttaaggcactcggcagggtacctgcctaagtcagaatccaatgaatagtgtttgctgtcctatgaccactagcagctgcatccagacaggccctcaggtgccctgggctctggtgccaccccccatggtccctcgacagagtcacaggctctcttaactgatggggacccaccactgatgcagaaatgtccttccctgtgtccatcccggcttatataccctagtgacagagtgctgactacctgctgggccattcattctcttccagagactctttctcggggggaagttcaccctcaggcccacctgcagcctctggcctctgggccttgctgtgttctgcagcccccagagccaggaccatccccctgtgctggcagggacgacagatggacagacggtgctcagggcacagaccatctgccttcttccctccgggcctcatttcacagccactccatggccaggctgccccatggagttggtccgcatccttttggggttggctgtgaggcccactctcttccctgcctattgcctcaaagcaggcattgtaccagatggtgcagagccctcacttggagacatccacagctgagttcaagtcccagtaggtcacttcgtggctgtctcaccataaaaacataatttaaaaagagtagcatgggtttccagttatgacccagccatgaagtcagctaatatatggtgcaggggcagagaggtggctcctggtcaggccatcaaggtaggttctccactctaccacttactggtgatgcgatcctggtgccccgcagactccctttacccatatgtggaacgggacacttacactctcttctgcagagggtggctgtgagttatacccaagctaatgtctatgggtaggtgaatgagcctgcctgttcccaatggggcctgtcttgtgatttctccagccttaccccttggggtgaccctgttcttccctgtcctctttccgttaacctttgtgcctctactccctcagtccccagcaggcagtggttctgggctgacaggtcgtgtggggtagcgggcttcacgtctctgaacctcagcttcctccttggtaaaaggggtgacgacacccaccactggggtggaggggcgagaagagagaatgcaacaggagcagcgcagggatcgtaccaggttctccaccgtgcgcaggcagtgggtgcagtggctgtggccgttgaagtccgacaggtcagcggccgcgtacccgtcgcggtcgcggacttccagctccgcgccgttcactaccaggatctggcagcactgtgggggcacgcagtgaggacccggccgcggccacgagctgggacccccgcgcccgggcagggccgtgcggagagcgcggtgccagcagagggcgcgcgcccccaccccgggcccgcgctgacctctagctccccgttctcggcggcgtcgtacagcgcggtcccgccccacaggtcagccgagatctccccgccgtgcagcagcagccagctgagcaccttgctgtggccgcggctcgccgcgaagtgcgtggcggtggcgccgtctttgtcctgctccgacaggctcacgtcggtgcagctcacctgggcgggaggggcggggagagagggccgggggatgggggccaggcccctgcaggccccgcccacggtcctccgccccactcctgatggccccgctccctccactccccgccctgccggctccgccccgtctcccctccgcaccgcccgggcccggagctcaccaaccacacgatgaccgggctgtggcccatctgcgccgcggcgtgcagtggggtcatgccgtcgtgggcgcgcgcgtgcgggtccgcgccgcattcctgcaccaggtactgcgtcacctccaggtggccctcctggcacgccaggtacaggggcgtggcaccgttcttggtttgggcattcactcccctgcggagacacagcgcccaccgtgggctttcagcgcctcaccccctccgaggcctccttacccgcccccctcccctcccggggagccctggacggcagggagagtgggcgggagagggccctgtcaccggcccgctgccgcccggggggctccgcctggactgagtcctgagccaccctccctcagaggcccctgagggcgtcccacccagcactgccctgccctcagtcccacttttttttttttttttttttttttgagaagaagtctagctctgtcgcccaggctggagtgcagtggctggatcttggctcactgcaatctctgcctcccgggttcaagcgattcttctgcttcagcctcctgagtagctgggattacaggcatgcgccaccacgccccgctaatcttttgtatttttagtagagacggggtttcaccatgttgaccaggctggtctcgaacttctgaccttgtgatccgcccgcctcggcctcccaaagtgctgggattacagagccaccgcgcccagcctcagtcccactttttaaccgaggtctacaaagatgtggtgagctggcctttcctcccctctcgcccactgtcaccatgagtccccacaactgctgtgtctgacctctatccctttcatcgtgtgccccctccatctggaatgtccttccatcctcctccctcttgaagactcagtacccatccctcctccatgagggccaccctgatttatttcccccttgctggcctccgccccacactgcccagggccactatgagcatgacctgtcatgcttggttgaccataactgattttgacctttgcctcccccagaagactgagttcccagcgggcagggtggtaagggttgccagacaaaatgcagttcacacagttcaaccggaatttcggatgaacggataatgctttagtattctatatcccaaatattgcatgggacatacttatactaaaatacaacttttttatctgagattcaaagctagtcaaacatcccgggttttgttgttgctgtttttgttaatctggcagccctcgggatgtccactatgtactgaatgcttctgctgtgctagctctgggctacggcactggcaagcaggttcttctttttttatttttatttttgagacggagtctttctctgtcatccaggctggaatgcaatggcgcaatctcagctcactgcaccctctgcctcctgggttcaagccattctcctgcctgagcctcccaaacagctgggactacaggcatgtgccaccacgcctggctaattttcgtatttttagcagaaacccagttttgccatcttggccaggctggtctcaaactcctgagctcaagtgatccgcctgtctcggcctcccaaagtgctgggattacaggtgtgagccactgcgcccggccatcaactattactgtgaccatcaactgagattacaccggtaaggcacctagcaggggacctgccagaatcagaattcagtcaatggtgcagctacagctggggaggctcacaggtggggctgggactctgtgccatcacccatagtcccacaacagaggcacagactcagctctctcctcggtcacacagttggtaagtggcacttgaacacccatctgtctgtgcatgcagggcctggctggcaatatgggcatgcagggagtgaagagatggaatgtgtctcaggggctcctcctagggcctagttttcggctgtcactgtcccttatccttgctctgccagcccagagggggcctacctagggaacagcagggctgtcctggctgctgggctgttgggtgtgaacagcccagggtgcagttgccaccaaaggacactaggtggagccacaacctacccccagacccaggagaagttccaggttgggggccacgacctattgggttccagttcaccttttgtgcctaggaggccaattcctcacaggacttgacatcctgcccatctacctcccccagtctttcaccccgtagatcaaccacatgctccaccctgcattcatccctcgttcacccatccaactgcccatccacttgttgcctgcccatcaacgtgcaccaggctacccccctttgcccacccaccctcttgttcccaacacgactcagcccctcttctgacccctgtcacgtgtgccctctccctccctctcacacacatcctgagcccctcccagctggcatctccctgtccctaaagccctggttctctgtccacttccctgactcctgagaccccaaggctgactctgactgagacccctgactctgcagcccccatggacccccactcactgatttctcctccctccccactccctagacacagggctgccatttgctggggctgatgctgagccgggcacttcatgatggtgcggggagcaggcaccatgcctggtgatccagagggggtcccgtcaacacagatgagggagacagaagacccagctacgtatctatcttcagaaacatgctggctcgtggctgccagcctccacaccccagcgccagcgtcacccccacacacactcacatactgctgcatcagaacaggctgttgaatatttcatgaccgacgctcagcggcctaaattattcaccccgtaaccaaggcacagtgagtgccggggtctttgggatcaggggctggtgggggcccactgggttctttctgcagaggcccacggcggtgtacacagcgggtggggggccagacctgcagtgagctctgctctctcagcactccctacttggcagagatccatgacccaggggtgcccagccagccagagaaggtctgagaagctggcatcaagcaggatctgagcagcagggggaagtggtacccacggcctcctgcagggccgctggctggcactcccagcccaagttcctggcacggaatgagccctcagtaagtgctggagctcatcaccattctcattagtattccaccatctgcactcatgcgccccattatggagtcagagcctccagcttggaataccccagaacatgaggcagatatgctgttgggctgggtgggaaggggtcctggctcaacatccccttccaccttggcctgaggacaagaagaacaatgggcactctcacagtcactggggagtattacaaagatatggatgagcataaggaccaaaatgaaattcccatcacacacctggaatccaagcacctcgggaggccaaagcaggaggactgcctgagcctaggagttcgagaccagcctgggcaacatagagagacctccgtctctacaaacaatacaaaaatgagccaggtgtgttggtgcacacctgtagtcccagccactcaggaggctgaggagggaggatcacttgagtccaagaagttgaggctgcagggaactatgatcataccgctgcactccagcctgggtgtcagagcaagagcctatctctaaaataaataaataaatgagaaaataaacaaaattcccatcactagagagaggaattaataaaagtaataatagtaaataataataatagtgatagcagccaccatttactgaatgattactctgtctcaagcactgtgatgagtacaacacacacgttctctcagctggtctttgtaacaaccccacaggacaggtgttagcattgttcttctggtacagatgaggaaactgaggcacagagagctaagatcactctgtgagaaagaggcagagccccgatttgaggctgtgtctgatgcagagcctgcttctgactccaaatgtgccacgtctacaccccttctgctcttggtcggtctgtccctctgcctccctccctccctcccactgcacagaccactgcccttccccacagacctcactgctgggaactcaggaacactctttgacagctgctggggcacagccccgcaggaggacctggctcgagtcccgtgcctttgagctgtgccacagtcttgcttcttgtctctttgtgttcccaaacccatccatgaaatgggggcaacagttgtcatcctgacctcgtgcagagtgcctgagaagtgcctgcagagccctgagcacaggcctggtgcctggcgcacagccattgctgaactttaggatccttccctgtgcctgggaggaccagccaccaggggggtctatggctggcctggcctgtccgggtcctgccaagtacgggccaggctgggcatcatttctgctgtggggaacactacctagaggggagaggatgggtcttgggggagacctctgactcccagacccttgccagctctagccctgaccacagtgacagctgcagaaaagtgctcccagaccaagcccttgccctttgccccggctttgacccaaaccctctttgtaggtcagaggcgccctggcgatgatcgtataaatcatgatttgttttctttctcctgggaacaaagatgctatggatgaactgtaactattcatcaagtcacctctgattacacaaaagaaacatgggtcccccgtgtgggctgtgggaatctctggcggagactggtgccagctgactgccagcaccgccgcagggagtgagctgcccatggagccagagtcgggctgcagaatgattcccgcagcccgccccactgccagtcacgcctccccagagggaggccaggaagaggctgtccctccgaggatcagtctggttgtggcccgtgactgctttcaattgaaattcacggagcctttggtggatctacggctctcggtgtcctccagtcaaacttcccggcctatgttaaaagattcccaagtaggcctggcccagggaagaaatgcagccccgatttgagaaaggttctacaccccagcccatcagctagcatggaatagttccagaagcctacagttgcctgcaactctcccagcctcccaggtcttcctcctggcccgtaattaggccaaatttgaccccccctgaggcctctacacctccccacatcactgccagttccaccatggcagggctgcgaggccgaccctcttttcattaggttctcagctctcctcccctcaaagatgcctggcttccctgacccctcaacttaaagaaccatccccatcgcttcctaccaaactcctcatttcactatatagcacttgccactcctgaattatcttgttctcctattcctcagacccatacatgcgtggatagaagaatgtgtggctgacgtgatgacaggccgggcagttgagtgcacccacttgctgtttgttgaatgaataaatatgagaagggacatccaggccaggagtaggggatgtctcttcactcatggccgcagcctggtagagcaggttagatccacttgccagataggctcggaaatgcccagaggggagttttgtctagggtcacatgcaatgagctgtaggcagagtggacaagtccctgggattccatgccccactcattcagcagatgtttactggagtcaggctctgggcatacagagccgggaagacaaagcccctggccttattagtcacggacagacgggatgaaaacacacatctgtctgtgtgatgcagggcccagccagaaatccgggcatgcagggagtgaagagatggaatgtgtctcaggggcttctcctaggggttagcttccggctgtcacgcaggatgcacacagaacgcaaagccaggcaaccatagggcggctgggaggccaggtgcagtggctcatgcctgtaatcccagcactttgggaggccgaggtgggcggatcacctgagttcaggagttcgagaccagcctggccaacatggtgaaaccccatctctactaataatacaaaaattagccaggtgtggtgccatatgcacctataatcctggctactcaggaggctaaggcaggagaatcacctgaacctgggaggtggaggttacagagagctgtgccactgcactcaagcctgggcaatagagcaagagtcgagtctcaaggaaaagggcagcagggaacaaggtcagcgggaaagtgagtgggcatcatgggcgcgggtgacaatttcagcgaggctcagggttggccttgctgaggtgaggtctgggcaaagacttgcaggaaggcagggagcaggcggggatctctgatccctgcagagggatcagcctctgtgaaggcaggggtgctggcctgttggaggggaccacagcccggaggagggacagcctctgggccattgtaaggaagtgagcagcattccctgtcagtggccagaagcctgtgacgggaggtgctcttttttttttgtgaaacggagtcttgctctgttgcccaggctggaatgcagtggcacaatctcagctcactgtaaccgctgcctcccaggttcaagtgattcttatgcctcagcctcccaagcagctgggactacaggcgggagccaccacacccggctaactatttttccccctgagatggagtcttgctctgtcgcccaggcttgagtgcagtggcgcaatcttggttcactgcaacctccgccttccgggttcaagcaattctcctgcctcagcctcctgagtagcgggattacagacacccaccaccatgcccagctaatttttgtattttttagtagagacggggtttcaccgtattggccaagctggtctcaagttcctgaccttgtgatccgcccgcctcagcttcccaaagtgctgggattacaggcatgaaccactgcaccagaccaggacttgcattgtcttttcttttcttttctttttcttttttgagacggagtcttgctctgtcgcccaggctggagtacagtggctcgatcttggctcactgcaagctccgcctcccgggttccagcaattctcctgcctcagcctcccgagttgctgggactacaggcacgtgccaccacacccggctaatttttgtattttttagtagagacggggtttctccatgttggccaggctggtctcgaactcctgacctcgtgttccgcccgcctcagcctcccaaagtgctgggattacaggtgtgagccaccacacccagcaggacttgtgttttcaaaggctgcgggtggacatggacgggtgaaggccagggcctttcaggcttactgaggacttccccttttccgttctgtagtgcacagcctcacagagccttgggcccagctgagcccaaggggttcaggtagcccccacgtgaggcagaaagggggtttctcagaagccctgggatgccccagcagcgtgctgcttacagagccccagggtccaaggctcagctctcccccttagaagggtagggcaggagcactagccccggttagatgacagctgggaccaggagctgctggtggagacacgagatggtctcctgctgtgaggggcttccccggactccaccaggcccttcctttcccagagcctccacgtgggtcagggagtcaaggacggcagccacctcctcagtgtggacacaggccccgcccccacgccctgcagccaggtgaactgacagacaccaggggtagatctggggctgctgataaaaaggaatgagcccccacggcctgtggcagaatcagggaccaccccaggcagagcctccagccttctaagggggagagttgagccctgggccctggggctctctaagctgagagttgctaggggcttcccaacaaactccctttctgtcccaggtgggggctgcctgaacccctgggccgtgggagcagccagactccgtgaagctttgcacaaaggaagggaaaaggggaagtctgcagtggacttgaaaggccctgagtgattaggacctggaccaggagtgggagagagacccagagaggaggtacagcctgctcaaggccacacagcaagccagtgatgaccacagctggtgaatcagcctctctaaaacaccatttctgtacctgtcagctccaccaggcagggacgcttgtctggttcaccagcatatcactggcatttagaatattgcctggcacatagaagatgctcaataaacattagttgaatgagtccatctgtaaaatgggctgattacatagctactgctcggggtggttgtgtgactcagatgacactgggtggtgccagacccctagaagatactcagcaccaggttctttttttctttcctttcttttctttccttcctttctttcattcgttccttttttttttttttttttttttggacagagtcttgctctgttgcccaggctggaatgcaatagcatgatctgggctcactgcaacctccgcctccctggttcaagcgattctcctgcctcagcctccctagtagctgggattacaagcatgtgccacctgtacaggcatagcccagccacacacccagctaatttttgtatttttggtagagacggggtttcaccatgttggtcaggctggtcttgaactcttgacctcaggtgatccacctgcctcagcctcccaaagtgctgggattacaggcgtgagccaccatacccagccccaggtactttccaatcccattccagtctagtctggtcaggggtaggggaggctttgggggaaggaggcacctgctgaagttgataacatctctgggctaactggttttccagcttgctgtgactggcagcacccacgagcccaggggaagagactggagcctcctcactccccagcctggaagctcaagcctcagggtcccagctgatccccagctccccgacccacacagccctgtccagctgctcaggccctgggacagccagaagcaggtgtgaggggggcagagtgagctcctgggccccaggaccctcctgggagggtggccactggccttggggccacctgctcttcgcccctcctcactctgccctgaatgggggtctggaccccttgttcccctccatcagccactggagctcctgctgggagggccaaccctcccaactcaatctccctgagacccagagcctgggacttgcccagcccagctcctgccagccccgtacctcccaactgagaggtcctttttctttttcttttttttccccacctggagatggagtttcactcttgttgcccaggttgtagtgcaatggcgcgatcttggctcactgcaacctccgtctgccgggttcaagcgattctcctgcctcagcctcctgagtggctgggattacaggcacgcgccaccacacccggctaattttgtatgagagatcccttttctacaagggctcagagggagggtcccacgtggcagcagccccgaggtcactgtgacaagtcctctgcttctgggaagacttggccccatgaacgggatagacagggaggtgtgggggatgtgcaggacattcctgcaatctcaagcactttctattataacaccccaaggtgtagccctggaattagctgagcctccccgaggctgtccagccttccagctcctctgcagcgtgtcacttccatgtctcatggccacccacagcccctccctgggcaggatcgagtttcccaccagcaggtccgggagcccttcctccctcagcactcacccacgcgccagcgagagagctgagccttgtgaataattcacagcaattcacagcaggccccagaggctcgcaagatcatgaagctgggccacctgggtgccctgattgggccctgtggcctggggcagctcaagcctctgccctacccagctcccagccttcatatccacagcctcggtgagcaggaatccctacccgcaagataggaggttaagtgggtaccccagcccccaaccccaattcccagctgctcttcctgcataagcccagcctggcaaccacagaaagacaccttcttatcagtcgagtcacatgctgctgtggggaacggagcccaagccctctgtccacctccctgagattcatggtgactcctggggggctggcagctcatcagtccaggccatctggccactgggtcggcaccagcgcccaatcacacacagcacctggcatggcctgggagggggtcagggttccccagccccggagccctggagggcgttccacagcacagccagtcttcctaacacctgggatccagcccacggagggatcgtggcttctcagtgaggaaggcttaggggccggcggtccccaccagcacttgcataaggcgggctcagcgtcttccagttcacacttgggccatattggtcccgccatcaggggcacctgcccctctcaagacctgtccttctcctctgcttgaagtgagggggtgggacaggtgcatcagaatcaccgccatgagggtggggacatgtcccaggtgtggctcccaggccccaacctggagagtctaactcaggaatctgggacagcctccaagaggtgttgacaggagccagttggaaccctctactcaagggtccctgggtccctcctagtctaaatcccactgactttgacatgatccaaaccctagtttgtttggaagtagtgaattcataccaaagcagccaccaagaaggcctggcagggctggttgtgaagcaccccttcctccgggtgctgcctgttgggtctcccactaaccaaaccagggagccccttcttagcaaggatggaaccaggcccagctcccttgtcctgggctgaggggaccactggagcccggcctggtgggtcctagggccaccctacatccacgccagtgtgcctgggcccaagaggctgcagctgtggctaccttgccacatggccatatggccagaactggcctccagcttgctccctggtggccaggggccctgcaggcacacccagaaactgaccagtggtggggacaggccagaccctctcacctcgtagctgctctcgtcctgaggctgggtccacattcacatttccatctcaggctcccacttagactaacgagggtcacccatcagagtaacccactccccgctcagacccctgtggcatctggcaccctaccctctcagacagggcctgggcagcttttcccaggatccctgcctccccaggcgcacctaagacctgagtctcttcctccctccccaagactcacacatgccacctgctctgttcgaccccccaccccacccgggggagctcccagaccactccccaggaggtttgggatccccatgcttcccttgatagtgggaatgggctgaggggccacaggagataacaagttgctttctggatggcctccagccaggggctctggggtcaggaggtggggtgggggttggggaggggcctttctcccttaactgcttggtaactaatggggttccctttctgcctgtttgactagggcctaggaggcgctcctgcccttgctgcccccaactccattctgaacagtcttgcaaatgagcacagcctgagccagagagagcccctgcggcagaagcagcccaaggggaacaggtgaccttggcctgtgtgcccagcctcccaggtccagctgcgtgcggccgggcagctgaggatgttgggagcacctgcttgcagggctctgggggcagccccagaaggggttttccaggaggggaagatttcatgttgagtgggagccatttctctggcctggccctctggccccaggatggctactggagggatcattgccctggagtgccagagaagtgtggaaaatcccaggcatcccccaaagccctggcccggcccacccagaggaccccttaagaggagtgatcttactcagggtagtgcctgacgagaagcctcagggaggggaagtctcctttggctgcagcgtagtggataggcagggcgcccatgtctgtggccgcggtgggatccccaccgccatgatgcaagagccagttcaccaccttggggtggccaaagcgggcagtcagatgcaagactgtgggaccagaattgtctttgtcctgtgggaggagagcgggttcaagtcctaaagcctgttgctgccccgcccctggcttgggccgctcccagactcccacaggcctggaaggtagctctgtgctctctgtcttccctggaagaattggccaggcctcactcagcagtggtttttttgggtcaagcggatcctgggtttgaatcctgcttctgtccttgggcaactaattggccctctctgaaccgtacgtagccaataggcagcaccgtgcagggttttcagaggctgcaggtcctgactgcgagctgcctacacgacaggcacctggttgtcatggcaggagactggctccaggcccagggccacagccctgactcccaggggctcagggaatgcctgaaggagtgacacagggttactgggctgagcagggccaggaagggtggctgtggggctgtaccaagctagcatcaggattggggggcagcccctgcatccaacacttgccccctctctctccacccttcctaggtgtcacgtgggaacagagacctccaccttggtgcgcctccagcaacccaacctcagtgccttagtcaggcaataagggccctggggactggtttgggtaggaaggacacaccaaatgagcaggaggaatttccccatagaggcgaagagaatccagagatggtgagggagaaaagcacataagaaattaaaaacaaatgcaaacaaacaaggttgaaacagggctggagggtgtgaatgtggtgattcttctcttcctgaggagacagggtcctgcgagttttgtcacaagtcaggaagctccatcagctctgcaacacctgagtcctggatggcgggagatgatggcttaagatatctgggcgcaaagcctgaggccctgcctgtaactccgactccctcaagggcagctgagagggaggactcagggcactggggaaagtcagcagacccagtcacagaattagaataaggtggagctacgcagggaagacaacaccaactatttcctttttcttattttattttattttatttatttattttttttgagatggagtctcgctctgtcgcccaggctggagtgaagtggtgcgatctcggctcactgcaagctccacctcctgggttcacgcctttctcctgcctcagcctcccgagtggctgggactacaggcacctgccaccgcgcctggataatttttttatttttgtatttttagtagagacggggtttcaccatgttagccaggatggtctcgatctcctgacctcatgatctgcccacctcagcctcccaaagtgctgagatcacaggcgtgagccaccgtgccctgccaacaccaactatttcattggcagtagaagaatcacactctgcagctactgagaggtggaggtgaagccaccctgccgagcagccaacctcactttttggttattatccttgtgccgatgctgccggacaaactctctctacaaatctcagcatgtggaagaaacagaggcaggaacaattgcccagcacctttctatttctcgaggacactcttgaagttattcatcaatgttttaattaaagcagatcttatcgcttttcctcaaatgggaacttgttcacttttagactttgttattgttcattttgggcttatctttggtcttttcctgtgctcttaaaagggtgcaaatcaaaatctgagttatgataatccacttatcatatgactaattacttcagtacaaggagttcctgcctgtctgtccaatatgaatcttactacgtcccaatgtcacattggcttcttttccttctcggtggcagcatttggagcttttacttaacttagggtcaatttcgacctctgaattttccacccctcccccacagctgttgctgggtcatgctgttttcttttatctctataaatattgtgacttgtaattgtcacttataaattcattctggctatactgaatcattcccccattatccaagtcatccaaatattcgatgtgcatttccacaaatcatgtagtggccccctgattggggatgatttgtagaattaattatatgctttagatctccattcaggtcttcaggtcaccaatacattaagcagagcagggccctgaacagcttatatggatcaacgattgacagagctgtcggggttgctgcaaagccactgactttttgctgttccccgtaacaaagtatgttcaaatctaggtcacaggtttgtggtagggtcgattcacagtatacatgtgcaacggcgttcagtagcatagcagttgaggttgtgaagacatgtgcacccaggtcaaagaagaaagatccttagacaaagccgctcaattcccaggcacccaatcttccttgggctttgtgaacctgagatttgacaggctcttgggaatgtctgtctctaagactctgttggcaggcttaatcaggctggtggccatctccatatgtgcccccccagcatttgtgacaaaataagggaagggggacccaataaagctacttctgaaagcttatgatcccacccctcatttaaactatgtgatgttgtcattctatataaactctttccaagtaacttaactaaaacacactttgccattagtcttgagtgtgggcacagcattattcttttctaggccttaagggttccttctgcttaaaaataatgtctaactttcatgaagtttacccatgattaaagtgccttctgaatatatattatcttgttctattggtttcaatatacctattttctttaaaaagaaaaaaatgatgaaccatgagtgttaacaccagaaaaaccttaaggtacatctgatctaatttcccactttaaagtgagaaaatcaaacagtgcctaggggtttgatttttccccaggctaattcgggttttcatatttccatctcaaagtggactttctttggctaactttaagttttaaacgtaaaggcctgaaaagtaactcaggatctagctttttcattagttttgatcgtgtatgaaagcaaatatttctttcccccaaatgaaaccccagggcttccagtatttgtagtgatagtgtgaatccattaggtctatttttaattatatctctcttattggttatttttttcacatttcctaactcatttgtgatattgcttccatataattcaactttttgtgcgctgggttcccatttgccccacaaaggcctatgtgcaaatctgatatcctgtttgaatgacattgttttgtttttaccttattgcttcctatctttcacaacaatgttgtcagttctcaacattaaggcattaaaaattagcttttctcaaatgctcagcatcattaatcattagggaaatgcaaattaaaaccataatgaatatcatctcacacctgttagagtggcatttgtcaaaaaggtgaatgatgtgttagacataatgcagagaaaagggaacacacacattgtgaataggtatgtaaattagtacagctggtgtggaaaacagtatggagtttcctcaaaaaactaaaaatagaatctaccctatgatccaggaaccctatttctgggtacatatccaagagaagcttcagagagtgctttgttgggttttctggaacccggcagggctcaggtgtgtggggatgcgctctgtgagcctgtgtttcctccgccgtgagggctcctcccgctcctgtaggaaaaggcagtgcccattttgtcttgtccatgtgggactccaaagggtccagacgcgacagaaaggcggcgaatcctctcagagtgggcaggggaggagatgatagaatatggggaggagatagaatatgggaatggggcagtagaggggtgggatttcatgaaatttcctgattcaaggctatcatgaagtaggcctctttgggagctcggccctccagtcgctggtgagggtaacatcccaccagtctctggtgaggtccagtcgcctccgccgactgcattgaaagccaaaagcagaactaggccagcaccgcggcctggcgtccagtgacccagcggtctgcatattccccagggtggaagcactcggacttcaggtttgaaggcaatgcggtcaccactgcaataagaaaagcaactagggaaaatggcaccttcttctccaaacttttgagacactcttgctctgtcgtccaggctggagtgcagtggcacgatctcggctcactgcgacctctgcctcccgggttcaagcgattctcctgcctcggcctcccaagaagctaatttttggcatagagagagagaggggggaagggggggggagagagattgattttaatgtcttcaagcaaaaagagactctttctgcctgttggccatctgctgccaggtgaacgtgaaaatccatcgagacgctttctgtgaaaaccgcctttatctctttgtccctcttaggttaaaatccgcactccaaaaccttattgaacagaaaaattacaaaaagcacatataagacgtttcagttttgtaaagggtaaaatgaaactgcccttcaggaagaatcagaagaccgacgagggagagaggagcgatcgtgaaatctaagtgggctgcccccgggtcttccagggttttgtactcggtggcttggcctgagttgatgtgcccatattttcaaacagccaagtgccctgagacacagcctttgctacggtacctgctgaaatctggaagtgtgattaactattacttaaattgagtggggcagactaagagacagcagcagtgaaggatgccctttgggagaaagacgtcgaggcgctgaggccaaagggtccgtgaggaaagagcccgcagctcgcgcccctcggcctgcggaagggagggcaaggagggtcctacggttcctgggaggacgcgaagagccaagagctctgacagctggcgccggggaaaaggccccgaggcggggtccgcatccctggaagggcggcgtccacactcctgcgaggcacggggcgcccggggctcggaagctcaaagcccgccggcttctgcagcttctggagcttctgggagccaagagtgtcagccggaaggatcccgcacacggcgcttagttctggaactggatacccgggggaggatgcgggatcccgaagcccgggtgtgggtccccgtggtcttcgtgttgggggtaggtgcggaacgctaagcctgggcctactgggagccatagtcttcttgatggctggtgcttattgggcttttttcagtcgaatttcaaaatgcagttgaatttcttactttggaaacgataatagaaatggctgacctcagattttcatgattatgttttgccttttccagtgtatgtgcagtttctgtagtatagtggttatcatgtttgcctcacatgtgaaagacccttggctcgagactggagggaaacatggttttttggtttttctttttgtccctaaatttagtgagtttaatcgaggttgggaaacaaacagaaaagtagttgaacctgtggctacactttagacctcctcaatctagacagattgttgaccaggctacagtttccactggtctgccagcaagaggcctgcttaatgttagctttggttccagaaattccttaagattctcttcattctcttctgtcgcctgaattttcataggctgacactgaaagtggatgacatcttaatgcatttcctaagtgtcccgctgggcttcgctttactctgataagttgcagatctggctgatttgcgagacaaaaacaaaatatttttttaaaagattctaaatctgcatctggaacttgtagagtcaataatctgaaaccacacgaattatctacatacaaaagattttgaatgcataccccttccccaaataatcctcagaaaaccggttaagttttagcatctatgactctgagatgcatatgaggcctttgtaaatttagaagttgagagtagaaagtacaggtttgtattttagaaggagatttgggaataaatatagctctggtggatatagatcatatgttaaggtttgttggccagagctggtgtgtgtcttgggtgttgggcaaagaacagagaacagccaaagctctgcgaggtcaatgtgaagggtgatttccttggtgggctcaagtttatgacgcagcctggacctagcttggcttctcagctagagaagaagcatgattccatgtcacagctcctgtctttgaaaaagtcataatgactcccagacccaacatgtggggaaaactctggatttgtctcttcagttgaatgtctccgttgaaaattgaggaaagaaatctctctactatttgaacttcatcaaaagactaatatgttaatattttgaccgtcaatatttccttaaactagtctactcctttcatagctaatacatcaaagcatattaacttaggaaatgggattctcccaaacaaggaaacattgacggcaagggttcttaatcttttcacaccacatttccttcaaatgctttatacatcttcaagcagacaaataatagtattataatgattacgagaccgatcattactcttttgccaaaaaaaccagcgacaaaagactaacttagtggaccaacctttgtttcttcattatctgtacattgattctgtccttttatttcgtctttcttctaattctgcttctgcttcttgtttcctccctggatttgaactttatttacctaaactaccagttaggttaccttctcagaacctctaaggcagcagtttgagattgacaatggaagatttaagattagaaaaaagaaacatgaatgaatttctgatgttttattataggggtttataatgcaggtagaaagacctttttcagacttaagagtttgatccaccaaatgagctattttgatatttataactttgtctagtaaaagtttcctataaaaacatttggtttggatatgtttgttagcttttagtcgacacttgaaaaaggcggttggaaggttctaagtctttttggatactcttttctcttatcccccaggccgtgggtgtgtagaggccttggtggtgcagtggtagaattctcgcctcccacgtgggagacccgggttcaattcccggccaatgcagcaggtacttcttcatttcattatggccttttacccgtcttttacgctgcaaaattatactgcataacctaatagtgcatttaggggcttggccaccacaaggtaaagtgacaacattactcacgagagtagcggcaagagacattcaggacactaacccaggacccatgcaattgttggactcaaacagcttagcaaagtggcaagcacgaagtctttccggtgagtcactgcagttttgatattggtacctgttactttcatctattcacggggcggatccctgcaaacccgaagaatcatcaggttcctgattcgcgtgctggaccttgggcttactgctgagccactgtagagaggatcaagaaatgacgctcttggaaggagagaagctgcgggcaggacagtcacgtcagaggtccaagaggcttcagcggcccaaagaaagggaaggtgtgtggggaagaatctgcgtggagatgaggggagcggcggggactggtccttgcgcagaggtggccagtggaccctcagggctgtaccccagacaccgtgaaccgaatttgctcacatcgtcagcggccgcggcctccgcgtgctttgtgggcccatcggtgttctgcgagggattccgtgtgtctggcaatgtctgtcaacaggtgttggcctgaaatttggccgggcacgttggctcatgcctgtaatcccagcactgtgtgaggccgaggcggatggatcgcttgaggtcaagagttcaagaccagcctggctaacatggaaaaatcccgtctctactaaaaatacaaaaattagccgaatgtggtggcatgcacctgctattccggctacttgggaggctgaggcaggagaatcgcttgaacccaggaggcagaggttgcagtgagccaagattgcgctactgcactccacctgggcgacagagcgagactgcgtcaaaaaaaaaaaaaaaaagcagcgaaagaaggcagagatgtcaatgggacaaagagacctcccaggaggcttgttgtagaggcagtgggtggatcctgggagatgagatttttttaaaattatgtagcagaatggggagagaaacggagaagcgcatgaaagagagaaaagcacgaaaatcggcggcgtccaagaataaagcagataaaatagtgtgagtgtttttacattcaaaaaatagaagaagtgcaatgcttgtcagcaggctttgtggtcgtgtagtggttaatacttgtagttgtggttgccacaacctgggttctaatctgagtcacagtagtgttttctagcctgcgattgtggctaatagacctgtcgtttgctttgcctttaatcctagcagcctccagagagcagagtaaacctctggccccgaagggcgccagcttctggagtttagcccacagcgcagaaactagggggcggcctggccgataggaaaacttggacatgctctttgtctcacaattgagcaggaaaaattcccgtaggtgaagatgccgcctctcaagggccctttgtctgtagcttccactggtgaaataatgcggttatagtctttttcggtagagaaaacggctgtatcagtggaattttttaaaaacacaaaacgagaacgagtttttaatgagctgacaataaaatctaaactagttgtcatggtctgcacaggcttgcctccattccccatctgctaatttttatgagaacagtaaattattactattatcattatttttgagacgtagtcttgttctgtcacccaggctggagtgccgtggctcaatctcggctcactgcaacctgtgtctccgaggttcaagcaatgagaacagtaaagaagctacagttcacataaagtgcacaaatctttagtgcaatttgtttagttttgatcaatgttatcaccacccagctcaagttatagaaaattgccatcatctgagaaaggcctgttagagcccctgtccaggtgattcccaccctgtgtcctcttagttatcactattctgatgtctattcccacaggttacaattgcctgttcttaaagttcacatgagtgaatgtacatatgttttgtgtctggcctttttctccagttacattcattatactcatgagatatatccacgtagtttcatagatcacttctcaattttggggttattgatttcttgtgctgaatattcttataacagtctttgtgtgcacttgagattcatggaagtccttcaattgctgggtcatgacctgagtataagtttaacatcagtataaattgccagtcttctagaatgctttttcgccagcgatgacagttgaagtggcaccaaattcttgtcagcatttggtgtactaactttgttaaatgtagctatgctctcagaccaggctggccaacatggcaaaaccctgtctctactcaaaatacaaaaattagctgggcatggtggcatgcacctgtagtcccagctactccggagggggatgttgcagtgagtcaagatcgcaccattgcactccagcttgcgtgacagaatgagaccctgtctcagaaaaaaaaaaaaagtagccatacactggtgagtggttagtgctatctcagtgtggaattaatttgtatttgcctaatgagcaatcctatgaagcatattttcttatggcttccagcatataagaaactctcctttgcaaaggcctattcgaatattttgccctattttatttggcttagctctatattactgacttacaaaagttctcttatatattcaagaattgagtcttgttttgacgttttttaaattatactttaagttttaaggtacatgtgcacaacgtgcaggtttgttacatatgtatacatgtgccatgttggtgtgctgcacccattaactcgtcatttacattaggtatatctcctgatgctatccctccccctccccccaccccacaacagtccccggtgtgtgatgttccccttcctgtgtccaagtgttctcattgttgaattcccacctatgagtgagaacatgcggtgtttggttttttgtccttgcgatagtttgctgagaatgatggtttccagcttcatccctgtccctacaaaggacatgaactcatcattttttatggttgcatagtattccatggtgtatatgtgccacattttcttaatccagtctatcattgtgggacatttgggttggttccaagtctatgctattgtgaatagtgccgcaataaacatacgtgtgcatgtgtctttatagcagcctgatttataatcctttgagtatatacccagtaatgggatggctgggtcaaatggtatttctagttctagatccctgaggaatcaccatactgacttccacaatggttgaactagtttacagtcccaccaacagtgtaaaagtgttcctatttctccacatcctccccaacacctgttgcttcctgactttttaatgatcaccattctaacaggtgtgagatggtatctcactgtggttttgatttgcatttccctgatggccactgatgatgaggattttttcatgtatcttttggctgcataaatgtcttcttttgagaagtgtctgttcatacccttcgcccacttgttgatggggttgtttgttcttttcttgtaaatttgtttgagttctttgtagattctgatgaaactacagatgagtagattgcaaaaattttctcccattctgtaggttgcctgttcactctaatgacagtttcttttgctgtgcagaagcccttaagtttaattagatcccatttgtcaattttggcttttgttgccattgctttcggtgttttagacatgaagtacttgcccatgcctatgtcctgaatggtattgcctaggttttcttctaggctttttatggttttaggtctgacatttaagtctttaatccatcttgaattaatttttgtataaggtgtaaggaaaggatccagtttcagctttcaacatatggctagccagttttcccagcaccatttattaaatagggaatcctttccccatttcttgtttttgtcaggtttgtcaaagatcagatagttgtagatgtgtggcattatttctgagggctctgttctcctccattggtctatatctctgttttggtaccagtaccatgctgttttggttactgtagccttgtagtatagtttgaagtcaggtagcgtgatgcctccagctttgttcttttggcttaggattgacatggcaatgcgggctcttttttggttccatatgaactttaaagtagttttttccaattctgtgaagaaagtcattggtagcttgatggggatggcatggaatctataaattaccttgggcagtatgaccattttcccgatagtgattcttcctacccatgagcgtggaatgttcttccatttgtttgtatcctgttttattttgttgagcagtgttttgtagttctccttgaagaggtccttcacatcccttgtaagttggattcctaggtattttattctctttgaagcaattgtgaatgggagttccctcatgatttggctctctgtttgtctgttattggtgtataagaatgcttgtgatctttgcacaagaattctgtatgctgaggagtcatttttaaaataaatatattgcaaatgacttttcccagtcagtgaaaagtctgactgaaagctgtcaactgaaaaatcacacaatttataaatttagaagggagattttattttttataaatggttacagcctgcaaggtggccattctgacagacagggaggcataccctcttgctgctgaaacctgaaaagtacgtttccagggaggggaggggggaacagggatttatgttgatgtggtgggccacatatacatattcaacagggaataggaggagctctgaatattcatgaagggatcctgctgcatgcatgctgagtaaacatgcctgttacatgcaacccatgttcattttggggtggagacaacatttaaatacattataattaggccctatgcttcaaaaggggaagcagggacacaaaggcagtcaagtgcacagcctctgtaaaccgtccagaacccgtccacagccagtgctctcttatcaaggggaagttactgaaatcagtctcttgtccaatcaaagctgtagttatggcttgtgtagggagggctcagtcagtttatggtaatgggtgagctgcaagtgcttcagcattgcttatctcaaggccagtgcttgtttagctagagaaaaaaaggaagaagaaaaaaacctgtggcaattggaacatagtttattctttaagttgaggggcgcatgactccaccttgcctggcgtggccttaggtctcgtttatcataccatatcttactactgcaaggagtctgttctgtcagtcttaggatctctattttaacaataatgctggtcagttgtgtctaaaccacaaagggagagagtataaggagaggtgtctgagattccaactactgggcaggaactcagtagttaagacttctctggggtctccttggccaagaaacagtctgtccagttggttgagtggctttggattttaattttagttctcaaagcatttaatttgatgaaattttgccatattttttctttatttttaaagcctgttatgttctataagaaatctttctactcaggatagtgaatgtattctcttaattttatctctctatgagttccagcgttttagttttaatttttaaattgatgacatctaaaattctactcctaaccaaaacattcctgggggtgaccaaggacaactccaaaaatcttccataaatggaagtaagacttactccttgaagaacttactgggatctgggcctgcagggcacagtggctttagtgcacctctgctcttacgactattcagaaattgtctttgtgaacccatcaggctgtttcaaaatcagcaatttagggcttgcttgcaacatgcagttatgcagcagctgttttgtggatctggtgagtgcctgcacgcatagttccccgggaattttctgaatttgaattctcatggtatttcaagtggctcagttgtctctttcttttcttttcttttcttttcttttctttttttttttttgagtcagagtcttgctctgtcacccaggctggagtgcagtggctggagtgcagtggcgcgatctcagatcactgcaagctccgcctcccgggttcacgccattctcctgcctctgcctccccagtagctgggactacaggcacccgccaccacgcccggctacttttttgtatttttagtagagacgaggttttaccgtggtcttcatctgacctcgtgatccgcccgcctcggtctcccaaagtgttgggattacaggcgtgagccaccgcgcccggccagttgtctctttcttttgcctactgccacacacgtaccaccaaatcctgcactccaagctgcttctacaccctggactcccaacctccagttagacaatccacatcttcccacacctgcctcaggctccatcaggctactgtgcctcctgcagcaaccaggccagggggaatctggattcctattacacttctgaggaaggtggtcagggagtgtggaggatgtgggtgggagggggtgaggttgagggcaggagtacactgtggtcttctgtcttctacctcattggcccaggtgctgctctccctccggttgtctgctttcagccctgcctgggaaatcaggccggcgccctgatcttcctgactctcattttgtgaggaacctgaacggatgagccatcgctcttgtcccacacgttctgtccaaaaggtgccctcctctctgcttgctcgggggcctgccctctgagctctggcactcaggctgggatgccgcccagtacagaggctctgcagccctgcaggggtctgactgttccacaccagcaggataaaggccacagggcatgctgtggtggaaaagcattcagaggtgtgggctgaaggcctctctttccacagtccctttgaagacaccatggaagtaggcacccccttgacagacaaggtggcccaaggcctggcttcacatgcaggctcttgggtcccagcgggtcctctctgtgcctggtatagccaactgcttcacgcatcttacccggtttcctctcctccacaacccaagctcctcctcgacccccttgctcagctgtcctcaggacagcaagatccccagcccttggaaaagcccatctctagtgcttggggagggagttgggttcaggtggtctaaccacagaagaacagagaacctgaggcaggaggaaatcccttcccttgctgggtctcttggcacagcccatccaggggtctgggtcagggtccaggtatactctaccctccttgaggacctgggttttcaggcccccgaggttggtcaatgtggagtctttcccactgttcatctgggaactgaaggaatatcccatggggccctctcttactcattagagacacccagaaaatactccatccagcagaaactgggtgcagtgtaccagaccactataattataattgcaggatgtggaggtcagatacgttttgtgggtattttctctctgtctgtggcttgcttgccttttcgctttcttagtggtatcttttgatgagaaggtgtggctaatgttgatgaagtctcatttatcatgtctttcttatatatgtattttttctgtgtcctgcttgttggtaggctaatctttgcctgccaacaagtcacaaagtatccttgaaatgctttatatctttaacttttaagttttggtgtgtaatgcggctgaaattacttttgtgtgtaacgtgagggagaataacattgttggtctccccacatccatatagaagttcattaattgaaatgatttattttcttttattgaactgcttttactgaaaacccatttattgaccgtatagctgtggatcaatttcaggttttctaactcaggctgtttatccgtttgtcactcttgatgccttgtgtctaatagcttatagtaaaccttaaagtcagatagtacaagtccttgttcttttccacacattgcaataaattttgaaatagataataactcatgaaaccatcacacacatcaggatatgctgtcacttcatccctttctgacatggtttggccgtgccctcacccaaatctcaacttgaattgtatctcccagaattcccatgtgttgtgggagggacttaggaggaggtaattgaatcatgggggcgggtctttcctgtgctattctcctgatagccagtaagtctcactatctgatgggtttctcaggggtttctgctttggcttcttcctcattttctcttgctgctgccttgtaagaagtgccttttgcctcccgccatgattctgaggcctccccagtcatatggaaatgtaagtccaattaaacctctttttggtcctggactctgttatgtatttgtcagcagcatgaaaacggactaatacactctcatttctgagtgggacacatgctgtcactcacatatgctggttgctgacttgtgacggaagattctctattgtaccctctggggacaatacatctccagttgcctgcggggaggatgaaccctcaagagtcaatgtgttgactgactctaaatatgggttcctggtgctccatgctcatgcagccatagggaaggaaaggggactatcaagagccaagggatcccccatacgactttactcagatcttggaacttttagatgctgtccaactcccaaagaaataacaattactcactgcaggggacaccagaagggagacacttttattattagaggaaattccctggtggaaagagcagctaaggccacaactaaggaaaccctggtatttcaagctgctgcgctactaccaggtactgcatccgtgtcagtgacaccatactatacccctaaggaaattaaagggactgagtaaaaggcttccagggagacccctctggatggttgctacaaaagaacaaactctattcctgaggctgacagatgggaaataattaaacattttcatgattcctcacatttgggacgggattttccattcaaattagtttcctaaatattcttcgggaagggactgttctaaactataaaaagggttaccactcaggaagccaccccataccccgatccctgcttaaacctgtacaacaccaaggaacataccatggtgaagactggcagacagacttaacccagatgccaccttacagggaactacaagatttgctagtatttatagacactttcaccaggtggatagaagctttccccacaaggacaggaaaagtactggaagtgtctaaattcttaaagaaatcattccaagatttggattaccaaaaggtttgcaaggtgacaactgacctcacttcacagctaaggtgacccagtgaggtcatgcctcagccttaggcattacctgtcttcattcctcatggagatctcagtcttcaaataacatagaaagccaatcgcgacattagcaaaactctttcagtttgggggcttgcctgccctgcgtcactatcattgtttccttgggtttcccaggaatgtacatgtgtgagactgccgccctgcttatagatctgtttccctgcaaggaaacaggaatatgttgcctgtggcttccagagttggagatacatgtagttgcaccactgagggctaacatttaattttggaatcaagtgatgcattcagactggttgctatcattctgtggtatatatttagtgaacacattcatgattgagtttcttgcttttagctggagcaagaaagttttataattgtgatttgtatgaaaaaatcataggcaagggaatggatgtaaaataaactttattgtcagaggtttctaaaggctcatccttcaaggaaaatggacatatgctgaagagctgataaactgtctacagcagtgttattctaacctaatcttgattccaagttcttgccattttcctccagctactgttgactccagttatatataggatgggggaaaggggattatctacgaatgtaggcatcactttctcttgggcagttatcacattggcagactgaagggaagtgatttctacaatcaaactatccatttggagtacaaatctggagtggctgtaaaattcggttctcagagatgaacttgcagattcggactttcaattgttctgttgttttagtttttctcatcaactggggaactgtttgtgactaagctttgttaaaagtagagaagagcttttcataattccaacattagttgttacctgaaacaaacaaaaacacacacagagacaattaaacagtaatctttggtgaggtcttgctgatacctgaggctggagtgagagctgagtggtgatacagctcatgtgcgtgatccagattgcgcactccttatgagactgtaactgatgcctgatgacctgaagtggaacagtttcatatggaaaacatccaccacccccttccatggaaaaattgtcttccatgaaaccagtccctggtgacaaaaaggttgaggacagccaaaaaggctgctttaaatgataaccttccccaaaactaaattacccctgtaaaatgaatgaaaggccaccaagttagaaggatgaaaggggcctgatttctactaagatgtatgcctcgttaaataattaccagccattattccagaagtcacaagattggcagcttccccaattactgctgtgaagaacatcactattgtagaacctaagattggcctcttgagatgtcttttcaggcttttgcatttctgactgctggaaggcaccatctggcccgaaaatcaaccagtcccttagcccccacccagaagctgactccatgcaggagggccattttccacgcccctgtgatttcatccccaacaatcagcaccacgcaagccctagccccctccccaccaaactatctttgaaaaaccccttacctccaagccttcagtgagattgctttgagtaataactctgtctcccacatgtcgtggctggcctgtgtcaatgaaaccgtttcctgcagtgccatggtctccatgaattgagtttttgtgtacattggtcaggaagaacccatcaggcggttacatctgcaggatggtgccagttctttccacaaaggctggtcagatacccagaaaacatttctccactactacctggacaatgtgtctccctgtcaatctccagggaatggggcctggatcaagtatttagtattcagcagttactacactgtcacctaatccctcattttcaatattttgccatgcttccagtggcctaactggccaccatgccacagaatctttactttatgatctccaaggagaactctccactcgatgttttgtgatttgagcaatggaatagaatctgatactggtgggctgggggaggtccctggacactggtgggatctcgaccccagccgtggtgtccaggctcttgacaccatcgtgagaacaaagtcaaagatgagtcagcagatagtgaaagaagagatttattgcaaagcaaaaagtacacactcaagaaaggggagcttgggcatacccaagagagaataatgggttctggggtttcatcttgatgggtttctttaaccaagaattggaatattcacgaaaattcctgggtaaaggtggagatttcttggaactgtggtgccatttttacatcaaacactggtctcagaactgtcatggcactggcgggtgtgtgatttagtatgttaatgagcatataatgagggcctaggtaaaacctccatccaatccagcaccacgttgggtccactcagccttagccagcttggtccacaccctggtttttcagcgtcttaacagcccacagcctcaagtcatgtaaatctgctgcctagaatttgttatcctgtgaccaccctgtagtattcctgtctgaaatctacttgtaaatattcaaatggtctttcacttgggcattccaactttgcttacttcacagtgtttcctgcgtaatatataagaaaagatgatccagacatttgttaaacatctcaaataagatgtagcccaggtatttgtgtcaaatttggattattttggtttcgtctttgcagaatataaaaaactaacatgaggtaagcactaaggtgtggagatggctgtgcaagagatgacaaagtccagcaccacgcttgagagtgtccaatcatctcttctgggacagcatatttttctacaatacggatttttgaaaaaaaaaacaacatcaaaaaaaaaaaaacctacaagattcatgaaactggacaactgtctttataacattaccagtgataaaaccagtaaggacggctggtttgcagtcatctaagcagcctctttactttcataaatatggtttctctctgatattaaacggcttccaattgcaagcggaatgctgcatcacaaggataaggatgtgaagagaaccggtttcttttgtaatccgaaacattctagtctgcgaattaaaagccattatttgaagaaggatgccccggctccatctggccaccgaaaggttgctccttaacacaggctaaggaccagcttctttgggagagaacagacgcaggggcgggagggaaaaagggagaggcagacgtcacttccccttggcggctctggcagcagattggtcggttgagtggcagaaaggcagacggggactgggcaaggcactgtcggtgacatcacggacagggcgacttctatgtagatgaggcagcgcagaggctgctgcttcgccacttgctgcttcgccacgaaggagttcccgtgccctgggagcgggttcaggaccgcggatcggaagtgagaatcccagctgtgtgtcagggctggaaagggctcgggagtgcgcggggcaagtgaccgtgtgtgtaaagagtgaggcgtatgaggctgtgtcggggcagagcccgaagatctcatacttacctggcaggggagataccatgatcacgaaggtggttttcccagggcgaggcttatccattgcactccggatgtgctgacccctgcgatttccccaaatgtgggaaactcgactgcataatttgtggtagtgggggactgcgttcgcgctttcccctgactttctggagtttcaaaaacagaccgtacgccaagggtcatgtcttttttcgtattggtttgtgtcttagttgttaatcctacagtggaggcctggggaataagaagtaacatgtggcctgcacgccataggagaaaaagcgagcatcagccgtatcggctttgtaacacaaattagctatcgtgaagtccgctcagctcttccatttctaccctggctgctttttgcagggattggtccgtggtctccagtctcttgggttctcaccctgtgtgaaaatcttcgtgtttttccctaccccccaagtcacctcttacacagcctctgcttccaagcgcagcccccacaggagtttgtaggatttctgtgctagcggggagtgtgttctcacctcatagagccaggtagaaattatgcagatgggcgctgttctctgggaagaaagcagggcctttggggctctcagtgtccccgttgggttgtagacataacactcttactttgcgtaggggaacggctctgccggcccccaggtgccctagcgcatatgcatggaggcccgcaggtcagaaccgcagtctcacctgtcttggcggaaatgccctgcgatcctcccggagatagaaggcgggaagttttatgaggagccggtccagtttccctactatctcctgcagttcatatatctagtgtttctttagactttaagcgactgcttcatgtttgatgtctcactcccacatcctacatccactgccagccaactttatagatagcaccgtgacccatccttcccacccccaagaagccctttcctatttctggtgccagtgtcctccccagtccctctttcttcaggccctcgcttatcaccttcatggacagaaaatacttagctctctctcaacctgaggtttacacctgacacgcatcagtgccctggcaaattccttaataccccttctcaaatggcactgtaaatcatctctttttaactcccagaactatctaattggttttgtccctgcactacatgaacactagtattccactacagaggaaaaccccaggcctagcgatagcggttctgggcattgtgccagcctctcccagggtatgttttctgacctcacctacttttgatcagctgaggtcaggagttcaagaccagcctgaccaacatggcaaaactccgtctctactaaaaacacatacacacgcacaataataataataatgataataataataattgccgggcgcagtggtgtgtgtctgtaatcccaactactcgggaggctgaggcaggagaatcgcttgaacccgggaggtggaggttactgtgagccgagatcgcgccattgcaccgcagcctgggcaacagagtaagactctgtctcaaaaagagaaaaaaaattagtgcatctgagacatattattggagacagtagaatcctgcgtccaacaggcacttggtgcagatctgaacccattgagctattggctcatgttccctatgttctattaagtatcatgagcagaaattgagctctttggcttttacccactgagtatggctataggacaggtctctctctctctctctctctctctctctctctctctttctctctcattctttgcatcattattttttgccatcagtgtgggtttttggttttgaggttatgaagtgaatttctggggacaatctctgttgggtcgtgttaacaaggatccagtccctgtttggtgatacatgacagctaatctggtctgtgagtcttctttattgtctatttattgtcctgagaataatggcatttcctgatatttgagactgcagcaatgataagttgttcagatcttgtctttccaatgtttggtaaacattttataggcccaatttttgtcaatatctgcaagagtggcatctctgttacaagagtgatcttactactcgatgtcccccctcccacccaacttcatttcctaggggctcttggctttaacgaatttactgtatctaaaagacatcttagtacaggaagaaaactaaatctgtagcatgtaaggagcagttttatttgattggtatattcaggtttctaaccagctgaaaaattcaaatacatgccctttaaggattaagtttaaaccacactacagaaagagaaaagatttatatgatcacatataagcaatggaatcagcaatatgagtacttttcacaactatacaaatcaaatttaataatctccagaacattaaggaagttcagcccttaatggaaatgaatgaaaagaaattattcacccactgttacatgccctggaaagagaatgtcctgccagactcaaaagagtatcacaatattactcagattttcagcaatgaaggccctccgaggatctaatgatgttcatattttcagtttatttccttcactgataaacattgttaatagataccattgcctctgtttgcactttaagtgatgttacttagaacaattcgtttctttagcatgcaccctagtttggtggaaggaattttccttcttttcaaatataggatattttctcatgaaacaaattggcatactctttcagtgaagtgaatagacaaattagatctctacaattgtaaaggagtcactgccccaattatcttaggaacaataataatcacttatataaaattaaaataagaaaattaagccaggtatggtggctcatagctacagtcccagcactttaagagttggagaccagcctgggcaacacagtgaaacccctgtctctacaaatttttaagtattagctaattttttaaagttggccgggcatgataatgcatgactgtaatctcaggctgcagtgaactatgattgtgccactgccctccagcctgagtgacagaatgagactcccaactcaaaaaaaaaaaaaaggaaagaaaattaagaatttgttgaaaattgttttactacaatgctaggctgcatgtcttgcacctgtactcccagcaactcaacaggctgaggcggaaggattgctttaggccagcagttggagaccagcctggggaacagggcatgacatcatctctaaaaaaatacaaggcaagctgagccaggaggattgcctgagcccagaagttccaagttggtcagctatgattgccccactgcactctagcctggataacagagcaagaccctgtgccttatttttaaatttatgttatttttttactacttatgcttatttatctatttatttatttttgagacagagtcttgctctgtagcccaggctagagtgcagtggtgccatctcagctcactgcaagctctgcctcccaggttgaagctatttccctgcctcagcctccagagtagctgggattataggcacacgccaccacgcccagctaatttttatatgtttagtagagacagggtttcatcatgtttgccaggctagtctcaaactcctgacctcaagtgatacacctgtctcggcctcccaaagtgctgggattacaggtgtgagccaactcgcccaggctccttatgcttgaaatgtgaggtttcattagggaaaaattttcttgttgaatttctaacatgaaaaaataatagatttagctgtagattaaattaatggtcctggtagtttggtacaataaaataaatgaagttgatagcagagaggaatctttgatgcttttgaacaatttaaataatgtaatattttttatataaagacatgaaaaagttcattacattattattatatttatttatttatttatttattttgagatgtagtctcactctgtcgcctaagctagagtgcagtggtgcaatctcggctcactgcaaccactgcttcccgggttcaagcaattctcctgtctcagcctcctgagtagctgggattacaggcacacaccaccacacttggctaatttttgtatttttagtagacacggggtttcaccatgttggtcaggctgtcttgaactcctgacctcatgatcctcctgctatggcttcccaaagcgctggggttacaggcataggccactgcacctggcccattacattattttttaaaaatcagtgtgactcttttgacaaattagaatggtttaataatcttggttaggctgggcatggtggctcatgcctgtagtccaagcactttgggagcccgaggtcaggagtttgagaccagcctggccaacatggtgaaaccctgtctctactaaaaatacaaaaattagccgggcatggtggggggctcctgtaatcccagctactcagaaggctgaggcaggagaattgcttgaactcaggaggcagaggtcgcagtgagccaagatcacgccattgcactccagcctgggggggcaacagagtgagactctgtctcaaaaaaatcataaataaataaaaataaagtataaaaaattaaaattacgtgttcaaatacattaaatatatggcaatgaaaaggaggcctagcatgactgactgcattttgctcctaacccttcctaccgtgtggtgacatcttccaggctaactgctttttcttatttctgcacataggccaagctatctatgggagggatttagcttacagtttaactttaaagcacagatgataataatcccttccccaaactaactcctgagaagatagagaggttgtatacacaagtaacagtgttatgctgaagatttataagagaagtgtgacctgacaaaggaccaacaattttcaccatccccttgggctctcactgcagcccatgtctgtcattgtcagacctcttcacctcaatcgcctccttcttcctcccttccctaatgtacaaggagccggaaaatagtattaatttaagatggttcttcaggatgttacttcaccatctgttcagtttggtggctctctggaataaagtcaccttccctgcccctacacctcaactctcgacttattggctgtcatgcagcaagtggtgagtgcagtaagccgagatcacaccactgcactccagtctgggtgaccctgtctcaaaaaaaaaaaaaaaaaaaaaacagagagagagagagaaatttggtttttgaaccagacaaattaaataggagacttaattccaatgagacctagaaatgtctaaatttctaaaatttctaaaagaactgagaaaattgcctccattgaggaagtaagctgaaggaggtagactgtcatgttttctgatttgagaaatattgaggaggctttgtctctttcacctccaactgctccttctcctcctgcccctgcacctgcatagtctttcttacctgagccttcctgtcctgccttgcctcttcttccatcaccatcacctaaggaaagtccccagggatctggtcccttccctgaaacttctgttctgacagcccctttcaaggtaaaacccaaacccacaggaagaggggagcctaccgttgtgtataccacttcaccaaaacgtgaattaagaatattataaaggacttccctgatctaaacttaaatacatttcactcttctgtttctaaagcaggctccaagatcctgtaggctttggcagaaaatttgacttaactgttgaaacctttgagcccaaatattctgatctttatcaattaactcacatgctggtgaagaagggaaggccactaactggttgcaaaaggtaaattggaaggattttcaaaaagggactgaagcagaacatgaaaggttcacattttcaccaaatatctccaagttgccattccccaggtccttcctaaaaatatagattggaggataattcagcattgtactaaaaagccagacaaatctgtctttgcttaactaaaatggtttgagagccaggtgtggtagttcatgcctgtaatcccagcactttgggaggctgaggcgggtgaatcacttgaggtcaggagattgagaccagcctgccaacatggtgaaaccctgtctccactaaaaatacaaaaattagccaggtggctactcaggaggctgaagcaaaagaattgcttgaacccaggaggtggaggttgcagtgagctgagatcctgctactgcaatacagcctgggagacagagcgagactctgtctcacaaagaaaaaaataaaaagaaaaaagaaaaatagaaaaaaaaatagcagggtagtagaaatataatgcacacaagaatgataatcatgaagacaatctgattctacaagagtaagggaacctattccattagagagccaactgaaaacatcaaatcccagttcacaccccagggtgtggggtcacgtgcctgtaatcccagctactcgggaggattagtaaggaggtttgcttgaattcatgaggtcaaggcaggagtaaaccctgatcatgccactgcactccagcctgggtgacagtgagaccttgtctcaaaaacaaacaaacaaacaaacaaacaaaaacccacaaaaccaaacaacaacaaattgccacctcactctgaaatcacagtggcaaacatcactttgctattgacaaattaaaagaaaaacactccctcttgctatcaacctggcctcttgctctaacatgtctgacccatggtttaaaatgcccaaaagctgatgtcctcaaattataatacacttacctattctgcaccagcatttatttttgtctggaggagatcaccatccatggtcctgtaaatgtctaacagcatggaatgatgaagggcagtgtcttttaggatatttggttatatctatatatatggctctgaagaaacccaacactgggcgagttccctcaaacttttcactaggcatgaccactgctgtattttagatagagattctgtggggcaaaacctgagaattatctgcctggctatctagaagatagctccttgcattttttgggggagaacacttttgcttcaagggagtgtttcctcccaggattagaaatctttctgtaacctcaggaaacattgctgatgaaaaccaggcatggtgtgctgtacaacttgtagtaataaggcagaagttaaaaggaaaagacaggttccctgtacttggctgactccaagacctgccatagatagagccctagcagatcctcggtaacacgatctgaaaagtcagagccgcgaggagtgagttccggagactctctcaacacagtaagccccaacaaagataagaggaaaaaacaacaaatgcctttactaccttctctttcccccttcccatttctaattattcaagttttgttaagttcttgatttcccttcagtgcagctgcaaggtcaccagctatacttgcattgcaagacctgtgacagtttgattagctgcctttgttctgcttctataagccctcttgcctgcccccgagtttcatgccatcaaattcccgccgcgccattcaaactagccgaccccctttcagaagtgtctataaagttaagccctgtctttgttcggggctcagcctttggattttcatctgctgggcctcagtgcagtcaataaatcctcctgttccacccattggtctctctgttctcctgattcccacaacagtagtaggggactgcgttcccactttcccctggtctttcatggtatgaataatggacagcatttttttttttcacctatagtcgcaggctcggtctcagtgattgtatgctgtggtcagctgtttttgtttttgtgagaccttgctttcttgtttactgtcctgggacagatgtctgtagtcacttgtttcctcgggaggcaaatttcagtctctgtgggggaggtctcccatgttagctgtggtggtacttggcaggcagagctcagggatctaggcttccgtgctttgtagattgctcaatggtccccaaggcctagtggcttttaacaccacttgaaaaccttagtgtttttccactgtccccagagtcacctcttacacagcctctttttttgtttgtttgactttttctctgagagacagtctcactgtatcttggttgaatcgatcctcccacctcagcctctggagtagcagaggcacgagtcaccacagccggcttatatctgttcttgtttttgttgttgtggtggctgtcttgtttttttaagagttgaagtttctccatgttgcccaggcgacgtgctcccggcgaaggaggccgcctgcctgggggcgggctggagccacgtcccagggctgggggcgctgtgggcactgtgggtgccgcacccaccgctgcccggcactggaggccaagagagcgttcccgacgggctccgcggatgccccgccgcgtcctgctgcccatcctgcccgggttgtcgcgggccgggggcacgacaagaggccggggtctgcccggacgcagcggcctgcagggcgcagctgtccctccaccagccggggtcccctcgctcagcccatgagacaaataaatgaatacataaataaataaataaataaaagatggagtcttgctctgtcgcccagggtggagtgcagtggtgcgatctcggctcacttcaacctctgcctcccaggttcaagtgattctcctgcctcagcctcctgagtaactgggattacaggtgcatgccaccacacccggctaatttttcgatttttagtagagacgggatttcatcacgttggccaggctggtctcgaacccctgacttcaagtgatccacccgccttgacctcccgaagtgctgggattacaggcatgagccactgcacccagccagaagtgggcattaatatgcaggcgccgtatagggcaacatctgtgtgcacctcttacaaatcttaatgctgtgtatatgaggggagtccttcgtgtccccctggggatgtttgaggttgcctgtatgtgttatgtgtgtgcatatttttaagctcagatatgcataggcggattgacacctctgtttgaatgtattcccatgagctcatgccattaattcaccatcacaagaaatatttactgagcgtgagccatgccattccacagacaccattatagcactaagatacaatgaggaacaaaaaatccaggctttctgagctcacactggggtgggggcatggtgggaagacacaggcatcaatgtaataaacagaaaccacgacagggctaagtgttctggaggagaggcgcatggtgtactgaggcccctgacgtagaccccaggtgcacctttgagctttgcttgcatggtttgggtttgtgggctcacctgcatgtgtccatgcatgccccatctgcgtgcccgtgcatggctgcatcaccccatgcacacgtgcactgcccctgggcttgcccacatgtgctgctccccagggcgccaggctatcagcctacaaggcattgtgggtctgggcccagcctgccaccccctacagaggcctgagcctgccttcccaggaggcccaggactctcacccagggcccttccctgcagctggagcaggctctgtggctgcaatctggtgagctggagacgcaagagcccagggggctggtactccagagcgtggagttgcggaggcagctgcaggaggagcaggcctcctagtggcgcaagctgcaggcctacctggagggccagcagcggcaggcccagcttgtgcagcggctgcagggcaaggtcagggccacccattcctgctctttccctcccacgtgttcactttgccctgcccccacccctggggctcaccatcagctcccaatccccagattctccagtacaagaagaggttctcggagctggagcagctgttggagagatccggagagctggagcagcagcagctgagggtgggtgccagggtggggcagaggcaggccctgccctccacctgcccagcctgatgctttaacctctctgccacccaggacgcagagcacagccaagacctggagagtgccctcatctggctggaggaggagcagcagggagggccagggctggcagcatggccccctgggcgagcgcctactgatcccctgtgccccattcaggagtgccagcctggcccaggtgaatgccatgctctgagaacagctggaccaggcaggtttggccaaccaggctctgagtgaggagatacgaaaggtgaccagtgactggactcgcagctgcaaggagctggagcagtgggaggcggcatggaggcgcgaggaggaggtgggcatgggggtgcagggaggccggcgatataagaggaagataatgcacaattatgctagtgagactctcttttccaataatgtttgcacttctcaatactacatttaaaaaggaaataggagcacttgaacggttaagtaagaagatgaacaaaattgaacagaggaaaaataactgtctgaagacatgttgaaaatacatttaaagacagtctgtctgagacaggagctgagctggccaatccatcttttaaatcattgaacatcattcaggtgtcaagtatttgacctggagcctggaaggggaggagagagtccaaaaaaaagtcaaaatataaagaaaaaaaattaaagaacttgtcccacaaatcaggcaaccaaggtctaaacttataccctctgcctgggtaaattgttgttgcttctttctgtgactcttaaaagatgtaccatatacctcatttaatgactttgctttattcatgaaaactctatccccatgggaaaagctgttaaatgaaaaaagatttcttttaagtagaaaaattatgaaaggattccttccaaccctccatacccaaaatatctcaaatgaattatgtatctatcaattatcaatatatatcaaaatataccaattaaaaatatcagttaaacaatacgtcaattgaactatgaaagcaagcttatttaagtagcaaagaataacgtgaaggttagtaagtatagcttatacttaaaatacaatgaattgaaagctcatggcacttcatagagtaggaagaagaaacttaatagaaagtggtagttgggcgagaaggactgcaagggagttatttggaaaatgcattttttatttctgcatcattttgttcacaaattattcctaatcttttgtgaatttgtggatttcttgaactcaaaccagacttaaaaatacagttatagcacagaaaaaaatctttaatggcaaaataaaagctaagcaagagagcctttcaaaacacatgaaaataacacacacatacaaaaaaaaaagaataaagagatgtacaagtgacacctcctcaaccttctcacttggtgtacatatgcacagtaaattattttgggctcagccaagcatgggagcaattcaaatagatccatatgatattctctgattagaaactcttgtggagtaagttggtgagtgtatctttgcctaaaacagtcatgtcaaaatatagcttcctatagcatatttatttagtatcattttggtgaaaaagtggttatacagaatagaaaagagttgtccaaaactaagtggttgacctttccagagccattacctgcagaattgttatgtaagtctgttccatactcataaaggaatactcagctgacccaactgattttctcgtgttttttccttcaagggctagtagaagtctatatgttgtggtggaaaacaacctcagccctatagtccaacatttgcctatcaaaacttgtcctatgatttataaaactagaacctcactggtaagtcacattcctagagtctcccccatccctaaccccagtcacggaaaataaatcaaatcattgtcactctttcttaacaaagagcatacatttaaaacttgagtaaaattacaggtaccgtctgggtccttcaagggggaacttgaagtctcaataccgcagttgtccaatcagaggatccaagatgaatatactcaaggactttatgcttggcatcctctggagacagtacataaccaccagcttggtttaactggagattcatttgggttaggagaaattatgtaggcaatgtacttagtcaatggaggcctcatccctgaagacttacaagaatctgaattcgtatgttacttttcctttaatggagtggaattccaaatgaaaataatcaaacagcatgtgcataaacattagatataatacccacatttacaaagcctttatagatatgcaagtgttattgcgtctgtccctagcttctgtacagaatttaatgggtagctgttactattttattgctgtataaaaatgaggaaactgataagttgtctaaaggtgcacaatcaaaacacatcaaagccattgtgaaatacaggtccccggatttcaaaaacagatcttctgcttataaattcagtctttttcatactgccataaactccagaatgggaaaacaaagttactatcagaaaagcttcttttagctgggcgtggtggctcatgcctgtaatcgcagcatattgggaggccaagacaggcggatcacttgaggtcgggagttcgagaccagcctggccaacatggtgatctctactaaaaatacaaaaattagctgggcatggtggcggacacctgtaattccagctacttgggaggctgaggcagtagaatcgcttgagctggggaggccgagatggcgtagtgatccgagatggcgccactgcactccagcctgggtgacagagtgagccgacatcgcgccactgcactccagcctgggtgacagagtgagactccatctcaaaagaaaaaagaaagcttattttttcccctaatcaccataatattcactattaagtgagggaaatagaaataatttatttagcaaatcctttctagttcaaataatttgtatacaggctgtgcaaacataataatgagattctttttagtcatcttgctttatatcactaattacactcttatttaatgatattttaaagaaaaacgtgtttattttcaagtagaaaactcatatctgtccaccaaggaaagctgtaacaaatgtaaaatacataaaaaagataactgctaaatttctaaagcattccagaaaaagacaaatagaagggtgtcagattaggaaagtatgtcttgtaaggtgtaacggacagactgatgagcttagagatgtggatctcaaagtggttctcagagcaacagcatcagggtcacctgggaacgtgttagaaatgcagattctcaggtaccatcccacatttaatgaatcagaagctcagagtagagaccagcaatttgttttaacaagtccttcagggattctgatacagctgatgtttgagaaacactagctttaggtaaacgtaagagggtcacgttagtatttttaaatcattggaagttggtttgttttgttttttcttaagtgggactcatttatacttcaatacacagaatggatatttagaggaagtcgtttttgacctaacacggatgagcatttccaattgaatagcgctttctgataatggggctgcccactacaagtgaataactgggtttctctaggctggagctgcagacaggtcactatgtgtatggaggattgtattaatatgatcgtggctctttatagctctgcattactaatattctgttttaaagtctctcctcaatatccaatgtctctgtgtgaatgatggtaaggagtgggtaacagtaacaatcatcctgttgttgacaacagatgataagagaaagcccaactttacactctgtataaccttacaccaatgccccattcctcgtctaattttttttacatgttaacacatgaccttggcattactaaataagaagccctctcacttagaacccgatgcagtatgataaaaattattttgagaacaatcaggagctctagttttcaattctgcttctcttctcaagtagttctgtgccttagtttcttctttgtaaatttaaatggttggaacagaggatctgttaagtgtgattcaagctgaaattgtatgtagcccacactgagtttctctgctatacccctaacccattcaacaatcacaccaccagttttcaggactcacagtaggatagccgtctatcatttgttaataggtgtgctctttcatccaaacaagaaactcatgatttctgcagttttttattctagccaggttctaggtgctggcctggaactataaaacgaacatttcacaaaaagttatgacaatatacaaaggaaagacaatttctttgaatatccataatctcaatatgcagtctggctgtggatggccaagagatagtttccttaactggaaaaagcttttaaatgaggcttggtggaagatatatctttgcatcattacaaagaagaaaaaagagaaatctcacaactgaagaaagtgaaatccactttacttaatgcggacctctgtctctggtgtgcaggtcctctgtgtccaaagataattagcactttataatgctaattattataattaggtctgagaaaaaaatcattagggggtaggcccgttcactgattttcaactgccccctctatttaaaaataaggtcatttttctatgaaatacctttaggagctcaaagcagaaagagggttatagaaaatcctgtgtaggtataagcctgagtttttaatattcttataattctgtgatgtgtctggaaactgaaccgggaggaaaacagtgaacctatttagtccaggagactagaaatcaggactcagaagagtaaacatttctgtaatagttagtcctcaaatagtcattcattgaccttccactgggtgtctggcaatgtgcaagctgcttctagatgctacctcatgtaacaaccatcacagttgcacagagcaagtactagtactccactttcatagataaagaagtaaaatcttagaaattagctgcccaatgtcatgtatgtaggaaaggaaagctggattctgattcatatttgctggctccaaagcacttgttgtaaatacttcactatcctgtgcttacatgtaaatgtaccatttctcttaggggtcttgaaatactgaaccaaagaatggtgtaggggaagggcagtttagaaatacctggaaatttggttgtttgaaggaagcccactctcagatggtaggagatcaagctaacagaatagctgagaatattttctgaggccccagaagtataaaaacggtctaggggggaaaatttgggacacagagtgaaaatagcctgcctctgaagaccagcttcatttcttcccctctgggtgttaatgaaagagcctttaactttgccaggcctcagttactaatttctaaaacaactgctgctactattactacggatcttactgctactatgaccaccaccaccaccacatcagttactgagaactgaactagatgccaagcaaaaatggtaaacacttcatatacattatctttttaaacacaaaatgtactattaatccagttttacatataagaaaactgaggctcaaagaggctaagtaatttgtatgtgaacatgctttacactatgtaaaacaccttattagtagatatcactattattaagaacctatcagccggagaggaagaattggccttttatctttctaagatgcacagttgtctttctgtttaatggttttttaaaaatccccctgtgacaagctccagaggacaaataatttgtttcttgtggtgtatggctctctaaatgaattaattgataggcatcccattgtcagtctcagggatgtggaaataaaacagacatgagatgttttttaccaaactaatttgtgctttaaacacataaataataaatatatatatattaaagtaaatgtgtatttaccgtctctcctgctccactttgaattcaagaacccgtgtctttgttgggtcactgcactgtcaattgagaagtttggttttgtttctttgagtgttagtaagtggcattaaatggtaaatattgccgggggaaagaaaggagaaaaacagctcttccaatccatccctgtttccattcaattaaaggagggtagaaagaatacttaagataattgtaataagtctaatagaatagcaggagccactcttttcctttcagtaggccattagctcagaactattttcagagtaatactaagatgatatttgccttttcactgtgttggcacttgtattgataaggcaaaaacagtggagtcttagcaaaaattaagaccatgaaaacaaactgcactaggaataattctcttcttcattactgtttacttgcagggggaaaaaccattttcgtttaagaaagtccttggtgaagtagtaaaaatattaattttattaaatctcaaccttgagtacaagtcttgtccttgactgtacttacaagttttgtcctccccaaagcatatggcgtcaaggctgggcctaacccagtctcatgaccttgtgaatccagtccacaaacacagagacacgcgtgaagacggctggccagcgcgaccttgtgcatactcggttggggattctaattcctttcaggacccagcagttgtgggtaaagcaggcaagtgggcccccgtagtcaccctggcaggtaggagaactgatgagggccccgggccacagcaatgactagcctgcttcatgataaaatagttcatttctagccccccatacccttccagggctggcccagggccctgccaccaacctcacaggcccccacaggggccaacagtccctcagtgcacatctcgctctcccgcacatgtcctcggtgcttgatgttacactcctggttggagatgacgttcagcaaggccacatttaggactgtgtcattacccgtacctgcagtgaggggaatggggagaaggagacggtcctggaggaagatccagggctgggcctcctggccaccagcagtcctgtgcactatgctcttacctttggtctcaccccagcctgcaatctcacacttggtccctggaggcaccacataccattcaggcggcaggcagatcagggccacacgctggttcagggtcacagatctttaacaagaatgggggcactcagggtctgaggccacaaggctcagccccacctcacatcctcccaggttgtccacatacctctccagcttgagcaggacaagctgggagcctgagggcccacacagcatcttggctactgggacccgctgtaggcctggctctccatgttgtgggttctggaacagggtgcccaaccatacctcatagcccgtgagaggcatatggctgggagagaagctctgctaggtcatttgtgactctcagtccgttgccccaaggctcacttgttagcttgcctggggaaaggggaaagtgggatgagactgggtccccaaacacaagggaggctcaccaggaggagaagcactgccgggcagtcagtatccactgctcctttactagagaccccgcgcagaaatgctggccctgcctagaggagtggggaattaggacagggaacagactcctgggacagatgctagacctgccatcttctggctaggacctctgggggcagggatagattcccagcccccagtggcataaccacagaggacacaacctcagctcctctctgtgggagacaggcagttgtgcctcaccgattccgcaagctgactgtccagggtgagttgcccggatggcccccagccacgcgcagcttggaacgacgctgatccagccgatccaccctcttgccacacttctcaaactgcacctggtctgtaggatggggtgggctggatgaaacccagactgtgtggatgtcgtgggctaaagggcctgacccataactggcccaactcgtaacctgggggggtccaggattgatggcggctggtcatcagctgaaagacaaagttcactggggttaagggagccagcctttggtggtgagggctgaggtaaggtcatggggcaagcgtcactagtgctcaccgcagcgtcgcagggcacagtagtcgaatggggtccttgggtccatcgtgtagcaccagggcccatggctatccccatctgggtctggcagaagttctcctccagttgtgcatgcggttcggaggtaaatgtgaaccgaggcgggagcgggagcaaaatcgtggcagggtagtctcaaccatttccaggctctggtcccagacatcaaagcatgccgccccagggttagggccctggcggggccgggagcaccagggactcactgcagcttgtgcggcgtctcagcggaccagcgctggcactggacacccttgcgggtcttgctgaccgtgccgcggtactgctcccccgcgccgtggtagcagtctgcggccggtgcgggcagccatcaggccgagacctcgccccggccctccggttccaggcttccagccccggctctgtagcccccaagcttgggcctcaccctggggccgcacgtcgtctgtacaacgccggatctggtagcaaaagcccacgcgcgtgccgggccgcagggtgaagcaccagggcgcctctgagccgtcgaggttccagcagaagttctcccgaaggtctctaagcaggcgctccactcagccctagcccgccagcctccagccctaagcccgtgactaccctcctcccgtctcacccgcagcagcacgtcccaacgcccgcccccccgcccacctcacttgcacgcgtatttttctggcgtaaatcggtgctgatgtgggatttgcgcgtcccaacgctggcaaggtacgccgcggtggtggtattggctgtgccccggtagccctcacccttcccgcggaagcagctgacacttgtggcctcttggcggggctgtgcctcggacccttagatggaccgagataggtcgggccccgagcgacagctgagatccctctggggctgggaccaaacccgcctttcccaggtgtacggtactccacgggatatgctctcaggtcacgcccagcccctctgacctccccggccaagccacgcccctccccaaggttcccaggtaccctcccaggcctggtccccgccgcctaccgcagcgggggaggtcacagaactctcgctcgatctgcggatccgtagtgtagcaccatggccgctcggagccgtcaggattccggcaatagttgtcgtccagaccttggtcgaggaacctgggggcggtaatggggcgtgaagaagaccctggtactctggcttatctggccccgcccagttgccctacacggagccctgcccctggagtcctggaccttccctagcccggcccccagggcgccgataccgcctacgcgtacttgcccggctcgaaggggtgctggtgcgggtgctgaagatcccagcgctggcactcgcgccctgactcggtgcggtctaccgcgccgcggtattcctcgccattgcaccagacacacgcggctggagacaaagagccagtgggttcgtggatgggcgtgggcttgcccctccactctcccagcttgacccggcgccgcttacccacccggcaggatttgatgctgcagctctggaagcgcacggcagggtctgttgtgtggcaccaaggacctccggggtcgccatcagggttacggcagaagttctcttccaggccattccggagcgtgggcatgtacctgagggcccagagcatcactatagtgtgtgctgggggaaggtcccaggccgggacggagggaaggtgtttgtctcacttgtgatcgttcgggaacttgtggctccaagcctggcaggacaggccacccacggtcgtggccatggtgccccggtacccaaccccattgttcatgatgcaggtccgtatgtagtctgggagcaagagacagaagatcaacttgggctgaggtcccctgtctcccaccctgcccctctccacccccactcgcctttctcctggaagaggtcacagcgcccagaatgccacagccttgagtggggcgagtgttgagtccatggcagcagttggcaaccatggctgctcacattgtagtggaacgccctggagagaagaaggcacagggtaacgccacggcccaggctcccctgcccccagtcttatctaggcccagtggccactcaccagcagtccattaagggcccacagcgaccagcacactcttcagcatctgccacatcctcctgccaaggcccgggcaccaccgcatgtagcaggtgctgtagctctgtgccccggagcacctggaagtcattcgatggcgagcgctgccctgcagagtgggcatgagtgggtgcaggtcaggtgggcatacatgtcagtaatgtgtattggcatgtccacactttgttcattcaggggatcaaagctacaaggcttctgggatggaccctgtatgcactttcaagggccagtctagcccccctgcacagatacttgtcaaaaaaatttcccctgggaagcaggcccagacttggtagttatcaccggtgcctctgtgtagtggcccaggcactgggctcagatctaacacatacgctctgtgagagcagtgggtgatggagcttgccccatctcatctctcaaatgagaatgctaaggctcagagccatcacattacccagccaggggccctggctaggcattcagactccaaatctgggctctcacctgcacaaaggcatacgctaggttagaggggtagatcaggctcaggaggggtcatttcctgctgtgtgcgtgcatctgtgtggtcctaacactgcttcagtgctagagcagacgtgctaatagaggcctaagtgggccgtgtctgtgtgttcctagggcttcccagctgtgctcaagaggccaaggtcactgccccatgcccactgagcctctggctccccgacttttttctcatcccagaataggagaatagggccaaccccctcctgaaggcagatggggatcagggttgggggcactcaccagggacccctaagtattgagtcagaagcagcaggagtgggagccactcctccaggatgacttcatcttaactaattatatgactatgttgactgcaacatatgtatgaagtttcatatactcaattcctttactgcttccttgagcctatgaaccccctcctgcatctcctagtcttcactgaacattatgtcaattctcagcctcagctctaaatgctcatggtttccaaaaacatatttacaacccaccataggtcctgagcaccaaagcctgatgtccagttgcccagtggacagacatctccactgggacatctcataagcactaaaaatctcaatgtactgaaacctgaatttatatttctctccccaaatgtgctccatttccatcttccctttctcaacatccatccagtggaaatgttgctcaaacccaagtccagagccacccttggcacgctcatcttcctgagccccccacttccatcggccacccaggtgcttgtcagtttgcccactttctccctctccacagcccttttcctagttcagaccttctgtctcccttgttgggatcatgtcaacctcttcctcactcgcctctggctctgggcttgtgccttcaaccgactcttcaaaccgtagcaagagggatgcctcgaatcacagatcagatccctctctccttaaagccctgcagcagcttcctgtggctctcaggatagaattcaaacacttccaggatctgggcatctcctgcccctccacagccctgcctcgccctgcattccagccccaccaaaccacagtcagtcccttccatggttttggatctcttgtctgggaactttgcacctgctgttctctctgcttaaactctcgctttcacccatgcgacctggttcactcctcattctcctgcatgtctcagcttggaagtcacctcttccagaaagccttccctgaccctcaggtccaggttagatcccccacctggattcccacagcaccgtgtttttcccctaccacaaccctagtcatgccctttagcgaacagccaacagttactaagcacctgctgtgttaggctgtttcttaggactttataagaaagatcacatttaatcctacgaagtaggtactgctattatcctattttttagatgaacaaactgaggcaagagcagtcacacacacatagagtcagtaagtggtaaagttgggatagaaaccaagacaatctgactcatggatgttacaccgtgtgttagaactagccttgaaaaaaagacacaagcttgtgccctgtgccaagaaagtttctgataatggtggcggtggtggtggtggtgggatttaatcagttggcagaagtctgtatttctaacaatctctgattcaaatgggcaggacccatgtccatttctctttattgcaattgtactatgtttcttaccttcactctgcaacaagcttggtgaagacagagaacatgtatctgaggcccttcatctcccctcagttcctagaccagcactagcccatagtcaaccctccatcaaagtagagggagaaagtaagtggcttttaccctgtgctttctgaactcctgggatgctaggaagagccagaaaaccttgtccaccgaacccacaaattcactctcttcatcccttcctcactccacttccttcccagtagttgttggagtttttgaattttccctctgtgagcccttgccctcccctgccatgttctcagcaaaggccctggcctccaggtccatgagaacaggattccctgtagtaagagctcttccctagcctcctccacttccaaaggggctggaatcttcaccccttgatcccttccctttttagagcacagaggaagcggagccctcctcctgccctgggctcccatgccccacatgttcctggagagcacccttgggccactgttgtaactacatggtgacttgcttgctctcatccttcatgaccccccctcctcccatgccccactttgttaatttcactctcctctcaaaactccccacagtgccagtgatggggtataaatgcagctgggcaacgaggctcccacagacagacccaaacctatcttccaagtgttaatttcttttctctcctcttcttcaaataggtctcttccttacacatttctgccattcctttctctctctgccttgcctctcccttttctcccggccacagccttatccaacctcccagcccagcttggactcagctttcctaggaggctcccagacaatccagtgggctctcatttttttgagtgtattcagcagttggctgatgctgcatctccagcacttgccctaggttgttttatctccctaatggcctgtaaaccccttgagggcaggatctggcctttgtactctaaaaaggtcttcctactagagaatgctccacacatgtgtgatgcttcggggagtcccaaccttcatcagagattcccactggtgccagctcatagctcatcatgacgtgtcccagatggtgactgggagtagcctatgccaagcaggagtttttccccgaagtcttcctgtttattgcaccgggctggctgcaagacattgaggatgctgccccaggggccagcagggtgactggggcaggcgccatgatggctgtgcctgggtgctggccagtgtggccccaagaagaggccgggagccagagctgcatgccctctgtcagcaccagcctcctaaaaacactctcgactttctccaagcatggattgcctgagctcccctcctgctccccaaagaggccggggaacaagtcagacaggggataagtcagacaggctcagctgtgggaggctggaggaaaaagaccaataaaactgactttatttgtaatgttccca

SEQ ID NO: 40 - DNA, 3076 bp, Homo sapiens
aattgtctgtattcatacagatactcaaaatatcttaatgcttcatccgtcagtttctgatacaggtgtactaaaatatctcaatataattaattgtaggtagttttggtttatttctctatacaaacctgcctttttttctttttctttctttctgtctttctttttttttcttttttttttttttttggtagagatggggtctcactatgttgcccaggctggttttgaactcctggtctcaagcaatcctcccacctaaaccttccaaagtgtaggaattacaggtacaaggcattgcacccagccttgttttttatattttgatgctgtgttgttcaatgtattcaggctcagaattgttataccttcctggccaattactctctttatcattaatatcattataacatgttcctatttaatgcttttcactttaaattctacattaactattatacaaggttggtttggggtagtattgtctagaatattttttcttaactcttgacgttcaaggtctgtgtccatttgattatgtatatctttcacaattggggtatagctgaatttttaaatgtccaaaaatctctgtcttttgactgaaacatagtacatttaaatttattatgattagtaatattaaaattatttctgccattgcatttgttttctatttaccttgggctttttcttcttcttttctttttcctttccaaacttctacttgattaatctcattttcttcattctttttctctactaatttggaagttaaacttataatttttatcattttagctgttttcttagcatattaacatgtacacctgattaagcacaatatagttaatatttgtaaaacatactggaataaaacaaacaaaatttagaactgaagctctacaagctatttttaatgtggtctatacaatattggttcaccaaaatgtattgatatttattgtctcatttttgactccaccttccaaattagacatcagtattattgtattttatagtcggtgctcttgggatttatcaacatattttcccatttctattctcactgttgctccttttatctcattatttcctttcgagttcaatttcattgctatcaaagcccatccttttgtgtcttacaatgaaaaagagtgttgaacttcctatagttttaggtcatttaaaatagtctatatttcaaattcactctgaatagtagttcaattaggtacggagttctgtgttgacatttcacagcagcattttgaagatgtcatcttgatcttaattttagctagtgaaaaccagtaacaattcatctattgtttcttattaggaaatattaaatgagatagtcgatatctcataagactggaatcatacagcatttgtctttttgtgactggcttatttcagttagcataatgtccacaatgttcattcttatttttacctgtgtcagaatttccttcctttataaggctgagtaatattccattatatatgcataccacattttgcttattcattcagccatcagtagacacttgagctgctgccctcttttttctttctctctttctttccttcctttctttctttcttccttcctttctttcttcccttctttctatttatttatttatttatatattttatttatttatattttgtcagggtctcactctgttgcccaggctggagcacagtgacatcatcttggctcactgcaacctctgcctcctagattcaagtgatcctcccacctcagcctcctaagtagctgggactacaggcacatcccaccacacccagctaatttttatatttttttggtagaggcagggttcctccatgttgcccaggctggtctcaaactcctgggctcaagcaatctgcctgcctgggcctcccaaagtgctgagattagaggtgtgagctgtcgtacctggcctccatcttttggctattgtgaatggtggtatataaacctgggtctacaaacatagaatcacctcctttctaactttaaaggccgggcgcggtggctcacgcctgtaataccagcactgtgggaggccgaggcaggtggatcacaagggcaggagatcaagaccatcctggctaacatggtgaaaccccgtctctactaaaaatacaaaaaaaaattagccgggcatggtggcgggcgcctgtagtcccagctattcgggaggctgaggcaggagaatggcatgaacccgggaggcggagctggcagtgagccgagatcgtgccactgcactccagcctggaggacagagcgagactctgtctcaaaaaaaaaaaaaaaagaatagctctgtgtcacttatagaattgcccgggttactttggccattaaaagtatcacagtaaccaagatatttataattctctattattggattttaatttcctagaggtaagcagagtcaaaattctaaaagaacttctttctgaactggtgtcactatatattcactattgccaaaattatgttttctttttcaagaacagccttctctggtcttcagatatgacaaaatccatcaggtacttggttggtccttgaaattaaattttaaaactctcttggtaatctggcaaaggtttagaaatatttgctacacaattgggatgaaagatgagagatccaaggtttcttagaatgcccgacgtgtgtgggaggtgagtgtgatgacttcattcactacactgttctctaattccacatttgaggtgtgtggttgttggcacaagacaggtgcctccttagccatccatagcaagcaagtcttttagcacctgtaatccagtctcctttccagaaaagcttcattctaaaatgtcaacccatctagaaactcagtaatgtctccaagatgcctgaccctcacagaatcttttgacctctggtccatggtttgtcaattccaagaaatgaatgcatgagaatattgaggaaactggcagtgtcaaggtttatctttatttggctaatggcgatgacagtaaggtcggctgagctgccaatctgtcctccaattaa

SEQ ID NO: 41 - DNA, 724 bp, Homo sapiens
tcacttatagaattgcccgggttactttggccattaaaagtatcacagtaaccaagatatttataattctctattattggattttaatttcctagaggtaagcagagtcaaaattctaaaagaacttctttctgaactggtgtcactatatattcactattgccaaaattatgttttctttttcaagaacagccttctctggtcttcagatatgacaaaatccatcaggtacttggttggtccttgaaattaaattttaaaactctcttggtaatctggcaaaggtttagaaatatttgctacacaattgggatgaaagatgagagatccaaggtttcttagaatgcccgacgtgtgtgggaggtgagtgtgatgacttcattcactacactgttctctaattccacatttgaggtgtgtggttgttggcacaagacaggtgcctccttagccatccatagcaagcaagtcttttagcacctgtaatccagtctcctttccagaaaagcttcattctaaaatgtcaacccatctagaaactcagtaatgtctccaagatgcctgaccctcacagaatcttttgacctctggtccatggtttgtcaattccaagaaatgaatgcatgagaatattgaggaaactggcagtgtcaaggtttatctttatttggctaatggcgatgacagtaaggtcggctgagctgccaatctgtcctccaattaa

SEQ ID NO: 42 - DNA, 3630 bp, Homo sapiens
aattgtctgtattcatacagatactcaaaatatcttaatgcttcatccgtcagtttctgatacaggtgtactaaaatatctcaatataattaattgtaggtagttttggtttatttctctatacaaacctgcctttttttctttttctttctttctgtctttctttttttttcttttttttttttttttggtagagatggggtctcactatgttgcccaggctggttttgaactcctggtctcaagcaatcctcccacctaaaccttccaaagtgtaggaattacaggtacaaggcattgcacccagccttgttttttatattttgatgctgtgttgttcaatgtattcaggctcagaattgttataccttcctggccaattactctctttatcattaatatcattataacatgttcctatttaatgcttttcactttaaattctacattaactattatacaaggttggtttggggtagtattgtctagaatattttttcttaactcttgacgttcaaggtctgtgtccatttgattatgtatatctttcacaattggggtatagctgaatttttaaatgtccaaaaatctctgtcttttgactgaaacatagtacatttaaatttattatgattagtaatattaaaattatttctgccattgcatttgttttctatttaccttgggctttttcttcttcttttctttttcctttccaaacttctacttgattaatctcattttcttcattctttttctctactaatttggaagttaaacttataatttttatcattttagctgttttcttagcatattaacatgtacacctgattaagcacaatatagttaatatttgtaaaacatactggaataaaacaaacaaaatttagaactgaagctctacaagctatttttaatgtggtctatacaatattggttcaccaaaatgtattgatatttattgtctcatttttgactccaccttccaaattagacatcagtattattgtattttatagtcggtgctcttgggatttatcaacatattttcccatttctattctcactgttgctccttttatctcattatttcctttcgagttcaatttcattgctatcaaagcccatccttttgtgtcttacaatgaaaaagagtgttgaacttcctatagttttaggtcatttaaaatagtctatatttcaaattcactctgaatagtagttcaattaggtacggagttctgtgttgacatttcacagcagcattttgaagatgtcatcttgatcttaattttagctagtgaaaaccagtaacaattcatctattgtttcttattaggaaatattaaatgagatagtcgatatctcataagactggaatcatacagcatttgtctttttgtgactggcttatttcagttagcataatgtccacaatgttcattcttatttttacctgtgtcagaatttccttcctttataaggctgagtaatattccattatatatgcataccacattttgcttattcattcagccatcagtagacacttgagctgctgccctcttttttctttctctctttctttccttcctttctttctttcttccttcctttctttcttcccttctttctatttatttatttatttatatattttatttatttatattttgtcagggtctcactctgttgcccaggctggagcacagtgacatcatcttggctcactgcaacctctgcctcctagattcaagtgatcctcccacctcagcctcctaagtagctgggactacaggcacatcccaccacacccagctaatttttatatttttttggtagaggcagggttcctccatgttgcccaggctggtctcaaactcctgggctcaagcaatctgcctgcctgggcctcccaaagtgctgagattagaggtgtgagctgtcgtacctggcctccatcttttggctattgtgaatggtggtatataaacctgggtctacaaacatagaatcacctcctttctaactttaaaggccgggcgcggtggctcacgcctgtaataccagcactgtgggaggccgaggcaggtggatcacaagggcaggagatcaagaccatcctggctaacatggtgaaaccccgtctctactaaaaatacaaaaaaaaattagccgggcatggtggcgggcgcctgtagtcccagctattcgggaggctgaggcaggagaatggcatgaacccgggaggcggagctggcagtgagccgagatcgtgccactgcactccagcctggaggacagagcgagactctgtctcaaaaaaaaaaaaaaaagaatagctctgtgtcacttatagaattgcccgggttactttggccattaaaagtatcacagtaaccaagatatttataattctctattattggattttaatttcctagaggtaagcagagtcaaaattctaaaagaacttctttctgaactggtgtcactatatattcactattgccaaaattatgttttctttttcaagaacagccttctctggtcttcagatatgacaaaatccatcaggtacttggttggtccttgaaattaaattttaaaactctcttggtaatctggcaaaggtttagaaatatttgctacacaattgggatgaaagatgagagatccaaggtttcttagaatgcccgacgtgtgtgggaggtgagtgtgatgacttcattcactacactgttctctaattccacatttgaggtgtgtggttgttggcacaagacaggtgcctccttagccatccatagcaagcaagtcttttagcacctgtaatccagtctcctttccagaaaagcttcattctaaaatgtcaacccatctagaaactcagtaatgtctccaagatgcctgaccctcacagaatcttttgacctctggtccatggtttgtcaattccaagaaatgaatgcatgagaatattgaggaaactggcagtgtcaaggtttatctttatttggctaatggcgatgacagtaaggtcggctgagctgccaatctgtcctccaattaagttctaatctgaagaagaattgttgtccatgattaaactcccactgtcctatgaaaagggagtgtctagaagtcaaattcaagatggatccaccacttatcagctgtgtggcttctggcacggcacctaaagaataaacaaacctggagaaaataacacctatctcacagagctgtgataattaaatttaaggggggttttttggtagtagttgctataaagttatgtaaaacattgtgttggagagcattgaaaaatgtgaagtactattaaaaatgtaaaagaaatattattattgttttgattattatttgaggtgtggaaggaagtggccagaaagtagataccaggaacagaagcaagcttattgaggaggaggacaagggcagctgggctgatgatgtatctgagttgagtaaaaaccaaatgcctcttatcagctctttacagataaggtcaaactctctcatggtcacctaataccccaggcaagatctgcagcaacctgcacaggtctgagacccaggctccacacctgctctgattatgcccat

SEQ ID NO: 43 - DNA, 5174 bp, Homo sapiens
tttgttctttcttttgcagacatacattggaagtgtggttatatctgttaacccataccggtctttacccatttattcaccagagaaagtggaagaatacaggaacagaaatttttatgaactgagccctcacatgtaagtactgtactaaagcattaagtttctcttttactccagagatgtgtagttgacagatgtgtgcagctgtctcctttgaatttcagaataatgtttttgtcagttttttttaaaaagtttgataaaagtatgaagactttaattgttattattttaaattaaaaaaaggcagaatacttcatttgacgtcagacttttctgaaatatttggattcaggatgtaaaatattttctgttcaaaattctttgcaagtagcagctgctgctaattatttttgcaaataaaacaggaatgtgcattgtttattattataaagagcctaagcagctttttcatagtgttgttgggccaagaaaaatcctgagtgttgggttgtgtgatggtgtttgggtaaaaggaccaaacaataccttcagtttgtaatttttgcagacaatgttcaccagatgcgtgggataggccagtgatttcacttactctggaaagtcacttgtttgatttttctgaagaaggtcacttgttagtgtaaataattccttcacagtacctgtagattctgtttgtctgctcctttagagttcttcgttgacgtgcttaagagatgccgaaatgatttggccactttataccactacaattttgttttctagtctgaatgactgaaacataacactggaaaagtttgcctggatttggtagatccgtggtagaaccgggttattcaaccctagaacttttattcctccaaataaaaatatctgaaaaagaaagttggagagagaatacccagaaattatcacaaacaataccttaaactttttatttctcaaaaaacttttttatttattcttatgttacatttactgattcaagacaaatatgttcaccatttacattctcatgtccactactgagtttaaaggaaagagaaatatgctaagttgggccaagtcatgtaatgagttgagagcctcagacttctccgcttgttgcttaggcagaaacatttcctgcctcctctcctgtgggcatgcaagcatttttaccagaattcacgtacttatgattgtcagttgctgcaaggggcccacggtgtcttgcagacgggagttggttgatgcagcataacatcttttatgcaataaactgttgaatgcagatttagaatatttgtgaactgctgctgaacgtgggctgggaataacgtatgcaaaagtgccttggaaggtgtcaagcattctacaaagttatgttgttcgttattaccaccattgctattactttttcgcagtagcatcatcctctctctctcaaaacagatgatatgctgaaaacaaccccaaattgtcatgaaatgcacataaatacatgtgcatgtagatattgatgaggaaatgttcagtaaatgtcttggttgcggaaaagatttattggtcattggcatattggtagcggggcatttgaaaatggttaagctggcaatttgggtcactttagagttgagacattttcagtctttttaccgaaagcagtagtactcaaaatggggcagtttaaaaccccaggggacagttgacaatgtctggagacatttttgattgtgaaactgggggtaggagggtgcttgctgccagtgggtcagggatgctgctaagcacccttcaaagcatatgcagcccttcacagtaaagcgttgtctgttagccgtgtccatagtgccaaggttgagaaaccctgaaatgaagtgaaagaacctgcagaaagtctcattatgtcctagcagaaaggattttctctgtatgattaaagattggctttattaattttgacagaacataaaatctaataattaaggaacatatatataccactgtccagatgcttgttttagtttctcttgataatgcagcatgcagcgatatatttgggctgtttggaactaaagattatttattatttaaatgtatgaaaatggttattaatgaataaatctgctggtatattttaccagtcaagcaaattctgatcattttgttttcttctagaagtagatattgcaagtgttcttgtttcattttgccttaagacaaataatatctgaaatttgttttataaagttatcctgatagttaagcccctgtgatgaaatactttatttgatacctgaatattttaaattctagtcctcaaagccccacttctcaaagtatggtgcttggaccaattgtatcagaattcccccaggggcttatgaaaaaatctggattcctaggtcttacttctcataagccaggaatctacatttttcacaagctttctgggtgattcttaggcgcatgtaagtctgagaacgtgttgctttagatctatatttaagatgtttttctttcctttcttaactacttactgcaatttgtgatctttaacaataataatagtaataataaaagtatttatggctaatattttattaagtacttactattctgctctaaatactttatacgttttataactcatttcattctgaaaataatcttgtgagataggcactattacaaatggggaaattgtcacagaaagatcaagtaacttatccaaagccacacagctggtgggagtggagccggggtattaacattggttgcccctcttagctggaaatgggcttgccattttcatgacagggcctcttcctgtgcacttccaccccactacctttggttcgcctgtgttcctacaccacaaaccctccaggataatcttgactgtgcctcagtttacccccagcaattgtccacatgctctttttgcattttcagctttaatctccattctgggaatgtttagatatataatgtttgggtagatagagaatgtttagaagtctattctaggtcatagaagttcatgctccagaatatacatttttatcctggtgcctggaagattcctgtaggaggcagcatggcactgctactctagttcacacccctcacccccaaggaaaagaaccaccacgagcactaaaataaaatacattctcaatgtgcttaggataaagaaaatgactttttaccatggcctacaaagcactacgtggtgagcaaagtacagttttactaatgcatctgaagttgccagatccctctcattccctcccatcttgcttgttctgtcagtcctcaccccaccctcaccacattccctctcatgggagcatccttgcatagaattctgtgccttctgcctggaatgcttttccctctttctccaaagcaactcgtgttcttccttcagacctcaaattgcagaagacctcttagggaggaaccgtcctcacttgttccgtactaaggctagatccgttgcttttgccacatttactatttaatgtttgtttaagggatgatttgtctaagaatttgatgagggttcagtaaaaacatagtgaacaggacttgggttcaagtcccaggtcttccatttacaagctatataatcttgagcaaattacttgaaaaacttcaactcagagaaattaagtaattagcttattcagtgggaaaagaattattaattaactcctgggatttttgtgagggccaaatatgtagttgatatttagataatgatctaatacgtataaggtgcttagcatggaatctgccataactctgtgagaaaggaaagctatttctattaacaatgagaattatagcaattgttgtaataataaggtatgtgggacacatttccaacattctcacatgctctgtctcaccactttctgcatggtgggtcattttccacttcctttagtgtattttcctgcatttttctttgcagatgttcatctttgatggtattttgaaacagggtcaatgctaacttggttccctactaaaacagcctggcattctcaaacaggatgtttgtgatgtaagggggtaagatgaccttagcttttgatgcattctaactgtaaatatttcatgaatttagttccagtttgaatagaaaacaacttaagcagctgctcagactacatactttgaaaactttgccaattaacttacccaatattacatttgaaatttacttgtcaattttttttttttttttttgagtcggagtctcgctcgctctgtcgcccaggctggagtgcaatggcgcgatctcggctcactgcaacctccacctcccaggttcaagcaattctcctgcctcagcctcccaagtagctgggactacaggtgcccgccacgacgtctggctaatttttgtatttttagtagagacaggttttcaccatattggccaggctggtctcgaactcctgacctcatgatctaccctcctccgcctcccaaagtgttgggattacaggtgtgacactgtgcgcagccttttttttttttttttaagagatgaggtcttgctatgttgtccaggctggtttcaacttctgggctcaagagatcttcctacctcctgagtaggtaggtgggactataggcacatgtcactgcacctggcttacatttggaatttaatttgagctgtgttcactgttagtctgcaaaagcatccagatacttttgtaattcatatgttttgaaggtgtctacaatttatctttctttaaattttaggtaattaaaaaataattccattttgtataagtatatgactttcagatcgtggaaatgtatagattggtttcctacctattttcctttcaaaaatagctttctgttatcatttgtgggtctgttagtcccccaaacatggaactcctcagctggactcctcctctgcggctcctttccttctctgaactgtccccgttacgtgtgaagccacatctttgagcagggtatcactgggtggcatccccaaggaaatgtggctgtgctgtgtggcagagcctataccaccatttgcttttctagttaggtaagtgatgtctttccagtatgatttttaacttctttgaaaataaggaaggtaaaaaatgtattccagggaggac

SEQ ID NO: 44 - DNA, 6539 bp, Homo sapiens
gtccacccttgacaagataatatttgtccacctttgacaagatagtattcttacaggatgaaagtgtgtttatatatatatataacctgttcagttttcctagttgggagaaagtccttcataattaatatcattgtgacccctgtaaaaagaaaaaaaaaagtcagcagaacatttctacgttccttcattttctattctgtttaattttctagaaatatctgacagtctttttgaatcccagtggtggtaatactggaaaaacttgttgctctaaaaatggtaccttttgtgggatgacattggaaaggtgggaagttggagatctttttttccccttgtttctttctttcctttatgaacctttttctttttaaaagttatatcgctcatcactttatcacttagtttatcactttaccacttttgttggcaccttttttccccctcctgtcttttatgatgttgaaactgaaggggaaaatggagctgccaagataagttacagttaagtgacgtttgcttgtggcattgtccttggcattgcacagaaggaactaaaccagcaccactggtgctgccaggaatttagggtcgaagtagacaggaagagaaattgtgttctggtttaaagttcagtgagaaaagtttagtacatgctaaaatatagcactgatccctcagaaagtgcatttaaattttacattaaatgtaaatttgacattaaatttaaatgttgacattaaatgtactttctggaaagtacctttaaatttgacactaaaactctgatattatgttagatataatgagattatgtggtttgaatgtccaagagatacctgtagctctgatactgaattgaacgtgatctgagcccattgtggaaagattgacagacttgcagagggccagtgccaaagggaaggccctatgaggtgtgggtagggaagaggggaacactgggatactgttgactaaaaaggtggaaaaagatgagagaagaaggggaactatagctctatctagaatcagggagagcatggctcttgcttacagttagcagtagtttgtgacaaaatttgtggaaaatatgacagggctttggagaactcttaccgagaaccgtaaattagttcagagatatactttgaaaggattttaaatatataaatgtatgctttccatttatcaacaaactaaatagacattgttgaccatctgtcttcagagatgcaaagcattcttaaaatgtatacaatgaatggtgaagcagaactagtgttgattttaaaaggttgaaaccatacaacactaaagcttaagacgttaaaatacattttgtgtactaactaatgggcatgttttgttctttcttttgcagacatacattggaagtgtggttatatctgttaacccataccggtctttacccatttattcaccagagaaagtggaagaatacaggaacagaaatttttatgaactgagccctcacatgtaagtactgtactaaagcattaagtttctcttttactccagagatgtgtagttgacagatgtgtgcagctgtctcctttgaatttcagaataatgtttttgtcagttttttttaaaaagtttgataaaagtatgaagactttaattgttattattttaaattaaaaaaaggcagaatacttcatttgacgtcagacttttctgaaatatttggattcaggatgtaaaatattttctgttcaaaattctttgcaagtagcagctgctgctaattatttttgcaaataaaacaggaatgtgcattgtttattattataaagagcctaagcagctttttcatagtgttgttgggccaagaaaaatcctgagtgttgggttgtgtgatggtgtttgggtaaaaggaccaaacaataccttcagtttgtaatttttgcagacaatgttcaccagatgcgtgggataggccagtgatttcacttactctggaaagtcacttgtttgatttttctgaagaaggtcacttgttagtgtaaataattccttcacagtacctgtagattctgtttgtctgctcctttagagttcttcgttgacgtgcttaagagatgccgaaatgatttggccactttataccactacaattttgttttctagtctgaatgactgaaacataacactggaaaagtttgcctggatttggtagatccgtggtagaaccgggttattcaaccctagaacttttattcctccaaataaaaatatctgaaaaagaaagttggagagagaatacccagaaattatcacaaacaataccttaaactttttatttctcaaaaaacttttttatttattcttatgttacatttactgattcaagacaaatatgttcaccatttacattctcatgtccactactgagtttaaaggaaagagaaatatgctaagttgggccaagtcatgtaatgagttgagagcctcagacttctccgcttgttgcttaggcagaaacatttcctgcctcctctcctgtgggcatgcaagcatttttaccagaattcacgtacttatgattgtcagttgctgcaaggggcccacggtgtcttgcagacgggagttggttgatgcagcataacatcttttatgcaataaactgttgaatgcagatttagaatatttgtgaactgctgctgaacgtgggctgggaataacgtatgcaaaagtgccttggaaggtgtcaagcattctacaaagttatgttgttcgttattaccaccattgctattactttttcgcagtagcatcatcctctctctctcaaaacagatgatatgctgaaaacaaccccaaattgtcatgaaatgcacataaatacatgtgcatgtagatattgatgaggaaatgttcagtaaatgtcttggttgcggaaaagatttattggtcattggcatattggtagcggggcatttgaaaatggttaagctggcaatttgggtcactttagagttgagacattttcagtctttttaccgaaagcagtagtactcaaaatggggcagtttaaaaccccaggggacagttgacaatgtctggagacatttttgattgtgaaactgggggtaggagggtgcttgctgccagtgggtcagggatgctgctaagcacccttcaaagcatatgcagcccttcacagtaaagcgttgtctgttagccgtgtccatagtgccaaggttgagaaaccctgaaatgaagtgaaagaacctgcagaaagtctcattatgtcctagcagaaaggattttctctgtatgattaaagattggctttattaattttgacagaacataaaatctaataattaaggaacatatatataccactgtccagatgcttgttttagtttctcttgataatgcagcatgcagcgatatatttgggctgtttggaactaaagattatttattatttaaatgtatgaaaatggttattaatgaataaatctgctggtatattttaccagtcaagcaaattctgatcattttgttttcttctagaagtagatattgcaagtgttcttgtttcattttgccttaagacaaataatatctgaaatttgttttataaagttatcctgatagttaagcccctgtgatgaaatactttatttgatacctgaatattttaaattctagtcctcaaagccccacttctcaaagtatggtgcttggaccaattgtatcagaattcccccaggggcttatgaaaaaatctggattcctaggtcttacttctcataagccaggaatctacatttttcacaagctttctgggtgattcttaggcgcatgtaagtctgagaacgtgttgctttagatctatatttaagatgtttttctttcctttcttaactacttactgcaatttgtgatctttaacaataataatagtaataataaaagtatttatggctaatattttattaagtacttactattctgctctaaatactttatacgttttataactcatttcattctgaaaataatcttgtgagataggcactattacaaatggggaaattgtcacagaaagatcaagtaacttatccaaagccacacagctggtgggagtggagccggggtattaacattggttgcccctcttagctggaaatgggcttgccattttcatgacagggcctcttcctgtgcacttccaccccactacctttggttcgcctgtgttcctacaccacaaaccctccaggataatcttgactgtgcctcagtttacccccagcaattgtccacatgctctttttgcattttcagctttaatctccattctgggaatgtttagatatataatgtttgggtagatagagaatgtttagaagtctattctaggtcatagaagttcatgctccagaatatacatttttatcctggtgcctggaagattcctgtaggaggcagcatggcactgctactctagttcacacccctcacccccaaggaaaagaaccaccacgagcactaaaataaaatacattctcaatgtgcttaggataaagaaaatgactttttaccatggcctacaaagcactacgtggtgagcaaagtacagttttactaatgcatctgaagttgccagatccctctcattccctcccatcttgcttgttctgtcagtcctcaccccaccctcaccacattccctctcatgggagcatccttgcatagaattctgtgccttctgcctggaatgcttttccctctttctccaaagcaactcgtgttcttccttcagacctcaaattgcagaagacctcttagggaggaaccgtcctcacttgttccgtactaaggctagatccgttgcttttgccacatttactatttaatgtttgtttaagggatgatttgtctaagaatttgatgagggttcagtaaaaacatagtgaacaggacttgggttcaagtcccaggtcttccatttacaagctatataatcttgagcaaattacttgaaaaacttcaactcagagaaattaagtaattagcttattcagtgggaaaagaattattaattaactcctgggatttttgtgagggccaaatatgtagttgatatttagataatgatctaatacgtataaggtgcttagcatggaatctgccataactctgtgagaaaggaaagctatttctattaacaatgagaattatagcaattgttgtaataataaggtatgtgggacacatttccaacattctcacatgctctgtctcaccactttctgcatggtgggtcattttccacttcctttagtgtattttcctgcatttttctttgcagatgttcatctttgatggtattttgaaacagggtcaatgctaacttggttccctactaaaacagcctggcattctcaaacaggatgtttgtgatgtaagggggtaagatgaccttagcttttgatgcattctaactgtaaatatttcatgaatttagttccagtttgaatagaaaacaacttaagcagctgctcagactacatactttgaaaactttgccaattaacttacccaatattacatttgaaatttacttgtcaattttttttttttttttttgagtcggagtctcgctcgctctgtcgcccaggctggagtgcaatggcgcgatctcggctcactgcaacctccacctcccaggttcaagcaattctcctgcctcagcctcccaagtagctgggactacaggtgcccgccacgacgtctggctaatttttgtatttttagtagagacaggttttcaccatattggccaggctggtctcgaactcctgacctcatgatctaccctcctccgcctcccaaagtgttgggattacaggtgtgacactgtgcgcagccttttttttttttttttaagagatgaggtcttgctatgttgtccaggctggtttcaacttctgggctcaagagatcttcctacctcctgagtaggtaggtgggactataggcacatgtcactgcacctggcttacatttggaatttaatttgagctgtgttcactgttagtctgcaaaagcatccagatacttttgtaattcatatgttttgaaggtgtctacaatttatctttctttaaattttaggtaattaaaaaataattccattttgtataagtatatgactttcagatcgtggaaatgtatagattggtttcctacctattttcctttcaaaaatagctttctgttatcatttgtgggtctgttagtcccccaaacatggaactcctcagctggactcctcctctgcggctcctttccttctctgaactgtccccgttacgtgtgaagccacatctttgagcagggtatcactgggtggcatccccaaggaaatgtggctgtgctgtgtggcagagcctataccaccatttgcttttctagttaggtaagtgatgtctttccagtatgatttttaacttctttgaaaataaggaaggtaaaaaatgtattccagggaggac

SEQ ID NO: 45 - DNA, 6903 bp, Homo sapiens
tttgttctttcttttgcagacatacattggaagtgtggttatatctgttaacccataccggtctttacccatttattcaccagagaaagtggaagaatacaggaacagaaatttttatgaactgagccctcacatgtaagtactgtactaaagcattaagtttctcttttactccagagatgtgtagttgacagatgtgtgcagctgtctcctttgaatttcagaataatgtttttgtcagttttttttaaaaagtttgataaaagtatgaagactttaattgttattattttaaattaaaaaaaggcagaatacttcatttgacgtcagacttttctgaaatatttggattcaggatgtaaaatattttctgttcaaaattctttgcaagtagcagctgctgctaattatttttgcaaataaaacaggaatgtgcattgtttattattataaagagcctaagcagctttttcatagtgttgttgggccaagaaaaatcctgagtgttgggttgtgtgatggtgtttgggtaaaaggaccaaacaataccttcagtttgtaatttttgcagacaatgttcaccagatgcgtgggataggccagtgatttcacttactctggaaagtcacttgtttgatttttctgaagaaggtcacttgttagtgtaaataattccttcacagtacctgtagattctgtttgtctgctcctttagagttcttcgttgacgtgcttaagagatgccgaaatgatttggccactttataccactacaattttgttttctagtctgaatgactgaaacataacactggaaaagtttgcctggatttggtagatccgtggtagaaccgggttattcaaccctagaacttttattcctccaaataaaaatatctgaaaaagaaagttggagagagaatacccagaaattatcacaaacaataccttaaactttttatttctcaaaaaacttttttatttattcttatgttacatttactgattcaagacaaatatgttcaccatttacattctcatgtccactactgagtttaaaggaaagagaaatatgctaagttgggccaagtcatgtaatgagttgagagcctcagacttctccgcttgttgcttaggcagaaacatttcctgcctcctctcctgtgggcatgcaagcatttttaccagaattcacgtacttatgattgtcagttgctgcaaggggcccacggtgtcttgcagacgggagttggttgatgcagcataacatcttttatgcaataaactgttgaatgcagatttagaatatttgtgaactgctgctgaacgtgggctgggaataacgtatgcaaaagtgccttggaaggtgtcaagcattctacaaagttatgttgttcgttattaccaccattgctattactttttcgcagtagcatcatcctctctctctcaaaacagatgatatgctgaaaacaaccccaaattgtcatgaaatgcacataaatacatgtgcatgtagatattgatgaggaaatgttcagtaaatgtcttggttgcggaaaagatttattggtcattggcatattggtagcggggcatttgaaaatggttaagctggcaatttgggtcactttagagttgagacattttcagtctttttaccgaaagcagtagtactcaaaatggggcagtttaaaaccccaggggacagttgacaatgtctggagacatttttgattgtgaaactgggggtaggagggtgcttgctgccagtgggtcagggatgctgctaagcacccttcaaagcatatgcagcccttcacagtaaagcgttgtctgttagccgtgtccatagtgccaaggttgagaaaccctgaaatgaagtgaaagaacctgcagaaagtctcattatgtcctagcagaaaggattttctctgtatgattaaagattggctttattaattttgacagaacataaaatctaataattaaggaacatatatataccactgtccagatgcttgttttagtttctcttgataatgcagcatgcagcgatatatttgggctgtttggaactaaagattatttattatttaaatgtatgaaaatggttattaatgaataaatctgctggtatattttaccagtcaagcaaattctgatcattttgttttcttctagaagtagatattgcaagtgttcttgtttcattttgccttaagacaaataatatctgaaatttgttttataaagttatcctgatagttaagcccctgtgatgaaatactttatttgatacctgaatattttaaattctagtcctcaaagccccacttctcaaagtatggtgcttggaccaattgtatcagaattcccccaggggcttatgaaaaaatctggattcctaggtcttacttctcataagccaggaatctacatttttcacaagctttctgggtgattcttaggcgcatgtaagtctgagaacgtgttgctttagatctatatttaagatgtttttctttcctttcttaactacttactgcaatttgtgatctttaacaataataatagtaataataaaagtatttatggctaatattttattaagtacttactattctgctctaaatactttatacgttttataactcatttcattctgaaaataatcttgtgagataggcactattacaaatggggaaattgtcacagaaagatcaagtaacttatccaaagccacacagctggtgggagtggagccggggtattaacattggttgcccctcttagctggaaatgggcttgccattttcatgacagggcctcttcctgtgcacttccaccccactacctttggttcgcctgtgttcctacaccacaaaccctccaggataatcttgactgtgcctcagtttacccccagcaattgtccacatgctctttttgcattttcagctttaatctccattctgggaatgtttagatatataatgtttgggtagatagagaatgtttagaagtctattctaggtcatagaagttcatgctccagaatatacatttttatcctggtgcctggaagattcctgtaggaggcagcatggcactgctactctagttcacacccctcacccccaaggaaaagaaccaccacgagcactaaaataaaatacattctcaatgtgcttaggataaagaaaatgactttttaccatggcctacaaagcactacgtggtgagcaaagtacagttttactaatgcatctgaagttgccagatccctctcattccctcccatcttgcttgttctgtcagtcctcaccccaccctcaccacattccctctcatgggagcatccttgcatagaattctgtgccttctgcctggaatgcttttccctctttctccaaagcaactcgtgttcttccttcagacctcaaattgcagaagacctcttagggaggaaccgtcctcacttgttccgtactaaggctagatccgttgcttttgccacatttactatttaatgtttgtttaagggatgatttgtctaagaatttgatgagggttcagtaaaaacatagtgaacaggacttgggttcaagtcccaggtcttccatttacaagctatataatcttgagcaaattacttgaaaaacttcaactcagagaaattaagtaattagcttattcagtgggaaaagaattattaattaactcctgggatttttgtgagggccaaatatgtagttgatatttagataatgatctaatacgtataaggtgcttagcatggaatctgccataactctgtgagaaaggaaagctatttctattaacaatgagaattatagcaattgttgtaataataaggtatgtgggacacatttccaacattctcacatgctctgtctcaccactttctgcatggtgggtcattttccacttcctttagtgtattttcctgcatttttctttgcagatgttcatctttgatggtattttgaaacagggtcaatgctaacttggttccctactaaaacagcctggcattctcaaacaggatgtttgtgatgtaagggggtaagatgaccttagcttttgatgcattctaactgtaaatatttcatgaatttagttccagtttgaatagaaaacaacttaagcagctgctcagactacatactttgaaaactttgccaattaacttacccaatattacatttgaaatttacttgtcaattttttttttttttttttgagtcggagtctcgctcgctctgtcgcccaggctggagtgcaatggcgcgatctcggctcactgcaacctccacctcccaggttcaagcaattctcctgcctcagcctcccaagtagctgggactacaggtgcccgccacgacgtctggctaatttttgtatttttagtagagacaggttttcaccatattggccaggctggtctcgaactcctgacctcatgatctaccctcctccgcctcccaaagtgttgggattacaggtgtgacactgtgcgcagccttttttttttttttttaagagatgaggtcttgctatgttgtccaggctggtttcaacttctgggctcaagagatcttcctacctcctgagtaggtaggtgggactataggcacatgtcactgcacctggcttacatttggaatttaatttgagctgtgttcactgttagtctgcaaaagcatccagatacttttgtaattcatatgttttgaaggtgtctacaatttatctttctttaaattttaggtaattaaaaaataattccattttgtataagtatatgactttcagatcgtggaaatgtatagattggtttcctacctattttcctttcaaaaatagctttctgttatcatttgtgggtctgttagtcccccaaacatggaactcctcagctggactcctcctctgcggctcctttccttctctgaactgtccccgttacgtgtgaagccacatctttgagcagggtatcactgggtggcatccccaaggaaatgtggctgtgctgtgtggcagagcctataccaccatttgcttttctagttaggtaagtgatgtctttccagtatgatttttaacttctttgaaaataaggaaggtaaaaaatgtattccagggaggacatttcagaaacatttcagaaaactcagtaactggattcattgagaactgcctcagattcccaaacagcattgataaggaaaggctgagaagggagagatgagggaaataatcaaactataggttgagcatccctaatctgaaaatccaaaatcttaaatgatccaaatcagaaactttttgatcacaacatgacaccacaagtggaaaacaccactcctgacctccaaatgcagtcaaaatgcagtcatgcaacatagaattgattccgtgtccctaagagaaaggtaaaatttccttcaggctatgtatataaggtgtatattaaatataaatgaatttaatgtttagacttgggtcctatacccaagataattttgtatctgcaaatattcccaaatctgaaaaaatttgaaatctaaaacacttctactcccaaacatcttggttaagcgatactcagtcgatacttaatctccttccacttagttgcaatagcactgtgacagtgcaccttcagatattttagttaccaaatccactggccttttgtgttgggtgattgccttttaaccttgcagcagttgatgcagtttatcaccaacagatggatcttctaaaatcagatcatgttactcaccttcctagaaaccttcatgggctccctattactcccagttcctttagtgtagtgttcaaggccctttacagtccagctttagctgtcctccctgctctcctccaaaccccactactctcctttgtggaatctcctcttgagccagagccattcatgtcttttcctttctacgtctcataccctgtaccttatctccactgttaaaatcctgccagtcttctatggtctgtctgaaagacttggtcagccccagcataatccacaagggacttgcactggccctgagttatcagaccactcgtggtcgtcaacacacctcttcttgctatggttgattaggttttggtgtcaccctcttgaatgagatagaagcttctgtaggttagaaactttatcctgcacatctctgtggctgtctccagtgcttttctcttcagagctcaacaactataaaacaaaagagattttaggtgatttttcattacattttacctgtgttatggctgagagttcaatgaaatcaaaatgtacttgataggatacttgtggagtttattcaaaatttcatgcagtataatgagaatttttttcattttttaaaaaaagcaaaaatatttttatggtgctcttcaactcttaagtatttgttcagcttcgatttgttcatgttgtctgtatgtctattggaaggaacttgccaccagaagaagagtgtattgtggtacctggcaacaagccctctggtggtcatagcccaggagtgagctgagatgtgtccttcttaagttaggatataatgtgatggccatattaccttaggcattgcagtcacaaggtgaagcagtctttccatgttagtaaattacaaactcagcaacaaatgttaaaacttagacaagtggcttacagctttgaataatttctggttaccctcatttaaaaatgggtaagcaattagtgggagcacctggtatagtgctaatgtcagttgtccagaagtgagccctccgtctgtggactctttgacccctacttttgggccagactggtttttcaggatcacataccgttgcccatgagtgatgttgcta

SEQ ID NO: 46 - DNA, 2932 bp, Homo sapiens
aaattaaggggtgcctttcagtatattaggagaacttcgtgaagattttgaaaaatgccacactctagataaatatagatatagcttttcaaacatgggattggggaagctaagaagttcataaatacaaaaaaaaagagtttttgagtgtttcaaatttaaaaaaagatatgtcactgaccatgttgctttttgagagtctttgtccttgtatagggtaggttatgctgaggtgacaaatagctcccaaatctcagggagtaagaatagtaagaagtaatcctttcttatggttgtcatgtgttagcagggacctcttcttatcacggtcactcagggacccagtctcatggagtaactactattctgaattgctggcaccatgcagaattacttaaatgccccactgaccacaaggaggtgaggaatcacaatgctaccttgtgtttgcaactggagaccgataggaatgattagggaaccataccaccataatcctagtaaccagaaagccagccagctagtaccagagccccaagcagaggcacttgtggtttccaaatttcatctttaggctcaggctgatttgtaagaacaaatgagctacagccatgcatcacacatcctgtgctgccaccacagtcttaaatcccttgcccaagacaggagcctttgctttttgtgagagtccgcgtctgtcacctggtgtgactcatccattctccagtgcattgcccctcccactgcaggagctactcccatgcaggacttgtctgtcaggctgcagcactcctgcacatggggctgactgcctatgggaaccgcagggtccagcctggggagctgccattcggggctaacttgactctcatccatacaagagcccagcctgtgatttgtagcaaggtatgacagaagagagccagtaatgcccatatctccagctgccagggagtggggcaaatttgccggtgagtttgtctttggccagccacagtgagtagtcccaggtcctccttctccttccagtgacttcctttggagaggaatttcagagatgagcagccactcatgattttgtgtttgtgaggctttggtaatttgaggtttaattaataacatatgtagtgaataagtgaatttatacagtgaataagggaacatgtacagtgaataagaaggaatttattaactttaaggcactttacgtaataagagcacaagtctgtataaaaatatttttgttttcatttattcttctctgttcttctgtgctccactaattttatccaaagatcagaatacaggaaatgggaacctataaataacctttttttctgataatctccaaggtactaggtgtaaatgcagaagttaatgaacatttttatgattattttccctcatcagaccttgtcatgttttatctacaattttggcttattatgaaggcatcactagcctcaaacccttcttgaaactgagtaatatttttgtactttctcaaaaaatcctgcaccaacgactaacctatggcaatgaaaactcttggccttacacattcttcttctcagatgatactttctcaagaggaaggcagactttggggagatttctctgggttcttaagcttgtctccattgtgtcattctttgtattgtggggatgtaactacagttccattgttttttatactattctttaaaatagtgtaattgatgcttcattcctttcttttttctgattctttgtcagtatttgttgaatatgaattttaaaagtttagttttgcttaaaattgtttatcctttgaaatttgacaaaatgtgtttttccctcttaaagtgaacttacagataaaagtgatgcttgaatttctcccacattacttttggtttattacgtttcctctttcaaaattcattcatagtcctatagtttcaaaaaatccacttattggtagctcaaatgcataatttcaaatatatttctgggcaagtggttagccttaaaagactgcaaaacttgtactttatgtccttagagatggtatcctaaaataatatagccacaattctgttctaataatatttgcataatatagagttacaacatcattgtcttttttgaaaaatgaatagaaacttgtgaacagaaatcagacctcttattcacagataatgagatcaggggattcagttaccaggcctggtaaccggttgctctttctaaaattggacatgggaggacagcacaggggttgtcagtggaagtcacctgccctgggttcaggcattaacggggtgcagttcctatagagaataatatttctaaacatgtctaaaagataatagaaccaactgaaaatcagtcttctttatcatcagcatgttctggtaattctaacccatgtcagtgacatgggttggtgatatgggcagaccaggcccacagccaccttcccctccttgttactgctgttgtgtgtgtgagatttgatttaattcactagtgggaaacagtctacctcaggagacagtggctacttccaaaaaaccatagtttagcaatgatctatcagtcccattatcttgggaattgatggcttccgggtttgttatttttatatatttcttttaacataacagccatctctcaggctagtaaaacccctgattttatttttatttagggacgaggctatagaacctactgcttctgcctattattcctgaatcttttgactgcaatgaacaactcctgagtcttttgactgcaatgaacaactccttagctaaagccccaaaagtgattttattttagtaatactcggagatctcatagaacacagggcatgagacacaggggtctgaatggcctcaggactctctttatgatctttgcccctcttggtgcatctgcttccttttgc

SEQ ID NO: 47 - DNA, 5103 bp, Homo sapiens
cccaaagccagaaaatattaatattctatcataatttcccagtcagattttctccctgccttctgagaagttgccaccactgtgaagttgttatacagccttaccatctatatacttacgtttgcataaacaatagaaagcagatgatggcaaattataacctgtgtgccaaatccagccatggcctgtttcatatggcccataagtcagcatagatttatatttttaaaatcttgaaacaaagaataatctatgtgggctgcaaagcccaaaacattatcaggccctctatgggatactttattgatccctgatactgagtgttattttatctgttatcaaaatttatataaatggtctcataataaaaaagccttacgtaactttccatttttcactcaacattgtttttgagaattatcaatgttgatacctgtaggtctaattcatttttacaaactgctgcatagttaaaataccaatggaatagtcacaatttattgtataatgtgcctatcaatagacatttaggttgtgtacaatatttgtccattaaaaataaatctgtgataaatatcctcatacacatctccttgtgctcatgtgccagatttcttcccttgtatgtacctagaagtagcattgctagctataaaatatacacatcttcagctttgctcaaggttgtcaaattgctattcaagatagctttgttgatttcattatcaccagaaatgtatgattgttcttactcacatacttggtattatcacttgtttaatttttgtcatagatatcctcttgttcttctgtttgcatttttctgattaacagtgttaatttgattaaagctatcaatttactgattcttgggctccaaatccgcccttctttgtcctgttctgtcatactggaacaagactccataaacatctgtccttttatgttagtccctgtcaacagaggccactgaatgaagtgcaaaaccatagcataaaggggtttcctttccccaatccatagtgcttttcctgttcagcatagtagccgacaaattgatgtgcaagaggcctggtagcaaatccacctcagcggtatgcatggtccttctccaacatgcccatgccctctggcaagtttctcagccaactggctggaggcacctatgggccaattccagcccatgccttctggtgagtttcttcttcccactggtagatttaggggagggggataccagagtattctaaattcttaattcctttcttgtttattcccctgcagcctagaagtagtagctattttctgtatttgttacttctgtatccttaagggtcctttttaacttcttttagtagttaaccactttttactagttaattctttacgttaaagttttcctgttaaaattattggtattgttattgtctcctgagtggatcctgactggaacaatcagtgaggctgaacatattttcatgtgtttattcagccttcttccccaaatcataggtaaggaggtggaagaatggattgattcatggatggatggatggatggatggatggatggatagatggatggatggcaagattagatagatgatatacatgatgatagatgatagacagatgatagatagatagatagatagatagatagatagatagatagatagagatatccttcttttaatgaaggtgtagattttgtttatgtgttttggattctaaacctttatcagatctattcctagcaaatatcttctccaaaacctgtgactttcttcacactcaatgatgtcttctgtcacaaagaaattaagcagtattttcatttgtggtttgtacatttgtgtcttatttaagaaagttttcattattctgatgttataaagattatcttctatttttctcatggaagctttagaattttggttttcttaatatttgcatttaatacatctggaatttttgtgtaaataaagtataagctgggaatattattttactgttttccataaaaacagtgattttatctgagcaccatatatgtaatagtcaacttttctccactaatttatagtgaaaacttatccttctacaagttttataaacatggaactttttctggattttttatcctattcaatttggcctattaacctaatctagtaccagtattcactgttttaattataatagttttataagtattgaaatctggtggggcaaatatatactccatttcctttttttcttcgcctttaagtttgtcttgactgatctttgcccttcactctttcattcttcataagttctaagaaaagcacttttagatttattagaatagtattgaatttattaataaatttgggcaaaatagaaacattttctatgttgtctttctacccacaacactgtatgtatttctctccatttacttaggtttatcttcagtaaagatataagatttcctcaaaaaaaaaagaatgacttttgtgatatttatttctagatatatagatttttttctctattaaatgagtttctaaaatcacatattctaattgattttaatggtatatataaatgatattgatttttgtgtaatgattgtaatattcagcaaagttactgatctaaattctaatagtctgcctgtagattctcttggattttctatgttgtcagtcacatcatctgtgacattttgctttacattatatttcgcatagaatattggaacattcctaaagactaaggtagttaaccgtgaaaatggaattcactaagtactaaggaaatattcatgttcacatctactctaaaaagaaaagttttagaaatgaagtttagcagcattgagagccctcgtgtggaagcaagtcaagtaaagcttctatttacattttgtttttgtttttttttttaactagatcagctcagacatcaactgatttaatcacccttgtcagcttctaattaaactgacaacttctgaaacttaatttacctatgttttaacagagtagcaggttgctgtggcattggctaattgtacttaatcaaatatatagaaagagaatacttccttttttcttatttatcagtgtctctaaatctctatctaaaggcaactaaagaaagatttcaaaaatggtcacccagaccaaaataaaggaattcgaaattatcaatagacacataaaaatcaacttcattagtaatgaaaaatgaaaaggatttttacccatataaaattgttataggattttggtttgggtgttggttttggttttttttttgaggagaaagaaaaataagagtgtgtgtgtgcgtgtgtgtgtgtgtgtgtgtgtgtgtgtgtggtttggatgtaagaaagatgtattttcatagatttccaataagacatataaattggtgagcaattttgcaatatttacaaaaaaatctttaaatcataaatgccgtttgactaaagaattttcaatgtaacctttattttaaagaatgagtcacatctgtggtaaaaatggagataaaaggagattgattatggcattatagtgagagaaattacacatctaataaaaaagagaatgtgttaaataaattgtgatacattcatatgacaaattccatctagccatttaaaaccatattgtagaatattatttgatgaactagaaataattttcctgaaatattggtgaagtctaaaaacccaaatgtatagtacaatttcaatttcaaactacatgtacataataagaataatagcttttacttatgatgtgacaggcatacatgtgtatacatttatttaatctttacaacaatcctatttgctactattttcaccattttatagatcaagcaaccaaggcagagggaaattcagtaatttgcctaaaattagacagtaaatggcaaagctggacacatacatgcacagctttatgccagaaaataatacaatagttatctttgagcaatgggattatgggttatttttatttacatatctgtgtatgttttgtcttctccaaacttcctgaaatgagcagatattaacaaatccaaaaaattatataactgttaagataaatattaatgtttcttgtgatagcagaaggaaaaatgcctacttaatcataagtaaggcgaaggcgtattaatcttctacatgtgtatatttttgtaccaaattctggacacttagcccaggttccctattgatatgtattttgttgtgcagattagttctgcaaaaacgaaagcaaaaaaacagtaagccatccccatgtagcagctttattcccactgtcagatatgtttgatgctggggaaaaacttcccacccctcataccttgaaaataactgatgtcaggctccatctctgctgtgtacactcattacccttagcgagaaatcactgggctctgtaagaaaaaaatattgccccattaaacaaagtgtcatcattgaagagcaattattcttttttatttttccagtgaggttatcttaataactcactcataacagttatctcctaggaaacatctagttcatggagtaagactgttaaacaatatgaatctggtacaaatagcacaggacaaatgtttccaaccatgaagcatttatatttattaaaaatcaatacaaggcaaagaccactgcaagctactgcctattgttggtggaaaattaaattattcttactttttgtgggctttttactcctccatatgcagcttgtcatactagaaattatatttcatcataccctagaaagctaagtaaaagctaattggcaaaccgaaatttttatttgttgagacccaagatttgtgagaaatcagggtaattaggcaatcatcattttagtatcaccagactataattctgtattggaggtggaggaatcccctttattgcttttcctccaacatgagatgtgaggaaaaatttctaaggacaattacaatgaaatcttcataaaacatgaattctttttgccatgaggatttcccacacacatgcatgcataactgcccacaggatggatcactggctgaaggtacttaggcc

SEQ ID NO: 48 - DNA, 205937 bp, Homo sapiens
ttaataactgatatatatctttttattatgcacagataaaagatttaaaactgtggttatcaaaactatacatctaagcatcttcacaaaatagctgacacactgaacagagaaaagaatacaacaggggtgttcaaactggccacagggattttaagggtactcgttttaccctcatagatgatgaaaaccagcaacaaaatcaggctcattcaggaaaaaccagaagagagaagtattgtatttggaaactgataatagtcctttttagaaaaacatctgtcagtttcatgaacaacccccagataaaacaaacatgaaaaaaatcacataggactcacccaacaaaatgtgctctgttaacacaaccagcagtacaatcatcattcaaaccatgaggtagttacagtacaaaaagactggcacgcgtgtgagcaccccacacacactcacaatcatgcccactaagaacacaagcaggaaatggatttacaatcttattacaaggcaaagaaaaaaaccattttttttgtttagaaaatgctatagaaacagtttagacagaagaaatctctggctttttaaaatacagagtaacagctggtaaacaccacatggtgaaaagctatagcgtattatacagacaatctgccttggagtttggggcattttaacaacagcttcagcatcaaacaaacaacaaaatggcctctgcaaattaagggtgtagcctgcagaaataacaaaagactgcagatacaagagttcagctgaaatacaacaatacttttaaagaaacttgtagtacacgttataaaagtagagcttgtactttgtattaaaactgtaaagtgtgaagcaattagaaatactgtaatgagaagctagggagaaaataccttatttttttcatgttcattttttagaaacatttcagaaatacttaacgacattcactctccaatatgagattaggttttatcgacacagatttcttgatctgaataataattctgacaatgagacccaaacaaataaaaggtgatttttttcctctctctctcttttaaaaagatcttttggtttgcatctataaatttgtaaattaattttaaattatttataaaatcattggcaatgtagcatctctcttaaaaatatatatttaaatatattacagaaggttttaaccctgtccttctaagacatcaatcttttaatatctcctaatagctaattttctttttaacacgatggaaaagattttttaaaaaagcaaaggactgatcgaaagaattcacagtagctgaaattaaacatttcatatggagtaacttaaatttatctaaaacacttaaatatatctttatacacaaattttgtagtaaaatatagctataagtgacttaaagactctagtcttctttgaagacatctttaaacttttttatacatagaatatgctgaaacaatacattccaccgaaggttaggcaaagcgcaatattttcaaacacaggtagcgtaatctaggtcctccactctgatacccttctgttaaaaaaaaattaaaggaaaaaaattctctaaactcatgtcttcttcgtttgtatatggaaatctagaaatttttcagtagatcaatgtagatagcctggaaatctcagccctaaagtaatgttttagttaaaatgttccttattgaaaaaaaaaaatgttccttattgaatgtgtatatctatcaggtaagtcatattattactcaacgatttggtaaaaatgattgtcaatttccacatacttgtttcccatgtagacactgccctaaggttttaagcttcatcaggattacctactgaggttccattcacagacaaccaggcataacttccttattttaagggcagtgggatttgcttatgaatattttgggggtagaatctatcttgttctacttatggaattctaagttgtttgggggaaattctggaaaaagaataatttgcaatgaagctatcttcagcagtaaaataatttagcatgataattcccccctggcattctttttttttttttttttttttaacaaggaggtatcactgagcttattttagctgcaaagtggcatcatattattccatttaatgaaattcacctcaagccctttttgacatattaaatatatgggatatatttaaggcaagagaagtaaggcaatccaaatgagtgcccttttccaatctcagcactgtcttggtggaattggtgacactattcagataaccaactggagaccgacaggatttgccatgcatttgcatcttgctacagtttggtttttatgaaagggcctatttttttttaagttgacatattttgagtggaaacactcaccctaccaaatatacttaagttgcaactctaaaagcataaggacattttcaaattttctcttcttcaactgagaaaatgaatgtgccaggtgacatattatatacttgtacttgcatacacatagaaatatatcactgtgcaaattcgtccttgactttataactgaatttcacctcaaattatacattaatttgcagaacaaaatattaggaatgggcacaaatctgtggttcctgattttggtcattttcaatttctgtaggcctgtaagaaatacaaaatttgcattaagacattttgcagtggtgtatgcaagtatgggaagaaacaggaagctgataaggtcatcagcattggttttggcccagggcacaagaaaggaatgttgccttaacacttgtcagggtgcagtccctgagggcagcacccatcaagggacacatcagaccccacaggttgtggcagcaaggtcagaagtgtgcatccagacaaaggtgcaaattagacaggaggatcgcttagaaagcctcaaagcatttcttgttttacatcttggttcagatataaagaatctttggccgcatctcctcactggttctactatctggctattaaccctttaccaactccttgagtctgggtaaaactcagggccccaaattatggatgttctcacctggacaaagcagcattttaaaaactggcatgtgtttcacattgaaaacccccaagcctgtgaggggctggtggagaagaccaccattttagctttctcacatgaattctagtgtggtacagaagcccagggtcatgtttatactagccctgggtgtggggtgaatacaacgggtgatctttatactgaaattcactctgtctttacaagggaaccaaaatccagccctctgagtctggacacgaggctcagccattggtcctgcccttggcagtagctgagctgagctgggctgggctgggttgggccgggttgggctgggttgggctaggccgtgctgctgctggagcaaggcgtgctctgcgtgctgccgatgctgtgggcagcactgctgttttccgaggctggcggggaggtggggacttgctgccttcctgctgtctcccctgcagttaataaagaaaaggcagagtcagagaaagacgcatattatgtatgtgcattcctgaaaagatcatttattccgcatttgccattttaactgatatttttctcaaccagggcagaagcaactagactaggtcctagatggctggaataccttctaaaataaggttttgctatttgttgttttatttttaaagcatcatgaatgggaaaaagaagacagctgactgacaggcagctctagtggctaagacccctgagagttgatgacaaagtccctggatttcagggtccacaacctttgatgaaatcaccaccacttggtctgtgtgagctggcaactgaccagcacctgtattcaggaaacactgtccatcttctctcataaagacactgtaggatttggagggtgtgacctttcaattgtagttaagagaaccctggaagtttgggagccttgttctgaatgcacttgttaaaaacaggagtgaaatatagactttgtcctagctacagtagagagagccttgtgtgccaaacagataaattacctgagaaaccggggtgggggatagctgctattggaaaaaccttttggggaaggggtttagctgtttgcacatggggactgcagttgccagcgaatggcctctcttccccactgaggttccctgtggggtgcagtgtgagtatctcctaacactttaagcatcccacttttcattacacaccccactgcattttagctaaagccattcatcgtgccaaatgtgcagtgctttggagaggaaggaaacctcaagtcacacacatggtttgcatttaacagtgcaaaaggccctagagttagtcttctcttcggcaaaaccggcctcagtgcaaccctcaaaaaatggctctaggtagggaaaagcgatcagggctctccaataaaaaacactgcatttactttgaaaagtcagagcataaacttcataaacttcttgtaagcagcatcccctccttcaatgtgggaaaccccagagggccaggcctgtttatgaatgagcctcctctttcctgtcatgctgaaatacacatctatcagccggagataagcaacccttccagctgcttcattaaaacaaaacactcgaggaaaggccctgccctccagtgcaggaacttggccccattacttccattctctttctggggcccctcaaaagcctctgtgaaaaaagcagttctgcaaaatgtagaactggctcatgtccctgggtctggttacagcttttcctgtcacccctttcatgaaccacacagctatacacacttttgcatcaacctcaaagtatttatgtgcttgttgtaagtttggcccttgttgtacttcctctaattatcttttcttctgggattggcgggatggataggggactggggtcaatattcctgagaagcggagaagcactgcctttttttttttttttttttttttgtgagacggagtctcgctctgtcccctaggatggactgcagtggcatgatcttggctcactgcaacctccaccccccgggttcaagcaattctcctgtctcagcctcccgagtacctgggactacaggcatgtgccaccatgcctggctaattttttgtatttttagtagagacacgatttcactgtgttagccaggatggtatcgatctcctgacctcgtgatcggcccaccttggccttccatagtgctgggattacaggcgtgagccaccacgcccggctgaaacactgcttttgacttttttggaaacctatgttttggaccctccccagcactgccctctactcttcatgtgtgtgtataattaaggctggggaaattagcctccatggcaataactttctgccaaaaattcactttccccagagtaggagctttatttctagaagggaatcaaatctcttaactattctgaggtcaaaacaaaaacaacctccagagacccaaacaactctagatatactttaagaatttgactcccttacaaaccacatgttggtccatacccagctggatcctcacataatcaatcagaaggactaatgtggctatgcatgaaccacattttaaaaatattttttcctattttaataaggatacatctgaaaagcaggaggccaactccatctttttcttttttggctcacctgggctttgtttgctcagcccaacagcaggtaaaagagaaggccttgcttcatcaagcaatagggagcaagtgtgctcctccaggatctgccctgtgcttgattattcacattcaggaaaagtgccaggactatgccctgcccaggaagcctgaatatctgctttccgatgtctatttgccaaatataatttgttgccatgtcagtttattttcatccgtgcccattaaagagacctttcaacttcccgagttttgggaactcttgttctggtaatgcaaaacacttcaaaacaaaaccccaaacaaaacaaagaagcctccgcactcaagactgcaggatgcatctcaccagctggataagtcaagttaacctaatattatattgactttgatccaataatgggccaaggtgagtctctgtctgagaatctgctgggaaatattgaaagtcccctcttcagaccatcctttccagttctgtggctattttcacatgtaagatgcaaggtttctcaatataaccatgttttaaaaataactcttaccttttgacagattaagttttttcactgtcaaatggaagtgatgctacagaaaaattcaccatgaggaagaaagttgaatgtacagatgcttctacttaatgggccaacagagacccctgggttttctgagatgggtctttggctgtctgctctccactgcagtggtctctgatttcgtggagcaccaactttctctaaaacatcccttgggtgacaagtataacaaggctgctcctaaaggagatgggcagggaggacctcgtggctaagcagactaggcccaattaacacatctaagaaattcaaggagggcgccttgcttgtaaataaatatcagacttggccagcagaggaaatgtactcagtcttcctgctttcctcctaaaatatcaaaccacattgagggaacagagatttgagaggagggagagtgagtaggggagagaggaatttggtgcctgacatactctggaggaggagagtacactgaggataaggacactaaggattaattccacccatctcacagttagcctatggctgggcctagatactgccagagatgcctcaagaaatagaaaaacaaagccaggtgcagtcacttacagtgccagcttaggaggctgaagggggaggatctcctgaggccaggagttagagactgcagtgagctatgatctcacctgtgaagagcctctgcactccaacctgggcaacagagagagaccctgtctctaccagggggaagaagaaaaaaagaagcaaaaacaaacaaacaaaaaacatttcttaatggagaatgttttatttctttagcatggcatggagttgcccagatctgacttcctgctacctctttggcgtctatattacaactgtattcttatttctaagtctttcaccatggcaggtcctggggaagaaactattcaagaaagatgtgaatagcatgggaggactctgtggggaaacaagagaagagttaaaaagaaaggtgagggcaagcttggtatttaggccaaaggagactattgcaaatactctccatgaggattattacaaataggagcagacagctgttctttatctccctggagggcagaacatgaggaaatgagtttaaatggcaggactagggatttagatcagatagaaaagaacttgctgattatgaggattggttagttatagagggaatttatggaatctccttctcaggagatatttaagcacaggattgaaaaccatatacctggggacactttagatttaatattccttgatgctagaaagaaaataaagatattttcttctagatctacgtgttggatgcgattttctatcaattaatgtctcagtttcttgatctcctaactgtaattaattcacaagctcactctttaagcagagtgaacgatactacctttaatttagagaagtcttcaatcactttttatcattttcaaatttcattcctccccagcctccacacaaaagactcttcttttgcagcaaaattctccaggaggggtgagttagatgttgttagaagtcacggggaaaagactatatcaagaattaaagtttttcacaatgtcctgcctactactttctttctatattcctgcagtgtggccaacctgtttgtatatggactttggttttctgtggtatcttccctgcctttgtggcccctgaataggatgcaaaatctgataataactaagaagaagaagaaaagcaagagggaaagagaaatcaggtggaggaggaaggctgtcctccacagctatcgctacaaccctgagtcagaaactggacttgaagctctggtttgttcaatggctagacttgctaccttagtaggtatattagttgtgtttccctttagtcaacacagagataatcactacttcacagggttattagggtgagcgtacttaaaacaagaaatgcgtaataaaagctttttcaactttaaggctgctctgatgtgtaagcagaaaaaaaatctaagcgtgtaaggaacactgtttcacagagcataataaaatgctgaagttttgaattaggtgtgcccgtcccaactcatcaggcagttttcaacaaccctccatggaacacaccatgtgttcttaaagcaaaagtcaagcgcatacccaaaagtccacccaagtcaggtaagaggttttcattagaagtagctcgggaggtgccaatgtgttcagaggcctgaggtttctccaggttcccaagtgtagcccgatgaaaagagaaacagcaagcagacagactaaggtgtgataaggtaggaggcaagagaccaagtcccagggatcagacagatgcagctggaacagacggaaaccccaatgtgactgtaaagaaggcaggctccactctcttttcactcaaatgcccatatcattattttataaaaccattaaacacagaggttaagatgaatgccttcggctttcctggtgtctattggtgtgtctttttctctcaaaaaacaaagcacctcccggagcatctggccattcatacccttcccccttcttctcaccctcccctcagtttccataaaaggttaatagaaaacttaattcttcagattagaaacacttcttctttctccagtgagacttcccttgtcagttctccatttttctgacacagttcatcaggtcattgctttcctaaaggttggcatgtgtgcctgtagctgggtttctgcctgagccaatctgcttataatcagtctgtttggttattctcttcctctgaatatatgggaactccacgacagcaaggactttctgttgctcatggctattttaccagtgcctagaatagcgttggcatttaacaatagcttaaaaaatccattgaataagttgagtgaaagaacgaatacatgagtgaacaaaccaaaaaaatttagctgacactaaacagaggcaaaaagaaaaaccgaaacacatgttaattaatgtttattatctgataagcagaaggaggataaaaagattatggctacgtgacctttgaatttgtaataacagaacaggaagaaaagagtgaactctgaatcaagaaagcaagccttcagtcctggccgctgtgcctgggtaactttgagcttgtcacatcagttctctgggctcagttttctcgctacgtaaaaaggaaatgctgatgcagactagtaattttccaaggactccctttaagaaactgattaaaaaaaaaaaaaaaaaaaaaaaagcaagggtacgactttgcatagagatagtgcatttaaaggcattgacttgcattcctttcccaaatcttaccagaatgacagtaaatggacttttaaaggcataaacacatgaaaacaaagataacaaaagtaaagataacagcaataaaatatattggaagctggtgaggaaatgggtgagtagcaactgacttggcagactcaagagagccgaaacctaagccaacagtgggaaaaactgagaaacaagcaatttatgtcgccgaacccttaaaaaactcagggaatggtggcatcaggcacctctggaaacctcccttgaacatatggctataagcaagaggggttggctgaactatatgagaagcagaatagttctctacatttcctccctcgctccactgggctgagatctgcccttcctaatccaggaagaagacgggaattttactctcttaagaggaggaaactgaaggttccagaaatgatcaacaccaggcacatttgagggcaagagtaccacattcaaaagggggggattcggcaaacatatattaatacgtattttggctcacctgggcttcttttgctcagcctaaaaggagataaagccagatggccttgcctcatctagcaacagtgaaactctgaatcaagaaagtagggttccagtcctactttgtaacaaatttgtctcctgcagaatttgccatgcgcttcactatttgcattcgggaaaagcgccaggattataccctggccgggaagtctggatatttgctttccggtgtctatttgccaaatataatttgttgccatgtcagtttatttttatcagtgcccattataatggtctttcaacagccagtcctatacctttcaagcaggaggcaaaaaaacatattttatggaagcctgaagagctaaagaggaaagatccaatgatgaggtatcagggattcatcaataaaatggcccagtcagatcatcttaaagaagttcacaatcaatacatcccacccacagcttagaatttcctcattctttttttttcctcattcttaaataatcctatattaatattctcagatgatactgcacccatgaaacaagaatagaactttttttaaaagaaaagaaattcacaggaaaaaagttattagaattaaaaaagttattggaattaaaaaatttgaagccagtattaaaaactcagtaaaaaactgaaagataaagatgagacaatctcccagaaaataaagaaagcagacacatggaaaacaggaaagaaaggaaaattaaaggacaagaggttcaactttcaaataaaatgatttctaaaatgagagaaaacagaaaaaagggggtgagaaaaaaataaatcattcttaaaaatctcagtactgaaagatatgagtttctaaactgaaagggcccaattagtgaccagcataatgtataaacatacacctaactcaagagatatcattgtaaaatttcttccagaaagaaaaaacaggttatatacaaaagggatcaggaatctgcacagctctgaacttctcaacagcaatcctcagagctagaagacaatgaggagggctttcaaaagtccgaaggaaaaagtgtctataatctaacattctgtaccttgccaaactgtctaccaggtgtttctgttaaatgaggatattttcagacatgcaaggtgtgaaaaacatttgcgtcctctgtacgctttaaaccaggaagaagaaaggcaggagatacatgacacaggacatccacaactcaaaagagaagtgaagggaatgcacagaatggtagcgaagaagatcataggaagacagcagtgtccagaaatggagggaaccggttcagacaggagcaggtcagaggctccaggaaagagctgaagaaaaggaatcagtagaacattccatatgtctcaatgtattaaaaggagattgagacagctggcagggtcagcagaagaattaatgataaatacatagaaaattaagctgatgactgaggaaggagaatggcaggaacctgagaggcggagcttgcagtgagccaagattgcgccattgcactccagcccgggtgacagagcgagactccgtctcaaaacaaaaaaaagaaaaaaaagaaaagaaaattaagctaatggggtagggtggggaaagataataattaattctagggaaaattaaaagtcatgcaggatattatactacatgagttaactgtgattagcatttaggtagtcataataatgtaaacagtaaatgctgctctaaccaaaatgtcagtatatttctattaagaggatggtgggggaaggggacattttccataacaggaggtctagagcaaaggtgtaaacctgcaaagtcaaaaagcagcaatatactcaggttatttagaagtatggattaacatccaaaaggatgagctaagcgccaaaaataatgctctggggagtgagaaaagaaggtaaggacagtaggggtgtgatttttttttcataatgagtcttgtaggattatttcaacctttaaactatttgcatgtactactttgatgaagctaaaaagttttactagaaaataaaaataaaagcatttgttcctcccttcaagaaaaaaacagataagattttgcatgtgactttagggaccttcatggactagaagttagggacccctgaactaggtagggttcctaggagcatgaacattctatggttccagcaccatttcagcccccaagcacccctcctctctacagcatcttaggagagaatgtaagttttaggaatggagttttccaaacagaattaatccagccttaagggaatatctcttattgtgcccagagttgtcatatgataaagtgggaacccagtctttgtagagtaacacacattccaggtatgtaagtagatatccacaatccaaatttgtgacttggttttgtgctccgtgctgcacatggaatggaaagcgtaaacaaaggaaaagttattcaaattaaggattgtttttcacacagaggcagatgctatctgaacccccaaatacagcatatacgatctgtgagttccacagcttcaatcactgttgaaattgaacggactgagtcagtatttgtatcctggctctccccattgcccactgcattataatcttccttattaatctaaattgctgctagctgacccaggtaacaaactgaaggggttctggaaaagaactatcatgtggtcctgaagtgagtcttcttcatgcttgtatgatgctggtattcctcaagagcaatctataaaatgaaccagaggctacagtttttaataaaaagtaattttgaagctgtctcataagtcatgccaatggattttaagcccaaatgacagtgtctataaaccttttaccttctgaatcagtgtaattcattttgctggaaagcatcacaggagggaggtctttggtttcatttttcttaaatttacttacaaacctatttctacattaacagtacttgaaaggccctcctgaagtctctggcttgggggaaaaaggatcagtaacaacagacttccaaattcaatgaggatgaatacatgccataccaccaagttttgctttttatcaggtttgtgtgcttggctgtgggtaacagtctggattattggggggatttcagtggggcatgttccagtagtgagtattatctggttgccctatattctgcctggacctggcttcctggcccaagattagctatgagagtgcagctgtgtgaccaaggccagtcagtggctgagcaggcacatggtaaacatctgtgggtgacccagtcttcttggaggactttcaaactcactcccaacagccaacacaggctgccaacagccctagaacctctcagccaggcaggaggttggaaaagttgcaaagaactgttagcttgagatctgaacatgtcggtattcctgcgacaaaattacttactttaaaatgctgctctgctaaattctgtctttctggtccttttataaactgttcatgagggagaatcctcctaaactgattcacagatggttatataatactccagaatcatgacactggagtcttatttattttgagacaacttctctctctgtcgcccaggctggagtgcagtggcaccatcacagctcacttcagcctcaacctcccaggttcaagcgatccccacctcagccagctgggacaagagatgcacaccaccacgccatgctagtttttgtgtttttttgtagagacatggtttcactatgttgcccaggctggtcttgaactcctgggctcaagtgatcctcccgcccctgcctcccaaaatgctaggattatgagaagtcattttttaatctttcacgtaaacatactttactcaaagtatcctgactaggaacaagcatttgaggactcaaagtctctctattcaagtcttctacatttttgccaagaggttgccttttgggtgaatgtcccatgctaggcatgaaagagtccattcctctccttctggcgtaatctaaaatacctcaggcaggagatgtagtatttaaagtgaaaattctgatttgaatctgacacttttaactatcagaggatcactgtgtcatgcttttattctcaacagcttgacgttttgtctagcaatcaagagggtaaagatatgactctccaaaatatccttcagtacttccttcctctttaaatcagccatcctttcagcttggcccaaggggaagccaaagatcatggcattcattggtttaatggacaattaatgaaattataaacagagaagctgggcctgccacttgcctctgacggatcaatctagcacagtttatctaggttcacagtataaaactacaaggatccaagaacaaacaagaacaagaccgattttatacattctagttctccagaatgccgcaaaatgcatgtcactcctgcccatagttgaaaggaaactaagaaagaatcaatagcaggacaatccatttgttctttctccattgcactaaagactccctttgctggcctgcattctgtattggggtcagaacaggttctctcatcaggctagtatgtttcaaccttgggattggtagggaggagcacatctgaattttgaagattgagggataatagcttgaaaatgaagtgctctgtttcatcactttttttttttttttcagttcatggaaatctatttagaaaatttaactttatagaaaaacatgaaaattttatgttttatcaaagaagacatagcatgggttaaaaaaaggttgagaaaatctggtttaagtcattgattaaggactctgatggacagtgctcaataccttggcaggtgtggtaataaaatcttggctttctttttcacttcctctcatgtatatgcctatccttaagtctttggttttgacggaatggtttgtatttctgtacgttgtctgcattaaccttaaactctaacaacaaagtagctttattagcggctaaatttcaccaacatcacaatcgcaattagcacagtttaaaccttccttttctttccactgtttatggcaaattatacttttgtgaaacccaatttataccaaatatgtaaatgtaaaaatagtaggaatgaactttctctttcattcgttatttcatccaacaaaacactgagtgtctattgtgtggcaggaacacaagctgttcaccaactcttactcaacagtcacactaacctgtgtgagaatagatgtaccacaaggcccccgtcaggagtgctccgatcacaaaggctgcaaacgcaatgcccatcacggttagggtgtccagaccatggaaaattgctataaaggagagaaaccgatacacacaactttttggttagtctgcatcatgcattgcaattttatatttgtttcacaagcactgtcataaaggttgagcactaataaaatcggagaatgcaatgaagattccaataaaatacactgtattttgtaacttgcaaatttttttcaaaggttaaatgaaattatcaggtttccaaagtattctcagtttgcaatttattttgatcaacaaactaactaaaaaatcagatttgcaaactcagtaaaatcttgtctgtcatctcattgtctcactctaaggacctactatttgaatggagggtagcttgaaaattcacaggttaagatgctttggaaaataaagtgaacttccatgatcaaaatctggcttactgctgcttattcactgaacatctccaaaaatgacacactgcacagaaaacacacaccttagaatactttatacacatatttttgtgaacatttacaagtatgaaagataacagaaagaaaggagaatatagaataaaaataaactattcctgtggattataacatttcaccgatctcctcatattaaactcttaatcttaacagcttcatattgtatcatttaaaacaacctactttttaacacttttccaaccatgatctttctataaggggaacggaaatacttcccagtggggagtgatgtcagttttatggtcagcaaaacatataaatagaaccaattgtttctccatttggcaaaggtttttatatttgaaattaattccaggccccagaaatagaacatttcctttcatttaagagaactaccttctttgagtcacttataaaaagttaaaattggtttccaagggggaggagttttaggtagaatacaatttctaaggtctctgggttttgaatataagtgggaaatacaggatctccccactattatcatattatttctactttctgctccagtcagaagcaactccagtgatctctgtataaattaaatccctgcctttcaactcacttcagtgtaaagaaagctattttttttttacattgaagactgccatacactcctgtgacctttgggcagcccagcactccaaaggctcggggaaagtatgctgtggtggaacaagtctggaaggatccgaactcccaagttctggtccccactcttctagacctgtgctctttggtgtgttcatttaccttctgaaaaatgcggatagctttagtcacctgctgaagtcaggtggaggaagaggtgggaagagctccctggaggtgaagttgaaccgagccatcaacctatttaatctagtccttaaaactgatattagaagatgatttgcctttttatacccacagatgcaaaaattgaacatgattacaagtttttaatgaaactattctaaatctccaaagatagatatgtgtccatatgtgcctctgtttgagttcatattgttccataatttaaaaaaaataatccacttaagacaatggtttatgaagtgctttgtgaaaggaactttccagactgattgttaaatgtagtgaatcagccacggagactaatcctgggaatcttaggaaaggaaaaaaagcacagattcacaaattctcctcacaagacaacattatctagaagagctctgggtggacagctgggaagtccaggttgaagtcctgcctcaatgccaatgaggcaggaatatttctgggtcagcattttcttctgcataaaataatgaaattggcctagacaatttccaagtccttattctgcagcaattggtgttgctttctctttcattcttacatgctcttcctggggcccccagcccttgcactacggattgtcttgaaagtatagcaatgagttcccttagcattacgcctctgagcagataaatattgttgataagacttaaagcaaaccacttccatggctgtatgtgaattcttgcaggttagagcagacataagcatgcaagtcattaacttgtctctctaaataagttactaccttcccattcaagccatacatgccaatggatcaacaaattaatattttaaagtggtaaaggtgaaagggaaaaagaaagcagggataaacaaaggacagaggaaaggaaaaaatatgagcaaaaaggggaaaggggaagggggaagggggaatgagagcagaagtctccttatcaaaactcaaagtttggcaaatgttcactaaccaactcattcttaggaaagcccaggaggttttatttcgaaatagttgcataaagacttacgtggagaaattggatttggttccttcatgcttggacctttttctgaaacaaaaacataaatcacaatgtattctatggagaaccaagatttaagcaaagggtcatcaaagtctcagcagaaactgacacttttccatttggtaataaatactgtgagaaagctctgtcaatgatcctctttagatatcaaaactataatgagttacccagaaattttaagcattgcattttgttgacaatcagttgcataggctctccaatttgaagaaaatttgaaggcaaacacctaaacttagggaatttgggtccgacaatttgtgtgtgtgtttgtgtatatctttttatttacttacaaaaaaattcaatacctttaagtaccatgcttttccagtgtagtctaatattattctgctttcaaaatattctttttttttttttttttttgagggtctcactttgttgctcaggctggagggcagtggcgccctcagctcactgcagcctccgcctcccaggcaatccttccattttagcctcccgagtagctggaactacaagcatgtgccaccacaccagctaatttttatatttcttgtaaagacaggatttcaccacattgccctggctggtctctaactcatgggctcaagcaatccatccatctgcctcgacctcccaaaggccgagggactataggcgcgagccactgcgcccagccttcaaaatattcttttaatttaatatacacattttctaaaagtatctttgttctcctagccttagtgctattatcctatagtttaactccccttcattgctcatcaggattatcacagaggcccccttatctccaccactaccctccccccaattatttcctcctccacatttgcccccagagtgaatattctagagcccagagctgatcatgttataaccctgactaaaccccttgatgactctccttcctttatagggaaaaaaatccacactctttaacatggcacacaaagttctccctcccttctctatcctctctctccagcctcctttcctgatggagtccttcacccatggtgggctccccatacttagtaatttaagcttcccaaattctctatgctgctctttgtcatcatgctttgcaagccatcccaagacaccctcctccccagacctgctttgttggcattttctctgggggacctttgctgagtctcccactgttccatctccatcccagcagagctagtctctcccacccttgctcattccatccctcctctgttacacttgggccacaatacctcctagttctctctctctttttctctttcttttgctttttttttttttttttttttttgctgtgagggcaaggtctagttctcagtcatctgtatatccccaagggctcagactggcatagaataggtcttccagaaatgtttggtgaaggatgattaaaatgttaatgtactttttgcaaatggaggccacagaggaaaccagcaatcagactatgaagacgttcatatgcagtttgcaccagtgccatgaagaaggcagaaaaaaattttgtatcactgttttggaaatgagcagcctgagactctgatatcgtgtgactagagcccaaggtcacagctggaaagcatcagggcagaagttgaatcagaattccagagttctgcctagcaggctaaatgactggtgagcgtagctctgtccctagctggggaagcactgatgaagtaactatttgtgcacagctactcattatcctcagcagtgaggctgagaccagcggttgagatattatggtccaccacctatttttgtatggcccatgagctaagaatgaattttatattttgaaatgattttttaaaaatcaaaaaaggatatttcatgacgtgaaaattatatgaaattcaaattgactccataaatgaagttttatatggatgcagctatgcttatttacatactgtctatggctgctttcatgctgtaacagcagcgttgagttgttgagacagggattgtatgagccacaaataaaaaataatcactatctggtcccttacagaaaaagtgtgctgagtcctgctacagaccttgaccctactctttggagtttaaaagtgatacatgtttagcacctctcttttcatctccattttcattcaccacagaaggaacacacaccttatgtctgaattcacagggaagcaaaaagaacttgggaaaatgtgacccaaacaagcagcatctgaattgatgtctataaaaataaagaagctagacaggataaaagaaaacagaattgtaaattctcaggattaaccatctccgatgggtgggtcaacattctggccacatgagttatcaatgtctggctctaggggaaggaatgctactggatgaatcagagccaccacaattgaatggtgccccctggagttgtgcaacatagtggccctggaatgaggatatatgcaaaagtatacttaaatacaattactaagaaaataaaaatgattgtatgtttttaagaaaatctaattcagtatgcagaacacacactaattacgctaactacagaatgcactaccctgggagctgggtcccatcagcctcattggcaccaataacaacaatgatgccttacatttgtacatttgtatggtgttttgcaatagacaaaaagccttcggccttcacttatattgtctcattttaaactcccaagaactctatgaaggaagagtatctacccacaaacttctcctttcaagacgtagtatttgattccctgaactaagttcaaaggcatttaaaggttgctacaagatgcatcatgtaagaaatatacacacttctgggaataattccatccaatcaaccacccatggttaaactttctcactcagaatccccaagcggttgaaaaattatgactctctcctaaggagacctcccatgtaagagtttaagttttatagtaaggcctgtgtgatggatggcattgttttaaaattcttaatggatttctgttatgatctaatcctttacccccaccccaaataggagccttctcacagagctaaacagaaacagttgttgttcatttcccctgggtgaagtctcttcgtgatttctgagcacaaacaataacaagcagaagctgcagaactgaggttaaagaattctatcctcgaacttttctcttcccgaatccctaagaacccctgagtataactaaaatggcttgatctccaccggaaccctaccatcgagttggcatgctgagaggaaaagagtggactcaacaatatttacttttggtttaaggataagattaagattataagaaaggaatcttagctattgctgtaaagagaactgtaacaataaagatttctttacagaaaggacaaactataatcaatgttctgaattaaatcttttcatatacgctgagcaaattttggtctacctctagaaccaaaattcccctcttcagattgttcagcatggttttcataaacgggatatttctggggttatgcatgagtaactgaccacagcttttggcctttagtgctcaatttggtactaggcaccataggacggagtgggcccacagtgaaacaagacgtccaactggtacccacatctattggcatttggcaaagagaagaatggggagaggaagattcctcctggagactcaggaggtctttgtgcaggccccatttaagacagagtttttactaacttaacgtcactgtaactgaaccctttttctggattctttcaatatttatgatattcattgcaattacttgttcacttatctgtatcctgccactagaccagtgtgtctcacgtggtgggtgatttttattccaggggacatttggaaacgtctagagacattttgaatggttacaactgggctggtggtgggagggtgttgctactagcatgtagtgggtagagaccagggacactgcttaacatcctgtaacacacaggcagccccccaactacaaagggtattccagcccaaacactgattgtactgagattgagaaactttgcactaggctgtaaaggccttaaagacaagataatttgtccactatacacctaccatatttttttgaataaataaccacaaatatcacgtatattttattcttgagtactttccccagcaatgcaaccttcacaccattttcagagtagccttcctaaatgacctaatcgccgggcgcggtggctcacacctgtaatcccagcactttgggaggccgagacgggcggatcacaaggtcaggagatcaagaccatcctggctaacactgtgaaaccccgtctctactaaaaatacaaaaaataaaataaaataaaataaaaataaatgacctaatcatcagtttcctgcttgagatcttctgatggttcttaacttttagaggtacatactggaatatgtatggatgaaattaaattaaatgtctgggtttccttcaaaacaatccagtggatgacagaaagtgataaaacaagattcaccataaattggcaattgttgagacttattctatttttgtatatatttgaaatttttcaaaataaaaaggttttaaaatgtaaaatactggccgggagcggtggctcaggcctgtaatcccagcactttgggaagccgatgcaggcagatcacctgaggtcaggagtttgagacaagcctggccaacatggtgaaaccctgtatctattaaaaatacaaaaattagctgggcgtggtggcaggcacctataatcccagctacttaggaggctgaggcaggagaatcacttgaacccaggaggcggaggttgcagtgagccgagattgcgccactgcactccagcctgggtgacagaatgaaactccttctcaaaattaaataaataaataatgtaaaatacacgatgttaaaaaaaaaaatatgatatccctccttcccttcttggatagagaatgaatgccctggtctgtcaattaagcatttctaccatctttccactcagtttcccctcacctcgacctcagctcgaggacaaaacctggctggtcctttagagtatttttattctggaaagatcaaatgtgttccaaaaagtaatgcctctcttggatcaacttccaactgacgttcacaactttcccttcctcaaccctcccttcccaaaaaacctctagtttgctgagaggttgagaggaaggggaggaaattaacatttactgagtatccaagatatgcaggcatttttattttttaaagttaggtggtgaaaatacggagaaaattcagtatctcaaacatttaacttgctaagaattaaacacatctataggtatgtaaatcacggcaaattttggaatgatatttattgctcctgatgacatccacatccatgctcttctgtgtatgtgcactgtttcagagaaatggttactcctctctttcacaatttaaaaaaaatcatcaccgacgtggtgtaatcatttttactgtataagcccaagtgttctcaaatgctgtaaaaagcggtcacagaatccaaggcaaacagcactaatatgcctatacttcaaaatttcagaaaatagggtaggatggcaccacctcaactattttaaatgttttgtcataaaccataatatgcataaactatttatgttctctgggctttctgagttactactgaaaatcacagaacttctcctgaactttaatactctgctaaacaggttacacatttcccaacatcttaatcctttgggtgaacagacatttttcctaaaatccttcatcttccttttagttcataatcattagggtatttggggtgttaccttgaatactaatgtgatatggtatgaaaagggagaagagggccaggtgcagtggctcatgcctataatcccagcactttgggaggccgaggtggatggatcatctcaggtcaggagttcaagaccagcctgtgcaacatggtgaaaccccatctctactaaaaatacaagaattagctgggtgtggtggcaggtgcctgtaatcctagctactcgggaggctgaggcaggagaagcgcttgaacccaggaggtggaggttgcagtgagccgagattgcgccactgcactccagtctgggtgacagagtgagactttgtctcaaaaaaaaaaaaaaaagaaagaaagaaagaaagaaaagggagaagtggggcaggaagaggggtgtgaagacatagatgcacatgattctagttttcagtaaaaactagaatcaacctccatctggaataaggcatagggtttaagagcacaggctctggaatcacagtgcctgaatttgaatcccagatccaccatttatatgttgtgtgcccttggccaagttatcactatacagaggtgctatgaggataaaatataataatccacataaagcatttagcacagagccttgcacaaagtaaatgctcaacaaatgttagatcatcatcctcatctccatcactatcatcaccatcagctttaaactttcatctattgttaaaaatttaaatggtaaaagaacgctaacccaacactgattcccaagggacttagagatcaaaagtggcaaagatgtgctcaggaaggttccattaaaaacagtggcccagaggaggaatccagaaacatttttatagtcttgattgcctactttcctgtccacagaagaaacactaaagtatgtcaatgctattggcagtggtggccacagagcagctctctgcccagctgtgaagttgccaaccagagcctttatctgctgtcccagaaaatccaagtgttgaaaaataagatgaaccaaatgaccagagagagctggagttttggcatggccttcaaagagcacctgtgtagtaaaagcacagtgaagcgtcccattggttaggaaatttttacccaaaaagtcacagattctacaataaagagacataaagctgtctgacaggaaggacattcgtgacctgttattattcaaataaaccaatgcaattaggcaaatggtcacagtctcttttctttttttttttttttttgagacagagttttgctctgtcccccaggctggagtacagtggcgcgatcttggctcactgcaacctctgcttcccaggtttaggcaattctctgcctcagcctaaagagtagctgggattacaggcgtgtgccatgacgcctggctaatttttttggttttttttttaggtagagacagggtttcaccatgttggccaggctggtcttgaactcctgaccttgtgatccactcgcctcggcctcccaaagtgctgggattacaggcgtgagccactgcgcccagcccacagtctcttttcaaatgactattccaattcaccttgaggcagaaagcacagactccagtggtctgcattgaggataaatgatttagagtcaaaagaaaataaacttaaaaggtgagaggagtcacacacagctgaaacctgccagaaaacttaccccagtaagcgcaaagttagaaagcaaatttgcatacagcccctgggaagctggcctacagtttaaccgcctcaatttatttaacaaacctaagtaataaactttcttcacccacatgcttctcaactaaaatctagtctcaattagcaaatctcataaaattgctttgatatttggtaaaactttcctcttgaacttttatacaagaaaacattgaactttcagtacaattatactaagtttaaataaaagtaattacctaatttgcaagagaaattacttagaaaaatgtcaccaggctcaaaagaagaatggatgaattgctggaagttatactgcggcaatattaatgcctaattattgtctggcatgggaaaaagcaagccgctgccttcaattactagcagaattacctctctcaaaatagttacgagtaacagatggaatccgaggtagctgctcttattgttaaattatcagagacatttgaaccagagcaactctaccttgaatagggctgggtaaaatgaggccgaggcctattgtgctgcattcccaggagtttaggcattctcagtcacaggatgggagagaaggtcacaagatacaggtcataaagaccccgctgataaagcaggatgcagtaaagaagccagccgaaactggccaaaaaccaccaaaaccaagatggcaatgacagtgacctctggttgtcctcactgctcattatacactaagtataatacattagcatgctaaaagacactctcaccagcaccatgacagttgacaaatgtcatagcaaagcctagaggttaccctatatggtctaaaaaggggaggaaccctagttccgggaattgcctgcccctttctaggacagctcatgaattacccaccccttgtttagcatatgatcaacaaataaccataaaaatagcaaccagcagcctctggggctgctctgtctatggagtagccattcttttgtttctttacgtctctaataaacttgctttcactttactctgtggactcatccccaaattctttcttgggtgaaatctaagaaccctctattggggtctgaattgggactcctttctggtaacaaaatcactttcatagtacaaaatggagccagctgctgcccaattgtgattactctgcaacacaatttatattcttatttctttctcctgaacccaataaaaaggaactatttggaccatccatttatataaagactgggtctattataactttcaaatggttgaaaaccaatcaataaaagtaaaacaaacaacaacaaaaatgttgccgagaacatctcatgtacacttcacaacaactttaggacggccagaaaaatgaattaaagattattttgcttcttcaaacagcatagttgagtattacaactgaaaggaccttttggaagtcacccagtccaaacctctcctttccagatagagaaaatgaaacccaaagagctggtggtaggggggttctccaatgtcccacagccagttagcagagaaagctaaaagcagtgccttaggctcccagctccaatccagtgtgcctgccacctatactcttctgccattttgagggagcacattcattcataggaagggggcagatgccaccaccagatacacaattggaatggcacagctgttttcacagaggttagtcaaccaataagacactagacagtacctgcatgcctctgttctggtaggttctgcccactgtccaggggtcacccctgctgcctagtcttgccaaatcccaatccaacatgctcagatcaggaatgccatcccagggccacaccaaaccctagatctggtgtcagcaccacccagcaggccttccagctaataccctgaaactggagccagacagtgtgctggcttttgtcaaggcccttggtgcccaggctcctctgtgcccctcagagtggcgagaggcagcctgtagctctaatcctgaaatatctaaccccgcttggaatccactttcactctcccagccttctctcagtttgacacccttagatatcaatgttactagatggtgacaactgtaattgcctagatatcccatgtgacatttggttccacccctcagatgctgacagctgcctggtgtgtccttgcttgtttataacccttggagctgtgatgcgggtccttgtcagatgctcttctcaccgcccacagggcctcatatccactcctaacatttgttagggcccagttctgcctctctactgctctggctggccagacccatgccaggtctggctctgccctgcctgtcctctcaggtactgatgccacaccccttagggcacagccttccttttctcacagaagatacagcttgctgaatgttcctgcttgtggagaaagaggcatgcttggctccaagcaacaaatgtgattgtgcaaaattctgaaaactgaattttaagatgcatttgggcagtggttctcatctgttacacctaagatgaataatgttcacatattctcaaaggcatttgcaattttgataaagcaatacaataggttatagccagcataaactttagcagtagatcacagaaagatgaactgtggattgtgtgcaattcccgggacatgggactaactagaacccttttttgcatactcaaggaagcatatttgaatgcaagggagagtgaccttatgacaggaacaacctagacctgattctttttacagaggaaatcattttcaaatagattacttacaactaagccataatggctgtaagagaaccagctaaagaaaagactcttcgggcaaaaaatggtcttctaaagtaactaactggccctttagttatcttgtgaataaagctggactttgatttacactattgggtcttcttaacaagcagagctcaggccccatgctctgatcgtgcctcccaaagcacacctttagattctgcttcatggtggatcacagcaaggggcttagtgaacgtcttcttattctgcatcatggcccagattatcgaggcgtccagcgaggtgcaggcttcgtcaggaggcacacactgcagacaggcagaacaaagcacagaatcaggggccactcaaaagtgccttcaccagctctacctgcacagctgtcctgtggccttttatcagacagcacacagctgttcactacagaaaagcaagaaggtgggtgtttttcagagaacaccaaataacctgggagatatgacagcaggcccagtggatttttggttgtacctgaagatgcaaatatcactggatagcttctcaatattgtcctccccctccccttcttctcacaaaactaaacattttagtgttagtttgaaaaacagaaaaactatatgcctagtgttggtcctcaccaagctgggcttcatatacacggttcatgtttgtgattggtgattgtgggaaatttcccataaagacgctcctcaacttatgatgaggttacatcttgacaaacccactgtaaactgaaaatatcactaagttgaaaatgtgtttaatacacctaaagtaccgaacaacacagcttagtccagcctactttaaacatgctcagaacacttacgttaacctacagctggaaaaatcatgtaacacaaagcttatttcataacaaagtgttgaatagctcacataatttattgaatacttagattgaaaaacagaatggttgtatggggactgtctatactgcattatgaaggtgacagattttacatttttctccaataagataatcatgttgctgagtttgtttcatttttaatcctggtataggctcatgtaaaactaaactttccagggtcatctgcttttaatgtttcaaaatgcagatcctgggggctgtgcccaggttgtggaggccatgagattagccgcttcaaacctattaatgagcatgctcaggcccactacatctgttttgaaaaaatatgatcacactccgcactttttctttaaaataactttgttttcttgtctatatttatcaataggtatagttcttttttatttttcttgagacagggtcttgctgtgttacccaggctggagtacagtggtacaatcatggctcactgcagccttggcctcatgggctcaagtcatactcctgcctcagcctccccagtagctgggactacaggtgtgcaccactacacccagctaatatatatatagtagtgacaggggtctcactatgctgaccaggctggtctcgaactcccagcaagctgccaagctcagcctcccaaagtgctaggatgacaggcatgagcccacgcccagcctaataggtataactctaaagtaaatgacagcttctatggtaagaagacatattaatacagccatcattttaagtctatagcaggcatcccaaaaagctaatcaagttccatcttttccaaacacaaaagagcaaagactttaggccttgctgtcattgctgctctgagcaacatgccagtcagacacttcttataagacaaccctcactgccctactcttaccccctcaaaaagagaaaagcctttaacaagagccctcttgtaaagaaaaacaacaaattttctgtggagaggcatgatgactgaaaagagttgcattttgctttcctgttttagtttactgttactttcctattgagctcttcagttaagcaagagtctatgattccgcatttaactcagtggagtgtgaccctgggcaagacactctgctctccgggtctcggtttcatcagcaaagggcagggttggtctcaacaatctctgagatctcttcctagaagattctttggcgctctctattgtcacagaaagcactcagaaaataatagaaatgtgaaaatattacctataagcagcaaacagaaagacagtggtaacagctcatccaagcctctgccagataaagggctgtcattgtacatactgtcctatttgctcctctacccaggagggaagccaggtatgattataacagtatatgaggaaatacaggctctaaggggtccagagactggcttaaagtcccattggtggcagcagagcttccttctcagtcccaggctctttccatgttatcttaccttgggggtaaagggcgacttgaggtttagggttatatcccatcatgtcatcccctgaggcttagaactctctttacgattaattttcccagattaacacacatgaagctgggctgttccaggccaggtcagagagaagtaacagccaaagccacagcaaagatccctggtaactgctaggtctcccctccaagacctctaacccttaaacgttacccttctgcccacaggaagcagctggtcccacagccacacatgaagctcctcatggctctctaccactgtccactaagccccaaccctgatggtgaatgcctacaaggctaaggcatcaccgccgcaaaagcaaacctaggaatatagtctaaatcactgtatatgtgctccccaatgattatgatcatatctgctctattttcgtatgcaaacaaaattctcttgggtgttatcagagaaaaggatgcccaggggactataatgatgcaaggaattcagatcaattgtaatctatttggaaatggtggtttttcctcctacctccatacctaagacttaaaatctgtgagttaaatgagaaaattccatacatacattattaataacactgcttgattcttagccttttagacattgatatatgactgcgaaaggactggaaatcagtttactctgtgtgagatagccacagaataaatgcacatatgaaattatacataattatggcagatcacagaaacaaaactatggcagaagatacctttcatatacaagaccaacctagtgggtatcatagttaaccttgcagatctcccctatcaaatgcattccaccaaggtcaaatggttctgctttttgttatggcaatagaacattcaatctggagagtgacaggaggcaaatatgatgaactgatatgaaactgagaaaagctaaaatatttgttagtttcccctagaagtctccctgagacaagtcaaccttatatttcacacagaaaaggttaaaaaacaatgacaatgccagtcccagcaggacctggaaaaattaattctcacaatgaacttgtcctttcggcttgctgtgtttttggcctgcaaactatctgaaaagcaaagataaagccagaaatctccctccatggaaaagcgtcttgatttatcactcgtaaggtactactaagtagcacgcatggaaaaaagaaactcatgctgtcaggatttattatctaagactccataaaactcacagttccctgctaatagtgactttaatatttcagttgggcagttccaaaacaaaaaacctcaacctgcaagaccttgggattaaacttttctgcctcacctaaaaatgccaaaataaccatccgaatggatgaaggcccacaaaccttaggcaacttctgggggtgcttctccatcttcgtacacagcgtcagctcacactgtagaaagagcagtgaggtgttgaagacaggcttgaagacaaagctgaatcgcttcttatccatgtcagcttgcgggataggaaagtgcactctcttgggactgtagaatttcacagattcatctttaggacaaatattctcaataatggtgtaatgagacatcctatcagggttcgaatatggagagataaagcacgtttggatggcaaatcccagttcttgttcagccttagtaacagatacctatgaaagaacagaaagatgaattaggaaatgagttagcatctcactttcactttaggcacaaggaccatatgccaagacagcccttcagatgacacgctgctttatcttcataacatagttatagccttctttctaattacaaaagtaacacacacacattgaaagaaaaagatattttccacttcaatttgatatagatgatgacagtgaattatttctttcaaatattagtccattagattcaaatacaagatgagtaagtctcttccacctcccaatgagtcctctgagagctaaaaataaaaacatattttgcatttaaagtggattttccgaagtaaataaaacaccagtaggcaaagtccctaatgttttaatagtacaacacttataagctaagctctttttaaagactgaccaaaaaatagagttcagcggcaaaatctatttaacctaggcaggaagactgagcttctaaattgcaaaaagtcagagtaagcctgatgagagtcctgcttcatcggcgagaaggcagagctggctccggcgctgggtgtcagtgacggtgcaacctggaggccatcatgggcctggtaaagtgtcccagctgctcacagatccaaatcagccttgccaagtactcccccttcgctccataagcccaggggtagtttaggggaaatctaatctggaaacgtttccgactcatttatacttccccctttgaaaacacttgtatgggctacgtccaaattttgttaaggttcttttccttagaaacaggaagtaatgtttagccaagtgtaaacagaattcaaacctcaactatcctgaacttagctaaaatccccagaccagaggagattctccatttggtgacacgtggatcactgcatgaactgcccctccctgctatgcctcattctttgactaaatttaggatcaaaataaacttaaacacttgtagaaacagctagtccttacccatagaccaacagccgcagaatcatttcaaaagacatggagatagaaacagactttccacgctgagatacccaggggaaacccctgacatcacatggggctttgaatccgcagcactgttgtgaaagattcctacgtggtggttaactgcaggacactcaacagtgaaaatgctaatgaagaggattctgataatgtcactgtggtgacattctgtaaatactaacacttcagtatttttgcaatacttctgaaaaacaagatattctatcttggaaaggtggcaaattacatatgtgctattactaaaaactgccgtttaacatgaactcagaaaccacatgccaaaatgtgtaacagagggactgcaaatctcttctctaatctcaaaagaaagtatgtagcggcagaatgtctaaggtatcccaaaaagggatacctttgtagcagagggaaaaaatatatattattttttaatatattttatgtatatatagtttatatatataaattatcagcaaatcttttactaaaaaggattttacttttagaccagaagtgagtaggagaaggactacgggctttgtagtgagacgagctcataaaaattacatgctctcctgctcacgtgctgggcaccgagactcagtttactcacctacagaatgagaacacgaatacccacaagatatcataattgtgaaaactagcaaagtaaaagttacatgcaaacaacacagttcccagagtgtcaataaatgctacctattagtaatagtagtattctagatttaaaattttgggttattaacaactgggtttgtaaattccccaagacaaatgaaccaaaagaaaactgccattatgtgaccaacagtcacctggagatgaccaatgaacaggtggcaacactgttaacttggattatgaaagggactgtatggtgtagagggaatagaggataaactatgagaaatataggtgatatatgaaaaggtataaatgggaaaacaagaatggaaaaaaaaaactaccaataacacacttcaagtaagccagcatttgaaggatgggggaaaaaacccaaaatatccagggtaaggtacaggaggaagattgaccactgattagcataaatcagcaaagccaggcatagatttggaaaagaacaatctgcaattatgcagcacccctgaaatccacagcgcaatagggtgctgttgaccaactgcccatgtgaactgtacagccagaaaagcaagagaaaaacagccatcttggcttaggaaaagcatgtagaaggcagtatattttccccaatggagaaagaaggtgtgctcaaagaaagagaactctcagaatgggggaggggcagaatccatatgatcaaggaaaacaacatctagcgccagcgggctctgtcccagagtcagtgcgaatgtgagagttatgtgtctttccaaaacagaaacacgtgcaccaaagtcacttttaacatatggaagtaccccactttgaccctttaagcttctcacccctcccactatgaagctgagcttgcagctgagcaccaaaaccagctcattagatgaggaccttcccataagaccaacagatgatatgcccacttgaaacactaaggttgaaacatgaaaggttgtacccagggcacaagaaacagcagacatcctggtgccataaggacatttatcttttctagaatccactctctgaacctggatgtttgcattgataagacgttatgttttctcccctttcaaatggcactttggagataagtgatagtcgtatccagcgaagatcagtcagagctctggagtcacacggcctatgagcactgaatctgaactccactagtaccagctgtgtggcctcagacaaatttgtgcctcaattttctcatccataaaatgaagatattattagcctcccttataggatggctctaaagagttaactaactgctgcaatacttacaactctgtttggcacataataaatctgcagcaaatgttagatgttgttatttcattattaccgccactgcctaatattgtgtagtcactccagattccagatttaggttgcacatgattattaacattatatataggaaatagtttaaataagtttatacagatactcagatcatgatctagaaaaaaaaatgtcatgagttataatagcacatagcatttcacttaaaagtgagtgcaatttaaaagataacaagtcagtttcagtggcggcatggacccacagggatttggctgccctgctgggggctaaggggactgtgcagggaaaaaaaaagaaataaaagataacatatgaggtggttttgaaatattccatggttaactctaacactgcaactactgaactactgttccaaaagcaaaggacagggctttaccagtagaattcacacttgccaatttttttttttgttaacattcatctacaaaatactgtcttcacttagcataatgtattaaatcttgaaatttcctgctttggtcagaagtcagtctggaagcgttctctgagccaatccctcatcagacctgttgaaggtctgtgaggtaggacaggaagaggtctgtacagggtattttagctgatgtctaaggaactatagcccagcactaacctaaaaggtcaaggctaactttcaggtctcacctcaacataaacgtgtccattctctggcacagagaagacgccctgggagggcaccaaaaagaggtcagtgttgtatagctccatgttgaaggtgatgtttccgtggggctgttcctggaagctgctggggttcctcacctgctgaaggctgcaattaaactggaaataacaacccacaggaagattaatgacagtcatatgaaggatgaaggccctgtagcttcatgagctttggcttttaacatctgattttattttcagatagtccctaactaaagccaacaaaatagacagcattttccacaaaccccctactgataacaaacacataccaccacgatttcaggtcgggtgaacagggaagcatctccttcatccatatctcccggaaatccattatcacctgactccagatcttcataaccatctggccaaccactactgtccccaagggctggaacctgtatcacaatctaaaaggcaaagaaagcacagccaatgttataaaaacaccaaaccatgtgtgtttggttctgcctcacacaaacactcatgtaatcattctgatgcaaattgaaaatctgactttaagacaaaataataaaataacatccaggctttttcgaattatatcttcaaagtgatgaagaataaggagaaacccaatgcaggttcaagttaaaagctaaactaatatttgtatcttctcttgtgaaaaataaatatttatgttgtaaccatattgaataattacaaatgatttcaaatggtgggaaaacactagatactagaatggagttgaatggagttgtcaagagacttgcctataccgtgagaaggggcttccccttaagagtctttatattataaactctaagaactactagcagttggcgaatacaagaagctttggttatatatatcctttaagagttgtagaaagtttggttggagtcagcagcgaaggacctaatgtttggttatatatatcctttaagagttgtagaaagtttggttggagtcagcagcgaaggacctaatgtttactatggagcacatctcttcattgccgctcttgtacccctctaacttttgctcatttcttccctaagaaatctttctctatggtgtatggatgtggaaaagaatacgttttattccaggaatcttttttttccacctttttcgctatccacctgcagatatattcccggaatctatcttgacataggttgaaattatgattcctggattatttctaaataggatgagaaaattcacccaagggtcatgacgccataaatgaaatcctaatttcttttgcttcacatgcttggattctgaacatgatgcaaaatagaaatatatagtaagtctgaaaattactacaaacaattataattggtgagaacagctaaaacagtctccaaagggagtaggatgggaagaaaattaaaaaaaaaaaacaaactgcctttctctctgtaccaggtcctccaaagaaagtactgacgccaattaaaggaagcatctaggatattgctaaactcaaagatcataataaagaaaagaaaaatatgtgagaaaaaaaggaactttaagggatcattacatgcctttctctcctgaagcaactgacttttttttttttttattttttcttaacagacatattactgtagccacttttggtgttaacttggaccccagttttaaaatgccataatcaagtatttcagtaatatatgacattcattatatctgtagacactggataactgaacgaaaattcatgctgcaattatcaggaggtcaaaggttaataaattaattatttgagtaacaaaaggagattagcagggcctagcctggtgtctaggaaagattagtggacaagaggtcaggaagttggattcagtcgtcctggctctgccattagcccatccctggagtttaaaaaagcaagtctttttaacttcttggagttcagtttcctcacctgtgaaatgaagaagctgaataagctcatcttagggttatttgctgctccaacagtctaatattctctgaggaacaatatgcttgggttcatgggagagtcacttcccacaggaaccacgctgaccagagcacctgattgctagcctctcttctctggatggggtcgaactagcagccacagctcagccaccccatgtcaaagctggatatggcactaagaagacaccccccctcccaccccaacccaccctgtgtcaaaggtggacacagggatctctgagccttatttttaccattaaaagtaaaacccaaaatgcaaaatcagcactttaaagttcttttggaacttcacattttaaattcttttaatattcactgcctagtctctgcacccaagagaatgggtttaatctgaaaagattttgaccaactgagaagaaagatttctggaaaatgcagcttagctattgcaacggtttatcattgggggaaatctgtggaatctttctccaagtaacttcaaaagtaggagagtttcttcaatgtatggtctttcttagaggtggagagagacttaataattccttaaaggtcctttttgagttttaaattctctttttggatttttattcatgaaggagggagaagttctcctacttctggacgagactcaaatgaggccagagagaccacacatctggttaacccggctgtgcagaggtgctgctcgttcatatagcccagggccttaaaattttatccttataagggccagttgagcttgggcactgagagaagtcataatcaccttgacagtgcagcctttgtcatcaggagacggaaacggggggtgagaaaacaggccttccaattcccaaagactcaccaataaaacaaataaaaccaaagagctcagggtcaaagtacatccattttgttgagaactgacacttggctttcttcaggcctggggtgaaaaccctcttcatcttcaaagaaatgttaagactaactttaagggagcacacagccaggctctggcaaagggcaaagctttgttctggaaaacactcacggagttatagtagaccacaccatcaagggctgaccaccggggccgagtaccgcagccattcagaggagactccaaaacaaagtgtgtgccattcatcttggccttgcaggtaggatccaacagggtgacgtccatccccgagtagccactggcctaaaacaacaaccaccaaagacatggttggaggcccacaggcagttctgttgtataattgacacaattgacaattgcctggtcttccaaggacaggcgatgagaggcctgcatcgtgccccttccccaagtatctcttcccagctgcccacctctcaacagctcaagggtagtatctgttggccttggaaattcaatagcaaaatattgacacacaaggatctggaacccccaccccctgtcactgagaacaacaggaaccaggtgagaatcacagccaaggggaagtaggcccatccaactgagaaaacagtatcaagcctccggagttcaaaaatgaaagagatagggagaaattacagatgcagactagggccagatgggaaaggaggtagcctctcttccctcctgtaatcagctgcaccgacctgaaaagaatctttttctacagccacgatcatcttctcattgtcacatttgacagacagggcaatatccacgctcccttgcacctcttctggctctctgagaccaggaaacagttgtatgctgggaatgacagggtcctttggccgagggagcccatcttctccctcttcattccagactctcctggaaatatctgggaaaggaaacggaaggcctccattttggccttcccctccccggatgggcgggttctgcagggcaggcagggcaccagggtccagcaggatccgtagctcaggaggaatagtgtggacttcctcatctcccatctcctctgctggtgaaagaagaaggcaaaacatcagcagtgtttgatgccaggccacaaccaacatcattacaggcagaacaggaggaattagcatagaatgggcaggtgtaaaatgacttttaataagcagtgcataaaggtcattagaagtctagaagcctgaattctagtcctggtgttctctctaactagctcagtggctttaggcaagcggcttgcttctctgtgcctcaaatttgcttttccaattttttaaattaagtggttggaaatgatcagtggttcttaactttggctacacatgaaaatcacttgggagctttaaaaaatattcctacgcccaggttgtaccccaaacaatttaaactcagactctctggggtggtacccaatcattaatatgttttagtctctccatgtgtaactgcaatgtgcacctaagactgagaaccaatggaacagacagtttctaaggctgtccaagctagaaaaatctgtgatttaagttacatgatgcaatattattccattgaaatgccactaaaatactttccttgaatcaagagagtcttttgaataatttctctaatgatgtcttgaaacaatattggtatgttaaaattacttcaccaccttctttttgacagctaaattttaacaggtatctgggcaccttggccttttggaacatattcccttgaaagataagaaatagctgcatagatacatttattccttcaaagggagagacgtatttccatacaatcaatactcaatattttgtcgtatttctaacaactaaaaaaataataatttccccagtattctttatatctactatctaaggccaactgatgtacacttgaggtcaaatccatctcagtggaagctggaagtgaagatgatagttggacattatctctcctttaataatattctttggaaaggacgctagagctgtaagggtccaaaataagtcatagctttgtagggtttttaatttgtactttcacgaaaaccttcacaacaaccctgtaaggtctgtcctattattttccccttattactgaagaaaaatctgtggctcagaggtgaagcaacttctccccaaacagtgactaaatggtagagctggggcttgaacctgtactcctaatccttattctattggcatttcactcagtggtggtaccatgagctgaggaacaggtctagggatcacaaaactagggtttcaagtcatgctagctagaagactccagaaaacctcaagaatttgttgaccctctgctttccaccccattcagctggggtagtaactcctgccatcctctgggtatgaacactcaagtatgagtcctcgtgactattttcctaaaagatacagccttttaccatgaacttctttcctgcagtcttaactcttctgtattctcagccataagtggtcattaggtgtctcggagagaagaacctaatgtaatcacactaaagataacctataacaaagttctctgaatatgcattcaactctatgtcactgaaaatctgtattacagtttcctcaaaatctctgtctaggtaattttaagccttctgataaaaagtagtcaaattattaaaatgtacaagagaaaaacagcaacatataagctgaaatgacagttcctcactggaaaagcttcatttggggggtattttttacataacttaaaaaacttctaacttaccattattttcaagccgaagatgaaatctattagccacaggagccattgtgtatgaagttattggactatagccattgtccaaagcccacttcaccagattcccttgggttgaaggaatgtcatctcttattgatttggtcattgtcatagatctttcactctcttttccaaagccaatactgttaggagcctgaagatatagcaaaaaaatcactcatgagtctaaaattaaacagtactttagataataaaaattaaatatcttaaataagtagattctatattgtatatgagggaattatttattcttttgacccctgttttccttgggctaagaacgatgatgtgaaaaacctttaatagccgactaaaagacatctacgtatgctgcttgatcatactatttgtattgcctatgctgataaaaaaaatcatccaatgacatgtaagtagttacatactaagtatgcctagtctataactgtacagttagtctaatgtttaaattattaacacacacagtacatatgtataataaactttcccttttttttacttaaaatgacatataaagtatacaaacagacatgttatattgccctcaaattcccatgcttccacttcctattcccctagatttcaatgaaagatagcacaatcacttacagccacttaacaatggagatatgtcctgagaaatgcatcattaggtgatttagtcattgtgtgagcatcatagagtgcacttacacaaacctacatggtagagcctactacacacctaggctatatggtacagcctactgctcctaggctacaaacctgcacagcatgttactgcactgaatactgtaggcagtagtaacatgatggtcagtatttgtgcatctaaacatagaaaaggtacagtaaaaatatggtattacaatctgataagaccactgtcgtatatgtggtccctcactgactgaaccatattatatgctcaagactgtacttcagtgtggagactatcccatctatataaactattaaattccacatggtaaaacaaccaatgtttatatttcatctaaaatgtatgatcaattagtaattctataactgtattcatttgccaattctactaactgaatatacttgtatcttctattctaaatattaattaattaatttaggttactctccccttaagtatcactgttttatccagtaatacaagtaggtcttaagattagctttcagggatgggtgcaatacttcacacctataatactagcatttggggaggctgaggcggaaggactgcttgagcccaagagtttgagacgagcttgggtaacacaggaagatcccatctctacaaaaattttaaaattagccaggcatggtggcatttgcctgcagtcccagctactcaggaggctgaggtgggaggatcacctgagcccgtgagttagaggttgcagtaagctatagtcatgccactgcactctagcctgggtgacagagggagaccctgccttaaaaaaaaaaaaaaaaaaaaaaaaaaaagactagctttcactggataatcaattacaaaattaaaatgacagaaatatttttgggaaaggatataaatggactctactcaaccaggttattcaacaaggacatggaaggtaaatttatacatcagttgctgactcctgtggcagtgctcttctcagagggtgagagagctaaatgctgcagaggggaccccaaagggaaggtaccatattttcaacaactgcaccaacagggctggaaagcccttccagcatgcagattacaccattttcgtgctgtataaaaatcactttaatttccatgcccagtgattttctcctgcatgcatgcagcatttttcctaaattcctcatttgtttcccattctgtttgcccctaacatgactaaatattaatcctttcccactgtaaaaccctaaaagattcacaggctctaagttctcttggcctatgtggttgtgggatattggctgaagccacatatatttcaactcaaatcttaaaggatctcattcagtatatttttctattacctaaagtgcttatgtgtgggaatactgccagactcaccagtcacaaattctatatgcaaaggaaccagacagaactttaaccaacttctgcggccatttgtaaactcagtttaatagattcagaatattttagctcttactccaattcagaaaaaaactccttagggtaaagaagggctagggaggaaagaaacaaagaggaaggaaggaaggaaagagctaaaatgagatcatgaaagatccaatttattcttagaactttttatgcattcagtcaacagtagtttcttaggtacagcttcttccagccttttagagctacatgtcattttgattggctggaatcacaacaattggcctaaacaacactgcttgccctcatctgccctagtctctttcatgttgttggacagctgagaaaatatcgtatttccagaacactatcatcataactgccacctgtccttttgcaccaatgtggaatgagctgtttgcacctttccagattaaatctaggagctgtcaatacatctcattttgattatgtctgggaacttaaaagactcaacatctatctacacatttgtaaagcagcaaggcttgggacaatggcagacaagttggttcccagctttgagcaaattctcacactgtacttctggaagtccctaggctttttccagctttagtggagctacgccaaatgcaggtgtacaaggaggtctccaaaaaccaccaccatctttcccagccatatcttcatgaaagataaggagttaagtctaagtgcctccacactcccccatatttacatctggactgatggtataggggagggaggactaaggaagggaatggccagagagcgtagtgcatatgcccactgagatttttaaaaatgtattctctaagaacaagctgcccatcatcaaccctgaagtcctgaggccacatgaaataatataagaggaaacctctaacaggtttcctccatctatttttttatgttttagaggttcttcctaccataaaagtgattatgcatggtccacacaggacctgagaaaagagccagagctggacaaggcaatgtagacacctccaatgttcccattcttgcccactgcctggctctttgcacctcttttgaccattttgccatctggaggacacattctgcccatgccccacccccgacacacacatgcataagacatccatatttaatggtgctcttctttaaattactccatcagactccttacaattcccttagtagacatctttctttcttttcaccttgtatagagaagtgccctaattgttcctatagacactctgaaagagttatttatggaaggaagatgaaccccctttttatggcaggcactctgctaggcatatattatcttatttctcttccaaaatataaggagataggcattaccattcctgttagagaaggagaacctaagactcacagaagcaacacatgtagctgagaacttacatgcgcaggccctgtgtccagtgctttaggtgaaatatcctataggcccttaacaagtatttggcaaataaatgaacaaacaaatgaactcagctaatgaaccacaaactcaaggtgagtactatcatcatacccatttcacaggtgaccaaacagactccgtgttcatcagtcagactgcacaacatctactaggagtagtaattggaaatgggatttaaatctagccctgtctggcacaaagtcaagattctttcaatttcactatgctgtctctaaaggaaatactagaaacaaggtttctataaaccattgccccctttctaaatagtaatttaaacttttgtgggagcaggtacctttccctcacagcacagtcagaattcacatctgaaacagggaattagaaaatcacaaagcataaactggttgggagaataaaaaagaacatcatgaaacattacctaattgtttagtaatgttgtcatgcattgtccaaaattggcctggaacaagcgtacagccaaggagaggaacataaacagatcttgcactgggatgagcaatctcatttctagcctttctgattcatatgagagatggggacattcaaagtgaactccaggactgccatggaccaggcacacatactcagggaaagagccatcgaagggtcaaggctgaaagaatatttacacaagaactccagcagggaattaaaatgtaccgtatgtttttgcctttcaaagcatgattccctttcctgtttttgttattctgaaattaaaaacatttggccggtgtgccaggcagcaaaagcagcagacagcctaggtcaccaacacccctcatgccatgccagagaaggcaatcaaaacatctctgacttcagatcatggctaggctttgggcttgacaacaaattaatgtatcaccattacatatgatggctcactgggatcctagcaaagttataaaaaaaaaaaaaacccacgggaaccagaaacgattactttaaaattaaaatatgtgtgctagtggttttgcctgctgcctctggtgagtgcttttacatgacgttgccaagggaactgttggctttgctcactgtggtatcacatggaaggtgccatgaatgaatgaataataccaaaaccaagggcatccctctcccaaaatactgaaaacataaaacccacttcagcttactcagtgcaggaactaaaagagagattggccaaaaaaaaaaaaaaaaaaaaaaaaaatttgagcccatagaagagatactaaagagataattatcttcttaaaaaatagggaggaggatttttctttaactttcaatataattcagtcaaatagttattgcctaagcatatttgagataagatttactttaccaagtttcaacattcaacttttgaggaaaccagctgctgtttgcccatcatgccaatgggctaagccttgtgcgtacatctctattaaatagagggccttgggaacaagctggagtagacttgtccagcatcatttcactgacttcgcacttactgtgattcttctatcagtgtttcacacttaggagttggaagcaagcaaaaagacatgccaatatttcgtatttaactcaaaaagaaaagtcaatgatgtgagctggggtcagcctaatagtccatactttctctaagtacctaactccaaaataaaagctgatattcggtactatgacactgaggtccttgtgggatgctcaatatgaaggcttaattgtgttcattactttacacttactattagtggaaagcatactaatgtatttcaggaatttcacaaatgagggagctggggttcagagaggttaggggacttgccaaaggtcacagtgggattacctggactcagacctgggtccgtcttaatccaaggccatgtttgaacaaccgcacctattttataggagcatgctattttgcaaagtgaaaaataattgacagagcttagagagtccaaagaggcaggaactttaaaaataacacttataaagtacagcttaaattgttgtcatttatctaaacaaaacaaaagacatgctccaccaacttacaataattttcaggcttcccttaacatcaaaagatttgatcacccagttgacagactttttgcacttcaagatcaggatgagatttttgaccacttcaagatcctcttgagaaggtcttatatcaattgttatatccacctggaaagcactgtgaatggaagacaaaggcaaagttaagacctacatgccagaaagttgcaactatctcccctcttccaagtcttcatgtttctagtgtctggccagttgattaaaaagctggagttgatcccaggccaatgacatgtgcaaaacagattgttactgcacacataacaaaattgttttacataacaatagaaacatatgcttgctgataattagtcactaaagtttttctcttctttgatggaaaagaggtggttacttaatgcagccactgtttgaagtggacttgaacgaaccagaagagtttacttttgaagcagtattgttgctttttcaaccttcaacaccttcgatgtacaggattcccatttggctaatatgctcaaattccttcaaaactgaagtaggtggcagtttggtgagttgggggcggggtgttgggataagggaagcatggtggtaaaaaaaaaaattaggaaacttcagagtaaaataagagacaaaaggctaaagaatttcttgatttatataaggtttgcttaagtcattaacaattgctacagaatcgtatctgcatttactttcccaaacttctggatataaggttattaaaataaagaaaacagatggtcaaccaagtgattactggaaaattgatgaacacaacccaaacttctaagaattcgtaaaaaagagaattttttactaaacaataacatccctgtcattctgaatttaagggaacagtctttctttccatctcagctttacacacttgtaaagcataaaatgcatggtatactccaatgaagcctcaggcctgacgtcgaagcacattcaccagactgctcctattcccattcccttttcactttctacaaaattcttcaagtggccagagtggaatcttatcaaaacgatctgtagcttacacgctttgaaagtcaaaccccgattagcattttcacctcgaaatccctctacaatatacatttaaattttcaagtcactagtccagatgcaaaggaaggagggtgaaatgcaggctcatgtgggaaaagaacctactttttctcctttttctttaattccctaattattcttgatagggagggtcgaatttccaatccaggggtaggaagctgagagggagaacaagcgcacaagggagaggcaagttctatcgaatggctttttggtatgtcaccatgaagggccactccagcatacacacacacacacacacacacacacacacacacacacacacaccaagcacacaagggagaggcaagcgctatcgaatggctctttcgtatgtcaccatggagggccactccagcatacacacacacacacacacacacacacacacacacacacacacacaccaagcacacaagggagaggcaagttctatcgaatggctctttggtatggcaccatgaagagccactccaccacacacgtgcatgcgcatacacacacacacacacacacacacacacagatttaacgcaaacagctctgagtgcctaagcgctctaaggacaccacaaacagagctttattaaaaacagaaggttactaagatgataattatattaatagggcatattttgtaattttcctatcagggataaccttagtcagaggtgataaagatgaaggaagagtgactgtgtcctgtaattaacacccagaagtttggaacaggcttcaggaattcatctgaaatatctgggatctagggacagatgcagaatataaaatataccactggtgcctttactctgttcttcaaagcttctgtgaaacacatctgatgaagcacacctgaagcatcaatggctaccttccctcctgcgtgaagcatcaatggctcccttccctcctgcgtaggggagggtgtaggacgggctacacctctccctgcctcaagtcaaggaagatctttactttcatctcttgtcacactcacacacttagactcacttacctgtaggggttagagttgggggtgattagctcgatgatgtgtacttcctcattctggggctggctggacatcacacacccttctgctgctttgggttgaaggtactcagcaaggtaattgagtgagagaaaattcttccctatgttgcactttggagggaacacttgatctgaaagaggcacaggacaatctgtcaaaccactgaggtactcggtaaccagattcaaaggaaggagggtgacagtgaaactgagcaaatggcagacacagggaaccacgagctcaaaggatggttcttcgtctgtgaagtccgcaaccactgccctgaaatgcatcctgttatggtcaccagtgaccgcctattgactagcccccaactaggggcctcttttggctaaatcttctccttgcatgttctctgtgatacttcctgtcctcgtctgtttcctctgacctatctttcacatctcttccactggttcctcctctgctcagaatctgtatagaccccaacccagagaatctgattcagaacacccaggcggggcctagggagctttcttttttgaaaagctcgtagtagattccaatataaaccaaggctaagaacttctcagctccttcctcaatcccctttctatctcattctttttctaggtgatctcaatcactcccatggtttcaacctgtacctagatcatgactccttttctgagcagttgacttatactgtcatctgtctaccaagcatctcctatctaaaaatccaatacttatgtatttcatggtcagcgtatttaacattcaatccattctatccccaaatgcactcctccttggatatttgttatttcaactatcaggagaagcaaccacctaattaatcctccgacaccccatgtagaattaatctttccctcatatgtattcctcacagcactttatactctgaagatgaaaggtaggaatttgggggaaataaagaaggcagactttcactctttctcacaatctgaacacagacaactcaagtttatatggcactttacagtttacaaagtgctttcgcaaacattatctcactgtgctgagagttgctcaccacctccacccgggaaagtgatgcaagtaccagaatctgaagacactcccacaacggcacatgccatttacacagcacggcggctgatgggatttccatccacgggcttaaatatttcaacagaacttgaaagaaactgctggcagtgtgacagctgggaccagtgtcaaggaagttctaggtgtagcatgcttttttcagaagggataattaatcagaggcctggcactactataaaacagacttctgccttttccattttgaggacaggatgccagggttcaagtccacatggaagtctcactttggagtaaggaatccaaccagggggtcccaagactgggttgatactgtccctccccctccccacttgtgcaacctcccttgtgctgaggtccgcagcacacactggggcatcatggctctggccaccacagcacccccagcaccaccccagaacaaaggggaccaaagcctctgtttgtcggctcgttgcgagagagcattgggtttgcactctgcagtctcctctaattcccctccccctcagagagaaaagctcaaggctccactgactcaggctgctagagcagcctccctccacatctgctgagggttttgccagatgagcaaatgaggtatgcacaccgtgcagctgcagccctgcggatgcctcccccacatcacaggatggaaaatgatattggaacggcaaggttgaaatttaattaagaaagagcgtctatgggccagggacaggacagtctggaactcaagagactagggccctcctgggattgtggccggcatatccagttcataggtgtgcctggcttgtatctggcacatagtgggcatatggtataggtttcctgaattaacaaacaatgatgtgagatttgagacaaataacaaaatattcactcatgtgaagccactaggaaaggtctaattgttcaaaagttgatgttattaagggctctagtcccagaagccattgtcactaagttgaataagctgaccacttttgttgtgtgtggtttctcccccgctccccaatgactttccgaatgcctggcatcaaaacttataccgagtgccaagtagaaaggaaaccacaaaggggaattcccgggtagaaacctggcaagtttgggggcagggggagtcacatgcttatttgtattttagggaaagattgacaaatgactttgagacacagaaggatatactctgagagcaggaatgaacctggggggtaatgcaaacacctcattttcctgctgtggaaactgaggctctggtggtaagtcaatgttgcttgaagcctcgcagcaagaccagctgggataagagcaaaactcttaaattctttcattctgggtatatagatgagagcagttcccaaacgtcagcaagcatcagatctcctaaagggctgattgaaacactgactgctgggtcccacccccagagttcctgattcagttggtctgggttgggcctgagaactggcatttccatcaagtccccaagtgatgcggatgctgctggggcaaaaaccacactctgagaactgctcgggttagagcaaccaggcctcatggcctgcgatcgctgggtacaagaaaggtagagccaggtcggattctgggaagtgggggatgaagcttgctcagtgcagtctgagccgtggtgataaacatatcactttatggtccactgacctcaccaaggaacctcctttccctactgctcctctctccacggcatggcccggtgactcatactcaactggtggctggagtcaagtttcaggggttccgaaggtgttaccaaggagttaacagtttttactgcaccagacacaaggtcctttaagttggcttcccctacccagtgtgcacaggctgaaccagttaagtgacaacccgtggctctcagggtaagtgactactgtgcttagaaagaagctcatgcactgccgagagaacacagtccaacattctaaatgttattataacaaattttcttattctaacaaattccaaggggtaatcaacattctttcatgctactagaattctgcttcagaaacgcggcccgctggccagggcttagagtctttattaaaagaaatttttcattttgtctcaatgggatttgacctctgttattagctacctatcatgagagtacagaaacaaacttagactttttgagcccagccctcctctaagtccccttctctctgcctcaactaaacaaggatgttcatccaggtggaccacttccctttttgagttatgcttatttggctaggacttaaagtacagctcaggcaacaagcgttaaactcaagagtcaggaagcctgggtttgtgttctggctttgtcacttgttagtaacttggatgtgagcaggttcacttagccctccactaagccctctgtaaaacggtggaaatgacatcttcctcctggggttactgtggggttaagtgggatgcacgtgaaggcccctgaaatggcttctgcacgtagcatcctctccgacgtccacgtccacctttcctgcctctgtctctcacacactttaaagcagcccagatccaaataagagttgggatcaagtgttcactaacccacccttccctgtcttgtctatgaggaggtgacagctgctgtagaatttaacagaaagcagctggatgctgaagaccttaaacgcagtgttcacacaatcagccagctataacaaggacccattcacaagagttatttcctagtaacttatgggggttccaaatatactcaactgaaaataatgatttttaaaaaaaggtctggccaggtgcggtggctcatgcctgtaatcccagcactttgagagaacaagggaggaggatctcttaaccagcagttcaaaaccagcctgggcaacacagcaagacctgtgtctacaaaaaattgtaaaaattagccaggtatgatggcatatgcctgtagtcccagcttcttgggagactgaagcaggagaatcacttgagccctgcaggttgaggctgcagtgagcactgatcgcaccactgcactccagcctgggcaacagagcaagaccctgttgaaggaaggaagggagggagagagggagggagggagggagggaggaaaagaatgaaagaatgaaagaatgagaaagaaagagaaggttttttgtttttgtttttgttttaaaaaaggctttcaaaactgggtttctggatatttctatccctttgcaatgcaaggaaatttaaataggcaatctcttatcaagaccctacacttcttttctccaataatttgtccttgtaatagtcatttgtactaaaaatatatttaaatacttttcctttgctattgtccaaaatgtaacctatgtctcagcaccacaaactgacacaggcttcaaacgtttgcagaacacaggtaagaggaagccacctgctgacccattcattctgccagctcttccactccatcagtcatcacctccttcccacaccctcagcttctcacctccacttactttttttgacttctgtgcatgggtgtcttctaaatcccacacaacaaccttctcctctctccccctgctcctccctgtgtttcacttggccataaccaggcctgcttccccaggaggaaaaaagaagggagggaatatggggggcggtggagaggcctggggccaaatgacccctcaggtcccttccaggtccaacattctgtaattctgtgattccttgccctaaccacctggtttcagaaaagaaaacaattgcctgtcataaatcagtcattaactgaagccacataaaatttaccttcccccactttaatataaatgtttcttgctatcttgagttcggtgaatgaagtaactgctccatactcttttcgggcccaatttaacagatgttcatttccatgggggaagttcctttcttctgtttctgctgtcaaggagaagtttgctgatgaaaactggaccacagaaccctcagacacctagaggaaagagaattgcgtatttaacatggtgcagtcaccggagctgaatcataattagagaaagtacttctcaaatcgaagtgcttgtaaatcgaacctcttccctttgttatacaagcagatcagcgtttttaagcagcggattcaaggaataatcccaagcctagtcctcccagacaaaggcaaaactaccaatgcaggatgtccctctgaactctgaaagaaccttgtgaggacggactgcattgcacattgagtaatcgtaagaattatcactgctatttccaagaaatctaaatcgaagaccaatcttacaatgaatgtatttcaagtcaagtgggaagccttgatgaatgttctcgtgggcttataaaaagcttcaggatcaagacaagtgatcccaaagtcctgctagcaactgatcacgactttcaggtcttccacagttgcagcatctgccaacagagtcatcacaatagggaaacagcgagagtcctcttggtttatgttcacctcagcactgagataaaaatggccaaaggttgccagcctttctatcacattgctctatttcataagagtgagatgaatgtttgtaacagtttattgtgtaagacccccaaattcccatagataatgaagtcaagaggctgttaaactgatctaataaaactttcaggatgacgtatgcaagtacctcattcttgctgaatgtatttagaccactgctgacctagcatatcatggtatatgtgtaattaacacatccaaaggaggaaaatcatcatcttgttgctgtgctataatcaaatttagttgctggtgaaaatatgtatgccatttttgttggctagcatttataaaataactgattttttcaatgtcagagtgaaacctcaaaatgtgggcaagaaggctcacaaattctcaggtcatagaactataaatgtcttgtattaaatttcacatgaaccatttattcataacgaaaagcatgcagtttctgaagtaagactaagaagcaagtcgagggcagggattttattagtggttctatcacagcagcatttttaacacacacaaaattatattttcccagctactgtgctaggcattaatattttctatacaattatataaacgtatcttctaaaaacgctggcaaaaaaaagtacttcaattaattgattccatgacctactaatgttgcaagctgaaaactagaatcacctgaaaagtttctagatatcctgatgcccgggccacacagatggtacagagctacatgttccactctggttttgtttataactggcatcaggacattcagaaatgatcgtgactacacttgacagcactgatacgtagtaagtgtgcagtcagtggtagctgtgtagaactacacagggctctgtggaagccctgaattaatcactaataaactcggtgtaaaccaaagctactcacaacagctaccactgactgcacacttactacgtatcagtgctgtcaagtgtagtcacgatcatttctgaatgtcctgatgccagttataaacaaaaccagaggggaacatgtagctctaaccttgttttgacgtcgcctgaataagaaaaaaatcctaggtcattttcctgccaaaaaataaccatgcccacctaagtgtaacttctctgaggcttagctactcatcaacactgaacttccaacaatgtttatctaattttttgacttttgcactgtagtaaaatcttcctttcacttgtactaaaaaggcatttttatcaaggctgtcaccaaaacccacaacagtccagaggcctttgtcccactgccagcacagttctgaatgtttagacgagaaaccctggatgttctgcttcttgtttctcattcatgttgtggccataaactacagcaaccctatatacattatacacagagtacgtttttcagagcggaaagcgggatgtcacactggtgcattccagaggcaagaaagcaaacagcacaaatacagaagatatcaacggcaactccgaattgtgtcctgaagtaattaaagagcgatgccgtgatgaagctggtgatggggctgattcgtggaggaggaacaactccctctgctccctccaggcattgttgtcctcacgggccagcagcaataagcttcatacactcagggctgaggaatttggaactggagttaactgccactcctcaggcacattccaataagaagaaagcaaagctgcagtgaggtgtccctgactgcaggtcagtggaaattttcagcttcagcaaggagtgagctagcactcccctcctgactgccagctctcctgaccctgacaaggctacagctgagttttagaaggtgttgttttagaaggtattgttcagatgttatttccatctgatttgcggaactgtgaggcaggctacggtgacctctacagcagaaaagcggaaacctcagagagtctaatggcctacccaaggccagagagtcatgcaccaggcccagaccagaacttaagacttctgactcctggtcacagctggcctctgcttgcacccttccagaaagaagacctcactagctcccaagacagcagatttctgttctgttagattcattttttatacactagtctgagccatgcctactagaacaaagaattccttcgtctttcttccatgagacaagacttcaggtgtttaaaggtgtcatctgacctcaatcacatgtttgctttttcagggcaacacccctagcttcttcagttctgccccagataccctggttgtcagagcgtcaacaggatagtctctgaaagacggtgtcgggacaagattcaaggtctccaggtatggtctgagaagcatactgtgatggttcattttatgtgtcaacttgactgggccacaggtgcccagatatttggccaaacattattctgggtattttggtgaggatgcatttggatgagatttaaatgttagtacattgagtagggcagatttctctccctgacatgtatgggttcatccaatcagttgaaggcctgaatagaacaaaaagctgactctctcacaagtaagaattctacctgatggctttcaaactggaacatcagctcttcccggtgctacagcagcctacaggccttcgaactggaactggggcactggctctgcagattttggacttcttagcctctataattgcatgagacaattcctataataaatctctttctccatatatgtgaacactgcatgaagcatccacattagctttggcatcagctgaaccctgctatgatctcatatttactaattgatatagtttgcatatttgtccccacctaaatctcatgttgaatggtaacccccaacgtttcacatggggcctggtgggaggtgtttggatcatgggggcagatccccccatgaatggcttaggccatccccttggtaataagtgaactctcgtcttgagttcacgtgagatctgctcatttaaaagtgtgtggcacctcccccgacacacgttctctctcttgctcctgcttttgccatgtgtaagtgcctgcacctgcttcatcttcctccataagtaaaagcatcctgaggtctccccagaggcagatgttggtgctatgcttcctgtacagcttgcagaaccatgagccaattaaacctcttttcttataaattgcccagtctcaagtatttctttttagcaatgcaagaacagcctaataaactaatctatgctttaaacatagagccaacaaagatttatggagtgcctgcctactccattgttctccatgctggagacacagtggagagacacagtggagaatatgacagaaaaaattccctgcccttatggagattaaagtctaataagacagccagaggagcacaataaggtcactgagaagttaaagacctaaaggagacgaaagaacaaaccacacaaacatcagggcaaggagcattcacagttgagacgcagcaagtgtaaggtctgacatggtgaaggaagaccaaggaggtcagtgtggctggacacagggctgagaggaggttggtaggacacagggctgaggcaaggttggtaggacacaggtcccagaggagaccagtaggcccaacaggaccttgtagaccgttgtaaggactattgaaacatctaccaaatgttttcgcaggatggctctggctgctatgttgagtctaaggggagacaaaaagcaggagatcattagtagacttccggaataattcaggtgagaaacagtggtcactcacaccaggaaggatggtagagatgatggtacctaaccccccaaggtcttttcaccagttcgaggcttttctatcctatccttatacccataattctcccaaaataaatgcaaagtcttatagttattcttcagacccatatttcaagtctgaagagaccatgtaaaaatccttattttattagctataaataattaaattttatagcacaccttctgcactttcatctaaatccctgagaggttgaccaagacaaggctgaagtctgtgactcatacgtacactcccacactaacctgagcacattagcagtccttgctggggttccaggttgttcagccaactaccaagggacctcacagaaccttcctcatctttgtaagggcatcatgctacaacccaccaagaaccctgctgcattagtccattctcacactgctataaaaaaatacctgggactgggtaatttacaaagaaaagaggtttaattggctcatggttccacaggctgtacaggaagcatggctgggaggcctcaggaaacttacaatcatggtggaaggtgaagaggaagcaggcgtgacttatatggcaggagcaggaggaagagagggagtgggtaggtgctacatacttttaaataaccagatctcgtggtaaatcactcactatgacgagaacagcacaaaagaggaaatcttcccatccccatgatctaatcacctcctactaccaggccccacttccaacactggggattacaatttattttattttatttattattttttgagatggagtcttgctcttgtcacccaggctgaagtgcaatggtgcgatctcggctcactgcaacctccacctcccaggttcaagagattattctgccttagcctcccgagtagctgggattacaggcgtgtgccaccacatccggctaatttttgtattattagtaaagacgggtttcaccatgttggcaaggctggtctcaaactcctgacctcaggtgatccacccacctcggcctcccaaagtgctgggattacaggtgtaagccaccacacccagctgggattacaatttttttttttttttagatggagtctcgctctgtcgcccaggctggagtgcaatggcatgatcttggctcattgcaacctccacctcacgggttcaattgattctcctgcctcagcctcccaagtagctgggattacaggcgtccaccatcaggcccggctaatttttgtatttttagtagagacagggtttcaccaggttgtccaggctggtcttgaactcctgacctcaggtgatccacctgcctcagccttccaaagtgctgggattataggcctgagccactgtgcccggtcacaggattactatttaacatgagatttgggcagggacatagacccaaatcatatcatttgctgaaatgaagacaagatatttccaggtcattcctctagtctaccagtccatgctccagacactgcattaattttcatggcatagcacccttatcagagtctggcttgtagaagaacataggatataaagagaatagcaaaacacataagaaatgtagggaaaataattttgtctaatatgagaaagggttgcaatcatcactgcaaggaagataactgcaagagtgtataggagaaaaacaacctatttttctctatgctcacaccactctcaatagtttacttctgacatcgcatgtctgggtgtttttcccacaccaactaattctccaactcagaacaccaattgatgctgtgtatttcgatgtaattctgataccatctacctggagataggtcagaccgcacagattaagggctcagtcccacaagactgcccctcttcagatgcttctgatagtggggctataaatcataggttcccatgaccctgaggttcaattattttctagaatggctcacagaactcaaggaaatacttttaagtttattcatttatgataaaggatacaactcaagaacagcagccagatggaagagatgcacagggcaaggtacggggaaggggtgaggagcttctgtgccctctcggagagcgccactcccccacgccccggcacctccacatgctcaccaaccagcagctctccaaaccctaccccacagatcagggatttctagggagccttcattccacaggcatgactgataaaaccattggtcatgtatgattaagtcaatctccagcccttctcccctccttcagaggggtgggctgaaagttctaacctctaatcacatggttggttcccttggcaaccagcccccatccagaggctatccaggagccccagccaccagtcatctcaccagcatacaaaaaggtacttaacacttcagagatgatgagggttggaggagctgtgtgccagaggaggagactatttattccatgccccatcttccaccttatccctggaggcttgccacaacactgtcccattttgggtccttataatctcaaccaaactgttgcagtaactttctaccctcccagccgctattcctgttccttctacccctcctccacactgtcacctgggtaatccttctaaaaagtaaacacatgataaagcggaatggcacctaagcatcttaacatggcgcatgactgaagtgcctctgcccgccctcatctcatgccaccctcccacatacccaagaactactcacagttgtagaacacatcatgctgccacacactcctgggtctttttacaccctgcaccctgcctgaacccgtctatcctaccttgctcccatggcaaaccgttctgtgtcctcccaggagtatcacctgctctgtgaagcctcccaggctccctactctcctcacaatgagctgcacacaagtgactgtacagacctttagtccatccctctctcacatggactgcaactatttatcagcatacctgccaccctcatttgacaaagagcaacacctcgagggccaagaaaaaaccttgttcattctgaatcccttgggcctggcatagtgctgggcatgaagcaaggacccaataattgcttgttgaatgaaagctcaatgttgttacctacaggaaaagatacaccataattgattcattcccattacccaaactcattgcttcccttactgcccaggaaatgagcttttggccaagctttaaagctaatgatttgatttttcacctaataactccacctaaaaaccaattattaaagcatatttagtaattccatgtcttccccacaacccaatgaactttcctcctgcttgctaattaaaacccaatcctctaacattccctgacatgacaaatgtcttcctgtgggaatgaacagagcactgggctccaagggtcccaattcctagtaaacgtttgttgaaggggaaccatgaagcactttacagtcaaacaaatcctgggatgctgaggtgcaccctggactctcctgaatgctcctccctacttgaaccatgcacaacatttgtatttgaaattcaggttatgctaccagacttttttaaagagcagaacattactctatctgccaattgctgggagttttattataagaacttacggctaggcaaccacagccaagtttattattttttctggatcaggttcaacaacctcatccaaaactacatgaaaaaagccaaagaggcaaccagccctttgtttccacacctgtctttaagctttaactcttaaagtcctcagcggatccacggaagcctcaaggttgatctcccaagcctgagtgaagtgtacaagtcccagctaatgagcacagacaccattttcctggcactgaggttctttgctttagcacttagcacatcagctgactcaccacctggcaggttgcattgtagcctctctctgggcctccccaacgttggtttagtcttcagtggtgaggagaggaacttgctgtggatagtgccacacatccccatcctcctgcctccttgacccctaccccaaaaagaatgctcccagatgaagtcttgaggaaacttcaggccaccctagatcaaaagtggatattaagtctcatcttaagtttcacctcaacctccttcaagtctattcaaatgttaccttctcaatgggcccatttaaatttacaaccccaccacccagccccactctaggaattctgattttcccaaactcactttacattttatttctacagtacttgtcaccttctaaaatgccatataatatgcttattgcccaactccttccactagaaggttccttcagaggctgggatcttagtgtgcattgtccatgggtataccccaagtgttgggtacaaaaaagatacttgttaagtatttgtttgataaataaaacaaatcttgatgtccaattaactggcagtgcctgcctaaggttctgtgctgagaaggattctgaggtcatattcaggagcagtggagaaatgggaacaaatgccatgagcaaccacgtgtctgccagggggttagcgaaggcatcattgctctacagctgttatccaatgtagtgtccactggccacatggcaccatcaagtacctgaacctgaaatgttgctggttaaattgacctgtgttatataaatgtaaaatgcataccacttagcacaagaaaaatccctatctcattaatttttattgactgattacaagtttaagtgatattattttggatctactgggttaaacaaagtgtcattaatattaattttacttactttttttttttttttttgagacggagtttcgctcatcacccaggctggagtgtagtggcacgatctcagctcactgcagtctctgcctcccaggttcaagcgattctcctgcctcagcctcccgagtagctgggattacaggcacctgccaccatgcccggttaattttttgtatttttagtagatatggggtttcaccatgttgggcaggctggtctcgaactcctgacctcaggtgatctgcccaccccggcctcccaaagtgctgggattacaggcacgaggagccatgcccagccactcagccttcttttactttttaaatgcaccaatagaagacttaaaattacatatattgttggcattatatttctattggacagtgcttctctagagcctcctccaatttgaccctaagaaaggaacatgtttatgaactgatcatgtccatccatctgcttcttggtctggtctcaacataaatcaatgtcaagaaaacatctcaagcccaacgcttcccaaagtctgatcctcagacagaagtacgttaaaatgcagactccagggtggtgggaggtagaaatgtaggaaactacattataatcctccctctaccactcatgattctgacgcatacttgaggaacattgttctaggccatagatatgaatattatttaaactccaataatctttataaagctcgaatgagattgtttgaagaacgagcaagaatctctcctctgcactgatgataaaaagccaagagggagagtgtaaagccaagtcatggatggagtcatctccttgcacatctcaaaaggaagaaatgggccttgtgaaataagagaaaccatagctccccaatgataatgaaaaagcctgttgagatctcagaggaaatctgttccaggaatctcaaacgcacgcgtacacacacacacacacatcccctacaactcagctgtggtccatttggaacttgagttatcagctgggtgagtgcctgctattcaggttacaggcccttggggctgctctaactcgcacatccaactgcacacatgtccgtgactttggcattggtggaagttcaacacttacacaatgaaaatagactcctccccctcttctgtcctgccctactcccagctttcagtattcctcttcccttttcctgactcctgcacaaacaaatctctttttggagttgcctgcttaggaaaatagaaagagcaaaacaaggaaaacaaagaaagcaaagaaaaacacactgatatttcagaaacacctgccatgccaagaacttgctggctcagttccagggggaaaagacacacggtaaaggagaataggtattcctcaagaatctcagttgaggtttaagtgggatctacagattggccctagaactcatcacagcccccacacagaaaggcattacaaagattatgcttttatgtattttggacacacaaagtccagcaaaaacaaacatactggaacagcactgaaatatttaccttccaaatgaagactgaaccctgcattttaaaagaggaaaatcacacgttctccctacccaattcctgggaggaccccacttgcctatttcctctgaagccatgtgatgtgaaatgcaatccgaaacatgttttctattaacatatatcatgactcaatgccttttaaaaaagcttcatttcaaagaaataataacttccatgcctgtgaacctaggttcataatttgcaaagctacatattcatgagccatgtgatgatggtatctgccaatcatgcattcatgaaacacaaatccatgcagccatttaaaaattcttgggtgattttatttagtaccccaaaccagattactttcttccaataaaatgacttaaaacatatttgactattactttttctcaaaacattcatgatgatcatcctgttcttaatttttgctgaaatataaaaaaaacctaaatgactgaaaccgccccatgttcttaacaccctgcatgtttacacacgtccaagaggaaagctctgagatgctgccctccaaacacaaacatgcacaaacttgaacatgagccagtacaaaagcaatactctcatctcccatggaaacgttatcagaacaacagtacatgtgagtgtgtatatacacaaagagaagcaaaagatgtctttccatctaaaaaacaaactaagtccccacaagttaccaaactgatgaagcacaagctgctttctaatatagttttccaaagtagagtcccaggccacacaggaatcctgtccagctttacaaaaaattcttcagactcctaactttacccttcctcatctgccaatgttagcctgatggaagagcttacccccaaattcaaagtgcatttcaatctaaatgatgtttttcacgaaaaaaaataaaatgttggtatcattactattacttgccatattcctttatctaattttgtcctccaaatgtgctcctggagaaccccacaggagggaagactctctttttttttcttctaagttacatccaatcagccaagtcaagttcaagagcaaaaactgatttttacaaatgcctggctccaaacatgttcctagaattctctttatagagttttttttttcatcaaggctgataatctcaactccattttacagagaaggaaattgaagctgacagaagctaaaggatctacccaaggcacacagctggcagacaacagggttgacaatagaaccaaagacctggtttctcactctagagctctttctattccatcgctgtggaagagtcagctaccaggctcagaaatcagtagtgtagggtagacacgcacatccctcagcctcatgttaataaaacactaggaaatatgatattaatcacaaaagctcaggctgcacacttcctaagtgcatgtcacatggattctgaatcctcatatctgatagtggaaacaactggggctctgagcaattagataaagtgccagattacacacctttagcaagaaatgagtgcagattcaaactgtctgctggactccaaaaatgatgctctttccactgtgggaaggtggacactctgcctggaaaggtcatctcccgttggtgagggaactgactggctcacaggtcagcaaagacctgggtgtcttagggcaagctttctaccaagtctgggtaggcaaatacagaggaacattctccaggcttagaggagagtgaaaaggaaaagcagtgaggcaaagcagggggctcccacccttcactgctgcttgcagagattctcctggtgggttatttccctctctgtcccctcttccccagcaatctcaggagctgtgctggtcagagtggagaggaacggaatggaagggacagacagaaatagaaatgaaacagttaaagcaacgaaataattacttggctagaagtcaagttagagtaaacaacaacaaattgctcaaggatcttaaaaatttctgtgatggtcagttttatatgtcaacgtatctaggccatcttccccagctatgcaatcaaacactcatctacacgttactgtgaggtattttgtagacgcaattaaactccataatcaggtggcactaaggaagggagattgtatcagataatctgggtgggcctgattcaatccattgaaagccattaagagcacacccaaggcttccctgaggaagaaaaaattccacctgtggacagcggcttccgctcatgcctgagctgcccttcctgaaggcctccctgcggactttgattgccctgcctgtccccacaatggcataagccaattctttgtaataaatctcttcatatatatatccccgactggttctgtttctctagataaatgctgactgatagctcctgggaatggctggtgcaagccctaggagaaacagagctgcatattctggcccaggaaccacagacctaacaacagtttgggaaaaaaagttctaaagggtatttccttggagggcaagaatggaggtgaggcctctagcccgaaataactgtggttggagcctccttgagcttcctaaaattagctctgaagcaaaggcagagccctcttaagcaggccacacccattttgcagtctacattgaagtctctgaagatgatcaaggtggtctcctaggtcaaagcaaagaaggttgaactgcacatatttagcatcaattaacaaacggtccccacagggttcaggatagatgtagatattagggcatcctggtggagctgatccagaaacgctccaactgggaccccagagggaaagctcttgggaaaggggtcaagaaacagttttaaaatctttattcaagtgaaatactgatatgatctagatcccagtactgaaataagtcatgcataaaacactttgctgaaacaagaagtttgctcacctgatgcgatgccctgatttggctctataggttcaattctgaagccctgttcttggaacagtcatgagtggctccagactggaggccagagttagagataaaatcatagtcatgccctcgagtcagcagtgtgactgttcccaatgaggtccccatttaccattctggaaagtattattattattattattattattattattgctaacatttactgagtacttactaagcactgtccctgggttagagcccccgtttactagctatgggaccaggtacatgttaacctctttgtctcagtttcctcatcttaaaacaaagacaacaaaagcacctacttcacaggcttattatgaagactaagctcatacatgtaagtactcagaagagtacctcacacacggcacacactagaagtgcttgttaaacatacacatatgtgtgtatgtatcctcacattgggccatgagatttgtctgacagatgctgaggttgacaggccacgagtcattcctcactatggcaggaccatagccttcttatacaaactgcaagaaaaggatataaaaaccctgttttaatggattggggcaggcttggctccaaacagcagctctgaacatcactctgccatctgtatcacccagaaccaatagaatctcaagaacaggctctctgtgataaagatggaaaggccagagatcaaatggactgtgagacttttgctagaggtggcagacggaagaccccctgacttccaggtatacactgtgtcattcaccacctcagtgggacaaggcagaggcaaaccaatggtgactccctagcacagtggcattaaggacccacagttgcaacaaagaccctgggtcatctaaggatacagtgttaggaacaaaaggcaaaagcagatcttgagaaaagcaaattctatcctagacacagaaattagaaggctaaagggactccttcctcccctgcgaaatcagaagtagcttccaagctagagttagataatgtggactcgaggtgcaagaaccaatttgcctcaaataaacccaacaacctgtgtccaggaaggagttggaccatcctggagttgctttctgagatggagagtgtaggtcacctgtggagaacccttaccaaaggcatcactgtctataatttatgagcggaacaaggcacagccacagccttcaagtcagcctcccagagtctcctggtagacagttggggtttctttcccctcctattacatggaaataaaatattctgcaaccttccttaacaaaacagtcactttttctaccgaacagctctctggaggctggccaccacgtcaacaaagggcaccagagatgtgacatttgatacaattgcccaacacttgggaagggcagatgcatctgattaccagattagccttagacaataaagccttaaaagacgttatgggactccacacgaagaaacaccaaccttgcctcctcagtgaaagtgagtttatttgacctcaatttgttgaatgaaagcaaagccttcacagggctgcaacccatgcctgcacacagacatgacgcaagtccagccagagccaggaaaagtctacacttgcgtgaaccctcctggacagtaggtcttcctcaggaaaaatacacccaggcaaatctcccaggggccacgggccattcactcactcacaacattcaccagccttaacctagcaagttagaataaatcccagggagtctttcaaaaaccccttctggaccaggtttaccagttgaaactgggctctttccaatgttctaattgccatagtgacatttaggaagagctcaatggccacaatagggccaaaaactcctattcctaggaaacaggaatgacttgtttgaactagggtagttgactgaccctagttcatgagaggatcaagacccatataattaaggcccttaaggacaagccacaaaaccaacagatgagcagactccggaataaaaatgcatggtacacaaccacttggaatatcccacaggacacaatgagtcattccacaagagacatttaaaaaaagaagaagaaccaccagcaatcttgaaacatttagttatttaatctcccttcaagagagaatttatctggggaaagacctcactgcaaaacacaaactggtatatccgggtccctggaatacaggggtaatgcttctggccgagccaagagctgtgtttgtgtctgcaaccttgacccatttgccacatgctgttctccagagccaacctcatgcaggaagctgccttgattgcatttggaagaagagaattctcattttctccaatttctactattctcatcttctccaattttcactattatttagcgtaatagtacttagcacactaaactgcaattcccaatttttcaatcagctctcccacacaatgggaagctccctgacgacaggcaattcaccccagttttccctagatcctccacagctagcacagttcacagtcaggcactaaaaactgtgtgttggatgaatgaacaagcacatacataaaccatcatacccggtatgctaattctgtgtttttttctaaacatgggggtgggggaactgccaaagaagggaaagaaggaaattagcaaagaaaaaaattatttccagatttttaaatgtaacacaatagaatacagaattttttttaaaaaaagttcccttctccacaagcaaacttgaatgtctgagttattcttagggcgtttttggacagacactacaaccctcagttacacatcacttggcttcatgaaaaggtaacagctggacatgcacggtggtatgggctgtgcgtgtcccttcctagtgctgcactgagcacacatctggggctatttagcaactgattggaaatttagccttctgatttccagttaaatactaggcacaggaaaacaaatagcacttgtttttcactgagtcttgtcagtcatccaaactccagtgcagaccagagaactgcctgtggtttggtggcagaggcccaaaatatttggacctttttttttttaatgcctctagtttaagtaaaaggaataaactagatgttggcagctccagcttcttcacccatccctccccgcttcttgaaaatacaaaactggttttaaatttattaatttacatttttcattaggattaagttttgatttgtttttaatccaaagctaatagcatagagtttagtttctgtcatttattgcaactgccctgccttgatatttacttggatttgctgaagaggcaatgctcaatttgccagtttctgttccaaattaaattgggatataacatctagcagtcgtactatcaaagaatcacagagtttaaaagctgggaggaactttagagatgagctagtacgatcccctcattttagaaatgaggaaacgaggtctgagtagttaagtgattttttttcccgatgatgtatataactagttagtggcagagccaagactagtactcaggcctcctaacacccaggccagggtgttaactggaaacaaaaacctgaattacctccgagtagagctgcccaataaagtacaggacacccagttaaagttgaatttcaggtaaacaatgaatactttttcagtatatgttatgtcccatatactacatgggcacactaacaaaatgatttgttatttatctgaaattcaactttaattgggcatcctctatttttatatgccagctccagcaattgtacctcaaagaccaaaatccccttctatgccccatcccccactcaaacatacacacattcacatacatttgctctctgattttaatgataaatggctagaaaaaaatagatcacagcacagtaatatcgagagtgaatgaggttggaagaagctgcttatttcttgaaacttctaatcttagatacccttttttccttatgagcatgcaaagtgactaagcctgacataagtaagctggccaaggcctctggactaggtattttaggttattaaaagccaggcactagggtctcatcttgaaaacgtctgcttgtcctagggctccaagtctacagaccttgcaggagagaatgctcaagtttggaatacaaataaagcaagattaaaaaaaaaaaattagaggccgggcatagtggctcacacctgtaatcccagtactttgggaggccaaggcaggtggacggcttcagcccaagagtttaagaccagcctgggcaacaaagtgaaaccccatctttacaaaaaaaaaagtcaaaaattagctgggtgtgggggtacatgcctgtaatcccagctactcgggaggctgaggtgagaggatggtttgagcccaggcagcagaggttacagtgagccgagatcatgccactgaactctagcttgggctacagagccagaccctctctcaaaaaaaaaaagaaaaaaagaaaaaaaaatcaggtacatggaataaagtaaaaagatacatttaaaaacctagtccctgcccagcactgtggctcgcgcctataaacccagcactttgggaggccaaagtgggtgcatcacttgagaccaggagtttgagattagcctggacaatatggcaaaaccctatctctacaaaaaataccaaaaaaaatcagctggtcatgttggcatgcacctgtagtcccagctactcgggaggctgaggcaggaggatcgcttgagcccagaaggttgaggctacagtgaggcatgtttgcaccactgcactccagcctgagtaagggagtgagactctgtcctcaaaaaaaaaaaaaaaaaaaaaaaaaaaagtgctgcagcaagtttttactagttttatgaaatacagtccacataccataatattcagccttttaaactgtacaattcagtgtttctgtgtgtattcacaaggtgtggtatattcaccactatgtaattatagaacatttttgtcacctcccaaaagaaatctcgtatcattagtagtcattccccattttcccctcccatcagcccctggcaattactaatctactttctgtttctatagatttgcccattctggacattttatataaattggaatcatacaacttgtgacaattagcatctggcttctttcacttagtataatgttttcaagacccatctatgttgtggtatgtatcagaacttcaatcctttttatggctaatattccattatatggatatagcactgttttcatccactcatctgttggtagacatttgggttgtttccactttttggttactgtgaataatgatgctttggacatttgtggacaagttcttggggacatgtgttttgctcagttttccacagaaccattttacattcccaccagcaatgtatgcgtgttccaatttccctacagctttcacaacccttgttatcgccttttttattaaagccatcctagtgtgaagtggcatctcactgtggttttcattagcatgtccctaatgactcatgatattgagcatcttttcatgtgttttttggccatttgtgtcttttctctagaaaccgtgtatttaaattgtagtatgtccttaaagacaacttcatactgtggctctcattttagcaaattcaggttgaaggttcaggcatcatcacccagttaagttatcttactttttttttcagtgtagaaatgaatgcataaataaaaacaggcttatgtgatccttctaagagattatttgcagtttcaacatggcacactgagagggtaagatgatttttatttctgattgttctctgggccacccatacaccctgcaaaaggaaaactataagattattacaacttcatcacgtgtgtgtgtgactcacactcaaagattcactacttgaaactcagcctgaaagcatcactcttcatcccactcatatttcctaggtaaccagaataaccagataaaggagctgcacctgcagagaaaaccaaatcccactttctccctgcctgacacgttcccttcttgcctgtgctgtgagggggtgagaaggactgaaatgatttgacagaaaaagacagatgcctttattactagtattaaagtatgttttcagtcaccctcaagggtggctgcgatgtcctgggtaacataaggccctcctaactaattatgaaagttttccttttttaatttgggcagtcataacaacacagacatgtccatttaaataaaaaggtcaccctgataaatgagtagatgctattacttgaacttttctcattgccctatttaaaaaaaaacagttaaaagttctgtaactctacgtacacagtagacagctctgagacagaaatgcaaaccatccagcagcatatcaggaaacaggcaaggatacatgcatcgtggactgagagtcaagagacccattcgctttccacagctcctttaggctccctgggtaacctcggagaagacagtgatgaaaacggtgaagcctgaatttccagagatcccgtgggccctctgaagtgtttgatgaacactttatataaaataatttagttatcttatccccaaactttaactcttaactatacaaatggataaagagaacacactactggatttctattgatcaccagaccctctgtggcaaaggctatcaaggagatgaggagaaactaaaattcatttcaggccacagagaggaagggaaaagcctgcccaaggagagtggcccagcttgtgcaaggacttgcatcactcgttgtctgctgatgtgagaacgtgaatgaacaacagatgttccatcgtctcttccaggccaagaagaaatgtgcagacgggaaaaaaaccgttttccctaaaggaagcctgctggacaacaaagcagagttcaggtgtcctggaatttaaatccttgacttctcctgatgctgcctcccacgtgttggtaattttaggctcattacttgatctgcaatctccttacatgggattgatccaaatggggctgacgttcaattgtttactaaagcggccaccttctttcattgttagtgtctaaactgatgaccaagaagcagtttttacagattttaagcaaaattaaagcaaattaataactaagagtaagacactttccgtcaaaacccatgaactggcagactgaagaaagaatccaggcagcgataagtacaactatgacatacgtagcccacactttcatctggacctatagcccagagaaacagaaccccttttgatctggggccagccaaactagatatttcataaatacagatgcaaattcaacacccgtcccacatgctctttactgtgactagaaataaataagagcagcaacagcaggtgatgtctataaacattttatatgtgatctcacttactcaagataacagccctatgatgcagggcctgagaaaaatccggcttagagaaattaatttgcccaaggtcactgcttggatctaaaccaggacatgcactgcctttgctcataatgcctccataacctgcccactgtggtagccactagcctcacatagctactaagcacctgaaatgtggctaagcaggactgaagaactgtaatttaagtagccacgcacagctatttcctatagtattggacagtatagctctacagtatgagggctaaatgtgcatatgactttatgatcagagccattagtattactatcacaagtaactttaattagaggagactgacagtgattatgagtacgaaggcagacagtttagcataacagcttgtagaatgggtcccatctaggtttgagtaccaactctgcaagtaactagccatgtgatttggcccactacttaacttctctaaatcttagttcttcatctataagaaaggatctacactatggtactgtagaaggctatcgtgagaattaaagtattagagcatttagtgacctgaaatatcctaagtgctaaataaatgtgctagtaataacaactaaataattactgatttttgatttttggcctttttaatatagaataagagttgcaattcccagaaaaggctacaataaagttattgtaatgcccaccttgtaaatgtaccttttgagtttaaatgttttcttttgaaattaatttaaatttacagcaaagttgctagtacaaaggactctactatacccttttaactagattcatcagtttttaaaaccttgccacatttgctttattcttctctatacaacatgtttttttcctgaatgatctgaccttttagcccttaatcttaaagagtattaagtatgtttcctaaggatattctcttacataaaaacaacataattatcaaattcaaggaatataacattgatataatattttaatctataggctcaattataatttatttatataaaatacaatccactgtccccctaatgtcttttatagcagctgccccactccctacccaacaggatccagctcaggatcacatgtgtcttgtctttttgtctcctctaatctggaatggctccccagcctttctctgtctttcatgactgatacttttgaagattataggccagttatcttatagaatgtcgttcaatttggttttgtcagcgtttcttcatgattagattcaggttatatgcatttctggcaaaaataccacaaaagtgatgctgtgttctctctcatttataggcacacagcgtccatctgccccacattgctgatatgaattttaatcacctggttaaggtatcatgggatatccccaaggtatatagtcactattttttatgtgtaattaataagtaatttgtatgaaagatattttaagaatatctaaatatactacttcctgaactccctccatctctgctagatttagcatctgttgataattcttgcctggtcaacttttattatgatggttgcaaaatgatcattttctaactcctttgctccttctagattttctagttggcattttactataaagatgagcttttccttttctcccttttattcatttatgtacttattataataattgtattgactatggattcttacattattcaacaagaacctttgagtttttagaagtactcttcaaacacaggggaaagaaactacagatctggattgagagacattaactgggcaaagtttattcatgaggcaagaggaaaactattaactggggactccacttgttttggatgcttgtgggcaagagaggtttaaggcctcaggcaccgcagttaggacattagcctgcagctctcgtaatagacaatgtgagttacaactaccaagttgcagtgctgctcatcatcagacatgatatcacaccaaaaaaattccatccaaacaacccatcgatttctccacaactagcacacttgaatgttctggcaaactcaaagggacatgatttacaaatagtaggtaatatttggatctttcgacaagagctgagttccagcttgtttttttaataaaatacaaatgacttcattttggagctcactgtgtcactttctcaacaaacagatcctcatatcaggaattaggcctgtgttatatacaaatagtatgggtccgtgcatattcattttgtggtcagggaccacacacccggtagccagttacaatatttacagggctcctgatgccacaaggggggtttcagagctgaaaccaaagctcaggccacacagagtatgacgacaggtcctgctctaatgtgcgcactagaccccagcctctgcccacagaagatgggcaggtgtgtctgctttctgtgaatgcttatctatgtcatcatccaaatatcactaagtgcatcctccaaatttaacactctttggactctggcattatttcagtgaaagtaagcctttatgaaaagtttggcaaagtttaaggaccattatgtccttgtgctaaggatcagtttgggggaggtttaagcacttaccaaaaacagtctggagaccccagtggcaagtctctctgtcttcagatgccacaccagggggtgtggggagttgagcaggaacacaacagacttgtggtggatgtggactgaggagatgggattcaggtgaagtgtgacctaggaagcaacagaaagagggcagaaatcttagccctggctttccatgaaaatcactcagagcagcctctggaatactttttttgcaactcactatcaacagaaacaagctataatgtagctcagattctatgaataagatacattaagttgaaccagatgatattgccaatatttgaccattttttactacaaaatggctatttcatattagtcaaccacactaatctcaaccaaagcatgatttagctccctgccaaagaacaaataaacagaacacattttttctttctaaaagtcagcaaaggtggaacaaaagttaccttcccttaggcctgctttaagctttaggtcaaatgactaaggtgaaacttggaaaacaaaatccccttggggtggggtcatccctctggatctccagagaaatgactttcttctcctccaggtaagctccaacctctataaagtgaaatgggttctgccaaagaaaagtgccgaaagctgagaaaaagcggctgccaagggaggctgccagggctttcattgtctcagcttttagcttgaagggcttttccaaagaaatgaagcacagaggacacacagaataaagagtgattgtatacagcccctgtcaaaaaaaaaaaaaaaaaaaaaacagggaagaaaaccatgggatggatacaaaaactgtaaccaattttgacagcagatcaaggactattgcaggtcatcactgttgtcattaacatcaccaaaaagcacctgtgaatggagctgcaaaccatggactcaacaaagtcctcttggcacacatgagcccagggcaacatgaacataggagaacaaagggatatataaggaaatattgactagatactttcatacagtctgtctcatactggctttccatacagagcggggaggcaagacccaagaatcacatatttaaacagagtgaactcatcaaacataaccataaagtaataagggagggacaggacaaaaaaggacttaggctagaaagacacagactgaatgatgcactgggaataatagtacatctcagctagaatcctcatgaggatgacatggtctagatccacgatctgtgtctatacaaccatcagggatacagcactaaatgctggactatttcacattttcccaatggctgccagcccactgtgatctcaacatacttctacctttttttgtagggaccacttatgaccaatgtcacttatcatagtatgctctcaggtcattgataaataaaacagtaaactttcattatctttcaaaacccaggctttagcacatggtaagcactcagcaaatgtcaaaataatgttttaattctctgcttttcaatgccacaaaaatattctatgaataacttgcatcatcttgttcactagcttgagaatgcatgtcttaatttccaaaatggactgtaggccaggagcttgagaccagcctggccaacatggaaaaaccccgtctctactaaaaatacaaaaataaattagccgggcatagtagcaggcacctgatactcaggtggctgagacacaagaatcgcttgaacccaggaagtggaggttgcagtgagcccagatcgtgccactgcactccagcctgggctacagagtgagactctgtttcaaaaacaagcaaacaaaaaactgtgcttaacatagacacgataatacacttgatcttagccaaaaggccgggaagtaaacacacacaataaatattgacttatcacagcaaattcatatatttatatgttacctaaaggggaaaaaaaggttcaaaggaatttagctggctaatttgcaaaaaaatacaaaaataagcaatactccaactgtcatgagctatttctgcacacagctaggatcatttttatatctggcataagcatagcactaaatcaaagtactagatgaacagtgatgtcaagtacagctacagcaaagtaatgtgctccttggttgtaaagactctacctcacagcacactttggagatgctgtccgcatctagaaataaacagattgatagccactgagaagaagagatgctatagaaatagcagaagcaaagattcaaactgtactgaacaaagagacacacacacactatggagaatgaaggagggatgaaatcatcatttgttccagtgtacctgaaaactgcaaagcaacactctttcactaatagcatgtatcagtaaaaggtttctctatttatttattcaagactatttactgagtaccataatgatgcaaagactagtaatgtatatctgcaggggctgcatcaacccttcttctgaagattttctttgcagtcctcaggcatacaattcttcttagagctcatagatatgcagaagtttcggtcaaaatatatactacaaaatactagtaagtatgtatttcaaatgaacaagaattttttataaaagctcatgaaatgagaagaaaaagatctatgagacagatattggtgctcaggtccaaaattttccagatggtcaaaagtgctgaggcctggctcatacaatcaagggaagatttctaggagccacagctctctgagctttcctggaaacagctccctcttcaatatgtggcagtgtctggccaagatgaatctctgactctggcacacagggtccaggcagagccccaaaagccatttggcaaagaagaattcacactacaattgggaaattcaaagaaaaatacccaatagtttctttaaaagatcatttggcagggacaatgagtcctgcaagtgcctgctcacctaatccctcagcaacctgtcttttctatgcttcccccgcttgagtaaatcttgctgaagggaagataaaggacaaccaaaacagctaacaaaagaaccatggtataaaagcttccagaaatgtagagagaacacacagcaatatctcaaagaattcctggctaagttgctcaatttctcccaggcttgggggaaaaaaaaaaagacaaaagaaaagaaaaagaaaatcctccttaggatcaattatagctcagggtagactacagttacaaatataagaatatcctgaagctttttgtggttacactctccagtgctcatggtctaaaggccgagctgaggcagactacagcaaataaatatcccatgaagaaatgatacaaagagtatccagaaatctccagcttggaaatccaaacagtagtttaaagagttgaccatcaatcctatgtcaaatttacacataaaaatacaggttaacagctttgtctatgggctgataagtaataaggaattgaacactgggaccatgcaagctgtgaaggctggtagaaccaaaggggatgcagctcaaaggagcagcaatgaccagtctcgaaaccactggcttctttgtaaatctttgggagtcatggaacatttgagaactgaatgcatgtgtgcaccctctccttaccaaaccaaaccaaacaaaaaacatccatatcacacaaacttttgcagacaatgtcagggaattacattcattgcagggcccatgaactccccgttaggcacccattaacccagattaagaaccccatcgtaaaagagtaagaaagttctaagagcaacaatggtaacaaaatggatccatctaattaaactacaaattacaccgctggtcttaagatgtcatcctttcagcagaagaacttaatagatgaagactcagaactaaaaaaactttcacatgcagtttctcgtgaaacccgtactttgaccacaaactggtccatgaagcctaatccaagagttcctgttctaaccatgctggtttcaaacagtgctggatattcggtattcctgatggtgtgagaaaatgcaagcaaatctgatctgccacatcccttatgtaacaccatccctcatacattgctgattcttcccctaaatggaaaagagttaattggtctaacctgttctacaacatctattcatactaggtcttctgcagttacctgtgcaatgcaacaaacatacaattttataaagaaattcaaagcagatcttctgagtgtttttctggggaatctgaacacaactttgcccaaagtcaaggacaactctaaggagcacaaagcctctgagtggaaacactacctccctatctctcacttgggaagaacgtctttgctcacattatcagcagaaaataacaaggacaatcttttctggaccttgttatagtgaaggcttctgggttctccaaaggttatctttgataagcaaaaactatctattgtctcaaactctgtagattactttatgaaaatgaattacaggaagagggggaaaccctacttgctttatggaaagattccttatgaaaattgttttgaatttcccaagattcataatatagatgcaaggcatttctaccatagagatttcagaatatgaattagttagaccccctacttctggggttcattaaaacgaacgaaaaagcaaagtgagcaaggcaactgatatgctagtctaacagctgtccaattttgctaacgtgtcagtgaggtccatttcaacatttctgattcttagaacagcccctgtgggctgttcatgaagcaatgaagtcatccaaaacactaccagggaaactcttattatctaaaaccagaccaaataattctctgaaatggatgattcaataatcagtttacactaagataagaaaagaactccaacagcgtgcctacaaccaagacccataaaatcacatgctggtctgtatatagccatcatctgtcccctcttcaggggtaaggagacatcccacttggcaacaatgttagtagtaactgaaaacatcctgaatctgggtctcccagcacccacactttgcacccacaaatggaaaggcacaaacctatttcaggacactagggtcccactgaactcaaatttcactgacatttgggcaatatgacttttaggaactcaaacctgaccccagatggatctaaaatgtgcaactgactgctaggggtgggaacagtatttacttagttgctgctgcagtatttaaagtatattctgatctaaggaacccctacagctgatattttattcaccattgcttgtccttcaccatttgggaattggcataaaaagattccctcaaaatatttttagagaactgggtgtggagctttaaaatttttcctttttatttttatatttctctgaatttctagaagaatattaatcagttggtgctgaattcaagaaatcttgacatacacacacattcccccccacacacacccagggtccccatcctgacctggggcactcaactaaccattctccttggtcaaatggtatcaagctctttcccaatggttttgtcttgaaaccacttaaagtgctgagaggggcactgtcagtctatttcaaaactaatctcccttccccccaacaaggacatgattcaggattccctgagagcctctgaaaatcatctaatataaccacaaaagagacaaaaaaaaaaaaaaaaaaaaaacctaaaatgaaagtctgaaacgggatgcagaaataagctctgctccatattttgtatgccctggaaaaatactgggaactaaatttgggttgggggttgaggggcaagagctcatataaacagaggagtatttatgaaactacaggtcatgaccttctaaaggggtcctgggagccgttgcaaggagattccagagacccaggcccttccttcccagagcagccacagctcccccggctgcggagaagagaggcaggcaaagcggagaccctgatgtgtgggtggttcgggtggaggaacgctgctagtgccctcagcaggccactactgatgcaagtctgaggacacagacaggcacttttctatcattctttggcattaagataggttgtgtgaatggggtactgtgtacatcactaacacaccgcagccttgcaggattctggcctaaagtgcaccacagtgctccggatggacttgtgggtccagctcacaatgccatctccagtaaaatctttccccctccctcagacagagccagagctctctcagacagcactggtgtttctacctctgcctctgcctggcactataatgaactgcttagatcaagcttgtccaacccacggccacatgctgcccaggatggctttgaatgaggcccaacacaaattcgtaaactttctcaaaacattatgagatttcttttgcaatttttttttctttttcgttcatgagttttcattagcattcatgtactttatgtgtggcccgagacaattcttccaatgtggcccagggaagccaaaagatcggacgccctggtttggatgtttgtcccccctgtcacagtataaattcctcaggtcattcttcaagggcagaaactgagtcacactcatttctgcatccttaggcctagcacagggcaggacatctagtaggcagtccacaagttctctgaaagaaggaataaaagaaggaacgaacaaaagttattaatgaaatgtgactaggataataattacagagtcatattgacctgtttttctggccagaacaagggggttggggtgtatatagtaaacagaacattaacacacagtcaagataagcagattccagctactgaaacaaatgacggagatgcttcctggaaggtatgctggacagcatgccaaggccactcccaggctttgtaggacaagccaccctgatcatcatcctctctgtgtgtaagacagcgtagaatggcacttgggccatccatgggaaccataaaaggcaaagaaaagaaaatagaaaatgtttgttatcttaaacagttacgcaaataaaaacacataaaatgtaaaaaacctttggagcgtgttttcttccttagggatagataacaaagataaaatattttgagcaaatattccactatcttttagaggcatagaattttacacgggtttgcatgtaggcaattaagtgtgttagaatgattagaaattaaaattttagacaaactgaagaaactcaatatttgcaaattgattaaaatggagggaaagtttgctttttatatatatatattccctgtcacatttaataaatacatccattcagatcactttttgtttttaacactaatatgtaaccaaagccccatataactatgtgctatacaaacgtatttcctctcaagttctcctttttttgagacaagatctcactctgtcgcccaggctggagtgcagttgcacaatcagagctcaccgtaaccttcaactcctcaagtaatctcctgtcttggcctcccaagtagctatggccacaggcataaaccaccataaccagctaagtttgttttctttttttttttttttttttgtagagacagggtcttgctatgttgtccaagctgatctcaaatcctggtctcaagcaatcctcccacctcagcctctcaaaatgctgggattacaggtgtgagccacacagtacctagcctaatttctacattttataatgggcttcaaattagctttgctacatacctgtttagtaagccagtatgctcacatgtatatgtctttaccaacaacagaatgttagaatggcctgtgcatcagtactgtgatgtatcaaactgcataataaagagaatcactagagtgatcattagaagctgatttacaaaataagcatagcaggaactcaattcccacaaaatctgagtactggagtaatcattccacctgctacgtgcagtcagagattgaagctgtcctcactgggttaacaagaattccggacagaaaatataattaagcattaacatgctgctctttgacctagtttcttgtaaccaagtcacatagcactagattctcaccatttgcatccccattgctcctatagatagataggatgtctgatgttagaatcctaagggttttgtttgagagttgcatgagcagatcctgaattccaacgggacagctgacaccaaccagtttaaagactcccacaaaggaaccaccaaatcagcatgagaacacagtttcttcatccccctgtcccacgactttaccctgcactcttcgacccatcaacaatctccatatttcagcccacccaaaacccttaaaaactccaaccccaaactcctgtgggagatggatttgagttttcccccagttcagcagctgtacaattaaacctctgtctctgctgcaacctggtatctcagtgtattgacttgccacgcacgttggacaatgaacctattatggctgtaagatctcaataaggatttctgtttaagcagcatcttaaagttagttaatttgtaatagcaaaaacaaacaaacaaaaccccacaaaatgcagttgtagtcaggtagcgatttaagatgctctcagcagcaaaggatggcatttggattcccctgggctaaagtacaatcttagaaagtatattaacctgaagctggtaaggaattctttaggagtacagtgttaccttgctagcagaaatcagaaatccagagaggagtaattactaagacatgaacattcaaaaacaccgcacttggattattgttaaaaatcatggtggcagcagtagtaataaccatcatcatcatcatctcctaaggaaagacaataggtagatccatggctcctgttgagatttgctgctctcatcaaaaggaagtgctctgcgtaatatctaattactcccatcttaaaggtaaagaaattggtgttcttgccaaagtcatatggctagaaaatgacagtgctggaagtagaatgaatgtctctccctgtctgtctgtctgtctctccccctacctacccacccccatctttaatcttgggtgttagtcttgggacatagaggagaatgggaagctgctctatagcagtaagaggcaggaactattttactcctggaaactatatacaaactcagcaaagtaacttctcaattctttctggaaggagggataaatgcattaattactgttttgtattttcacattggatcacagaaaaaaaaaaaaaaagccatgctctttaagatgactttgtgttggccgggtgcagtgactcatgcctgtaatcccagcactttgggaggccaaggcaggaggatcacctgaggtcgggagttcaagaccagcctggccaacatggagaaaccccgtctctattaaaaatacaaaattagccgggtgtggtggcgcatgcctgtaattccagctactcaggaggctgaggcaggagaatcccttaaacccaggaggcggaagttgagttgagccgagatcatgccattgcactccagcctgggcaacaagagcgaaactccatctcaaaaaaaaaaaaaaaatagaagactttgtgtccagaggatattactgacctatgtcctgttgacccatctcttacagcatccagaatctgctgccttgtattaactttgtacatataaactatctcagagcatggggtgggacttgtatttttatcaccttagaaccttgtccagtatctagcacttacaggaattacattaatatttggtaacgaatgaatgactgaatgaagaaattgataggttttggatctgtgtccccacccaaatctcatgttgaactgtaatccccaatgttggaggtggggcctaatgggaggtgactgcattataggggtagtttctcgtgaatggtttagcaccatccccctagtgctgttctcatgagagagttctcacaagatctggctgtttaaaaatgtgtagcaccttgcccttcactctctcttcctcctgctccatccatgtaagatgtgtctgctttcccttcgccttctgccacgattgaaagtttcctgaggcctccccagaagctgctatgtttcctgtactgcctggagaattgtgagccaattaaacctcttttctttataaattacccagtctcgggtatttctttatggcaatgtgagaatggactaatacatgaatcaacacacacattttaaagcataatttcatctcttccaagatctacattttcttctaagttggccacatctcccgtaacccaatcctttgggtcactctgccttcctttctaaattacaggcagtttgacctggtggttaagaacagtgactcagagccaggcattaggttggaatctcagctctccacctacccaccctagggcctcgaggatgttaagactctactcacatcagtttcatcaattgtaacatggggataataattgtatctattctatcagatgtcaaagggttaaatctgtcatttgtcgaaagcacttagaacagtgactggcatctggtaagcactctctaagtgttagctattattacttctacccactaaaaccacagctgctattctccattcccttggttcctatggaaggaagctcttgtctataccatcctccattgaggcttcaagtcaaaacgggtttcctcatagtcctctaaacatcaagctgctggcatccttggactcggcccacattctcctcctaaaccaacttctctctgggcacacacgggccctgttaaccttcccctttgcccccactctctttcttccccacctggccaccccacttcctgagtcacgctcccaaagcttactcacagcactatcatgaccaacaacatctccaaggctcacttcactctagccagacttggagatacttcaaaggccccacatgattggagagaaggataagggagctgtgtttttgttttttttgtttttttttttaatacaacacatcctgaaggggatgccctgtttccatgtgtgtattttactctgacacaaaccgatcactctcaggcttgaacaagctcggtgaagacctccaccagatacaaaaccaaaaaggccgagacagctgcaaaggtttctatttccctagagatgggagtttcatggaaggctaaggatcaccacagcaaccagactacaaaaacagtcgtgggcttcagcaccgtaactctggtaaagcaatttgtgctctgtgaaaggctggggcacagaagttgaagaatgatcaaagtaaacactgctcctcaggcaccattttgttgtgctgatttcaagacactgagtctcagcatcaaagttctgttatgaaagatgcgcatcaagtgccaaagatttgctaggctggactgcctgccctggtgcaaaggtctggagagaaactcatagcacattttccaaaacaaccatttcaaatttgctctaagagcagaccagggtaaaaatgtatgccattatatcaagttaccctgcccatgctagaacaactgttgatcccaaccctggattaaaaaaaaaaaaaagagtgggtgatttttctcataaaaccctaaatagactttatcccatgctgaacttacatagactgattcctacagatttaagaaaaaattacctaaactttattaaacaccaattgaaaaaaatcacctgttctagtctctgatctgccaccctaaatctatactgcagtttacataataaataagaaactacagcatactatttctacactctatagaagcagcaaatatagagtatagtaactaaaacagaaatctcttcatggatttataagaggcttcaatatttattagtatgattaatttaattattaactatgttaactatagcttgaatatataggaacttgttctttttaaagaaactcaaattggtctacctgagtaatcttacaatatcctcaaaaattaggttaaaaaatatacaattcccattagcaaatttatagaaaaatccttcagacctctgttatgttggcagtacacaatgcattcctaaaaaacacttagtggtagtgagaaatctgtaacttaaactgccccaaacaggaacactgagaaatacaacaacaaccatgtgatgtgtacacatacttaccacaccccttttctctaggatgtgtcccatgtatagtgcgctgctttctgaatcttttgtggggaaggggtccacttacacaatttctggagtttcagcagaggctcactcagtaagtcagcagggactctgcaatccacaaaatttattgttccataggcccctctagcccagcagtttgcaatgcataagaggtaattagtaatatctaacacctaaatgcttcacagacaggaatgaatggcttggcttacgggcttgctcagtcttttctagctgcaccctcctccttttatctctaggttaataagcgtgaagttactaaactaacagggaaaagaggttctcatgttatgttttgcgcatttactattcattcctcagaaactgaatggctactatgtgtaaagcactttactcagtcaatccttcccaaagtgtggagataataagaatgttttaagatatactttatgtatatatatttttacaggaattaaaaacatgatttcatgtttaggaagttgaggatgaagctaaagtcattttttaagtgagtagatttaagaaaaaatattatgggccggacacggtggctcacgtctgtaatcccagcactttggaaggccgaggtggatggatcctgaggtcaggaggtcaagaccatcttggctaacacggtgaaaccccgtctctactaaaaaatacaaaaaaattagccgggcgtggtggcgggcacctgtagtcccagctactcaggaggctgaggcaggagaatggcatgaacatgggaggcggagcttgcagtgagccgagatcgtgccactgcactccagcctgggtgacagagcaagactctgtctcaaaaaaaaaaaaaaaaaaggtaaataatgcaaataatatatgaatactacacaaactgtgaagactaatagcacatataaacttatatttgggaagcaccactaagtaatgaaaggacttcaaatgtgagtcagacacaatacctgccctcaagaagctcacagtttgatgggggcagagggacaggcagatacaaacacatctgtgggcagcaggaagggggcacttcagctgggccagagggtgaatggggaaaggtggatctaaggggtccagacaaggagaagggcagtggaggcagcatgagtgggtgtgaagaatacttaattcagacggagctaaggaaatacaaaaaagaataaagaagaatgtcgttgaaagggtactggagccagatcacaatgagccttgaaagccaagcttaaccagttaatgaaagacgatcatttgcttttcagagacatagaccctgatttgcttcctgatagataatgagtacattaacttctggcttagtaagtgtcacttagttaaccacattactgcactgattcactaaatgaacttccattacctgacttacttgcccaaaagaaaacatatcattcataaatctaataacaattttaaatcccatttttgtttaggatctaaagggtacctttagattgttgctgaattaccaaggaatatcttgcatggtgagaaaaatcaaactctagccctcaaccctaaatctcctagacttgaggagtttgttccttggctttgtccccaggtcatagtccctcaataaacacttgttgagtttggggtataaccataaactatcaatgaattaagcaactgagctaggagccttgagcatttctataaggaacaacttatagggcctggtaattctggtcctggttacattattttatgtaaaagtctgtaagttctatccataattctctactgtgtaagaaatgagctgaattaagcctcttatctatccctctactttatcatctctaaggtgaaaacaagttaccattgtagaatggtgtacaatgtctttctgagatgccctcttaaatcttggcaagacctaccaatacaatattagcatcttcagtacacatttcagacaattttaggtcagaatctctctcattcttttcaaagaagaaagtaagtaaattgttggcatgaaattttagaacaaaaataggattgtctgatttctagaaaataatcatttgttgtttgccctcaaggagaaaaaaagttaattgtctgagaaacagaggaaattaactttcactataaaccacaaaccccggtgctccccaattttgccttcctcctaatgtaagatcctgacatatcattcattttaaaaagggggttaggcacagtagctcaggcctgtaatcccagcactctgggaggctgaggcggacagatcacttgaggacaagagtttgagaccagcctggccaacatagtgaaactttgtctctaaaaataataaaaataaataaataaatgatttttttttttttggcttaagtatcttactttgggcttcagtctccccataaatgaaaaggttagactctatctctatggccacctataaatctagagcctatggttctttcagcaactaatagagtcagtaaaagtcttcaggacagatctctaggccaggcacagtggctcatgagcattatcccagcaatttgggaggccaaggcgggcagatcacctgaagtcaggagttcaagaccagcctggccaatatggtgaaaccccgtctctactaaaaaatacaaaaattagttaggcttggtggcaggcgcctgtaatctcagctaatcaggaggctgaggcagggagaattgcatgaatgcaggaggcagaggttgcggtgagccgagatcgcgccactgcactccagtctgggcaacagagcaagactccatctcaaaaaacaaaagatctctagaaatgaatgtatctcaataaatgagttgatgtgactgaattatcaatttcataaatgccatgtcacactaaaatgatctgtgtactcaattaaaaggaacaattttaaaaagtttagtttagcctgccaaagtgaatactagagaacaaaatagaagtgctttctcctttcaacaagtgaaaatgtcttgaaatgctggcttgaaaaattaaataatgtttgttttagagagtttctttgctttccttaactttaattctgggtcagtgtgcccacttagtcttttacatttggcagaagcaaaacaaataatgaaatactcaaagctaatcctaagggtaaaccatgatttacagtgcattttaaaataggaagtgttgacatggtagtagtctaaaaacaagttaatatacttggtcttgctaatttcttttagatatacttttctttttttttttgagagtctcactctgtcacccaggctggaatgcagtggcacgatctcggctcactgcaacctctgcttcccaggtgcaagtgattctcccgcctcaacctcccaaatagctgggagtacagacgtgcgccaccagccaggctaatttttgtatttttagtagagatggggtttcactatgttctcaagctggtcccaaactcctggcctcaagtgatccacccacctcggcctcccaaagtgctaggattataggcgtaagccactgcgcccggcctagatatacttttcaatgagagagttgtataattgatactgaaagatgagcaggttttttttattgaaatataagtttccaataaatcaaaatatgatttaaaaaaaagagtaaatgcaaacaacagtatcccactgtcaggttctcaaatgccgttttgatgggataaatcctcctcagtaaggacaatggcattttttggttaaaccctacatcactagtctgagaacaagtctcggtcatcacaatcgactcatgcggtgattgggaattctttcagggcaacaggcaatgtgttaaatatgcactgttgagtacactgtgcaaagttatgaaattctctctttccctcctgacatttttttttccaagtacttcactggctactccagaagcaaaggaatagagaaaagagtgaaatcagaactagtgagtggacttggttactgtaagatcactggtaaaagtctgaaagaaacaaaaggataaaaccaaaaatgaaatttatatataataaaatcattgacttctagtgagaaaggagattttacagacattctactccaaatgtttgttatagataaggaaattgaagcccaaagaggtcatgagttgcccaagttctgtagctggttatggcatggttgggactagagcccaaatatccactctagtaatctagtttctacttcccttgccagtggaactattcgcatttctccttatagaaccaattctccgttgttagcaaacacggactccccaagtcttcagaatttagggtcagctcttttaatcactagataagaacacagaaatgtaaagaaatgccaagaaacaacttcttactccgcagggccccacgtgatccaaccctcaatgaccaatcgcacctcccaccactctcccccttgctaactccactccagccatactggcccctctctcatctccaacaagctgcttccaagctgagggcctgggccctttatttggcctcttcttcacccagatctcggcatagttcacgccttttcaccattcaggtctcagttcaagcacgcttcctctaagaagcccttcctaaccaccctaacaaccaactcttcctgtcacttgaatacccaggtagctccacaacttggtgctgggaaatcctttcatttacatttttataaaattgaagggaaaagacacaaagcctgttggcatctatcccaagaatatctcctgggcacttctaagtaaaggccactgccagcaaaacaaaaataaccaactttcaacctactcaagacatgcaagaattcaagaccaaatcagaatgcatcccagagttcacctgattctgccagcaggagccctgcagtgctgaatttctgggcatgtgaatgatacattgttgtactgaaacattcattttccaagattcctttccaaattcaactccatggtctttcttttgtctgttttgctaaagggcaaaatactaacctgtttccaagctattcagcaatattttggcacaggtaatccagtaagagaattgtttgtatagaacagagctgatgttaataacagggtgccctaacctgcccctctttctaagctcttcacctatagatgacagcccagctattcacatttaactcttacctgatggctgtttcattgcagctcaaagacttacctgcatatgattaagtcaacacgcaacactgggtgcaacatctaagcccacatttaagcaaagtaaagagcttgagatcatctaaatgggagcgggagcaagggagaactcactatccactgtgtttttgttacctttggcaaattctcaagggtagggggtcaggactgccagtgcctggcactgtgcctgacacattacaaacaggtgcttaataaataatgatttcattattgaataaatgcctaagccttgggaaagcccaccttgcccagagccactcagagtgcatgtcaactccatctataggaagtgtgttgtgaattcaaggttaggttctaccaattatttcccagctcatgaccttgggtagaatacttaacctctcttagcctcaatttccacacctgtaaaacagagctaacagaatctcccttccaggggtgttgaaaaaaacaaataaaatgccaggttttgtaattctctggaaagaagcctaccagcgtttgactttggctctgatcagtgtagtgccattacctcctgcctacaggtccctggattttcaagcagggtgacaaattggtggcagctgcatacatgaccctccaaacacttggcttcctcatgaggaactaatggttgttctgtcatttgtctgcttttccttcacctttgggatttggagctcattaaagacgagggccgaaaggtagcacaaacatcaacatctttgctagttgttcctgttcaggcaccactaacctggacaagctcaggttttgctccccaaatctcaccgtagttctggagacttctgaatctaacaaacaaaggtcctgggaagaccacattcattccacacctgaccccaacaccacatctactctgaggttaccccaaatctctgaacaaaaactcaatcacctgtgctcgctgcctttcctccctggcaggtaccttccaaaaaaataggaacataggaagtgccaaagcaaggaactgcttccaaggcagctgacatcactggattgtgaggtaaagctagaggtttctcccaatctgtagtggggaaatctggggacaaacatttatcttcagaggcctgtctacactgccccttccagtgtcacaggctgtcacaattcacctggctttgaagacctgtggtgttcagctgaagaccattctcccagcatcaacaccaacaggcaaaaccatcagatgaagctttcacagctgccaaggtacttgctgtcctcaacatatttcatactcaactcggctctattttatttaccagtctcctcccctagtcttggaaaattctcctttcagccctctgccaaaccacatccccatttcaaacctttccaatttctcacctccaaaaagcagcaccaggcaagcacacctggctccaattattccagcaatgccttcccccagccccagccccaaccccagctctagccccagccctagccccagccccacatccccctaacatgcctgattacttagcacttaacgtgtttatctcagcccagctgtagttgattacatctatttggttaagtttctatctcgtgtatttagggcgatgagatgtttctacgtctccgtactttctgttacaggtgttgctctttgtccctggatgcacggtgaccgtgagctccgagggctgcctgtctcctcactcctgcaatgctttgcaccggtgcccagttcacaaaggcagctgcagctgactgtccaactgcctggttctaatttatgtggagagaggcctccactcaacaaactgaaataattagttcttctaatcttctgcatttcaataaataaaagaaagacagggaaagattcacatgtactctgtcctgacgaaacagtagagctctttggaaaatcatgaaatttttactgtgcaaggcagtaagatataagcaatgaaactcaaaagcattttcccaagtattcagagaccagatctgcccccagatctgtaaatcctacttaatctaggttaaaaaaaaaaaaaaaacacacataagaagacatgagacacccttagtttacatttcagctcttaggtggttccttattcactgaatgctgagggtttctttaaggatattttgtagtttaacaactccagaaatgcttttgactctaattctcaattggtattttgaaatattaattttctcaatgtctttatattgacagaaaataaaaaaagaaactgagatccaaatgggtctacacatttgccctcaagtttaaacaaaaaagatcacaacagagggaagaccaaaaaagagggaagtcttttattaagactcacaatccagtgctgtcttctataccttgaagccttggtttaagaaacattactttatgcccaagccatacataccaatatcaataactagatcttcaaaaaatataattaatgagaaacttccatatatagaatttctagacttaacctatttgctaaactgctacatcaacatacttatttattcatgcaaatgtttatttcacaaatgtttcttgactgcttactatgtagtgggcactgttctaattcctggcaataccaactaaagataaaacatctatactgatgatatactagcagaagagatagacagtgaacatatttaaaaataaatatcaggtggtaatataagttacattttaaagtaaaacagtaaaagagagtgtgtctgttgtggggtgctatgactattttaaatggggtggtcaatgaaggcctctcagtggaggtaatggcaaagcagggactgggtgaaggcagccacatgagtaactgggagaagtacttcaggcaaaacaaagagcccatgccaaggacaggaggcaagatgtcagggcccactgcagcacagtgagcaatggtgagagtgctgggagaagggggaaaagatcattcagggctctggtggggattgcgcattttcattgaaatgtaaaaaaccatggcaggaagctgaactggtgaacttcgtgactggacggaagtctttcaaaagatcatgctggctgccacttagagaatagatcttaattgctaacaatgatagcagctgacatttatggagtgctgatgatattccacgcactgttctaagcaccagtcatgctttaattatttaatcgtcacagcaactctatgaagtagatactatgattatgcccacatgaggaaaatgaagcataaagaagttaactgacttgcccaaagccccacagctcatgagcagtgtagccaggcttccaacactggcgctctaccccagatcttgcactcctaagagggatgggccagaggcccactgcctctcaagtaaaaatgtgatggtgggtcagaccgaaggtggtggtcagaagtgggcagattcagaatatggtcttagggtagaacaaataggattggatatgacatctgagcaaacacaggaagtcatggataataatgccaaggactgtggccctggcaactgtgtggtagcgtcctttacagagctggggaacacaggagtaaacaaactggagacaggagggagcatggaactcaaactaatgtgagtgtgtgctcatttcccatactgctgtaacaaattaccataaactgggtggcttagaacaacagaaggctattctctcacagttctggaggccagaagtccaaaatcagcattgctaggccaaaaccaaggtgtcagcagagccacatgccctccagaggctccaggagagaacctgttcccagcctctttcaggttctcgtggctgctggcattctttggcttgtgggttccagaccaccaatctctgcctgcatggtcacacagtcttcccttttgtctgtgtcatcaaatccctgtcttataaggatacatgtgactgtatttaggggccaccagataatccaggataatcctccatctcacaattcttaatttaatcacacctgctaaggctttttctatataaaggcaacattcccaggtttaggggttagaacgtggatatatctttgggggccattatttagcctatcacagtcaggaataccacaaataaaaacaataaaacgtacaggtgtggataaacagtgagcaaagcttttcccttttacatgagaatttgatcttctgttaactctctcaattctgtaaccctggtaatctggtaagacaatatgtcaattataacacaaggcagcttgctattgggactggaaaattttaagacatctgataagaagtgacatctgggggcttccctgagagcagtgattcttgtaaatggggcatatttatgagacagagtaccatgaaaactattcctacatagttgcctactagttcccgcaagggtctaaggctttttttttttttttttttttttctgacatggagtttcactcttgttgcccaggctggagtgcaatggcatgatattggctcactgcaacctctgcctcccgggctcaagcgattctcctgcctcagcctcccaagtagctgagaatacaggcatgcgtcaccatgcctggctaattttgtatttttagtagagacgggtttcaccattttggttaggctggtctcgaactcctgacctcaggtaacccacccgcctcagcctcccaaagtgctgggattacaggtgtgagccactgcacccggccttcctaaggcttttaaactagagaactacacacacacacacacacacacacacacacacacacacacacacacacagagatctcatctcctggcatttgagccatcagctggagagctctggatggctatgtgaactgatgaactgatgtgtgaacagtcacaaggcacacaacaaggaggaatgccttgctgccatgccgtaagctgtggtccttgtcctatacccttttaagtataatgaagccacccatggcctatgatagtctcatgggtctgaatgtttatttggacccaagaagactccttgcctgagtttgttgccacatgtaataatatcgtttcagttcattatttccatttcttcctccaccacagttactcagcagcaaaaaggagtagagcatttgtttcatctgttcatgctcttgtgtggcctcactcaaacagcaaaatggctaaaaagggcaaagggaaaggaaaagctagagaacaaaaattagtaaattcacaaaaactgagctaactgttccctcagggagaagtgagtactgcctacaaggaacatgctgcgctgcctgtgctatgccttccagaggcctctccagcagaatgaaatgtaaaatccctaacccacagttctgctggaaatgtgcaagtgggctcattactcagagccaagataaaggataaatctttatgagtaccgtaagtatgagtcataaaaaataggaaacatatgtaggacgtatacacagtaatagcaccaagccagagaaagtgtttaggaaatgtatttaagaacacatgacaaaacaggacgaaaaattgcccttgtacattgctctaaaacacatttaaaaaaaaaacctcacagcaagtcaagggcccatatcactttgctgatctctaataaacatagatcatttccatatttggaaataggctggcctttttattttaaatgcaaataggagagctgaatcaagaaaaagtaacttggagtaggctttgaaagattttatgatttgggaaatttgaagagcttccaaataaaatactgggaattagatcttaacagcattaaaaatgaacacaaaagattcttttagaaaaataattgttcacaatggtaatattaccatttcatttagattctcactatcttaacaaccactggaaaaatgagtggaatcttcaaaccttatgaaagcaggaatcaaaaataaactgcaacacatgggctgacaacataccgagagcaatgaagggcctgcgtgaaagccctcacggggatgctgggctcagcaggaagaactcgcagcaaggaagaagcagagccccctggccaaaagcaccaagtgacaatctaggggatgagggcgttcagaatagaagggagggtgatcggcccccagaagtcttttggggccagatgactgaggcaaaatgtatcatcattggaaattaagctcttcagttgcctttgattttggaagatgcccgaatttaagacagcttggcaaggctaggagacacctacatgcccatgtgcccaacacggaatcatgtgtgtcccaacggacctttggctcccttggaccagggctttctcctttaccttcagaaactgctgcctcccaaggaaagcactgcttgcacatcgactgacctgaggttgagaggaggagcagaggaatgtggaaaggattgtttttaccttcattaagtgttaaatttacctaagactcccagagagtcaatgctcttcaggaactattctgaggcagaaatttcaatataacttccacctcatgaaaaaatccaactgtaggtcattaaaagaccccaggggcatggcgagggctgagaggtacgacagctcactttcgaccttttgtgctcaggcctctcagcagttgctatacctctctgcccctctcccccaaggcacctcggtatgtgctcacatcactggtagtgaggccacacctcactctgggagggggactcaccttttaagaagacatcgatgcagcttccacgtaaacgggtccacaggcatgcagtccctaacctgtggcaagcccagtgctaggcacagagaaccgacagccacatcaccgacttgctggagcaaattcaaaatggatcagatgtgtgtacacatgtatcaacaaatagaagttaagccataatgggcacaaggggacacttcagctccgggcaagagttaggctatggtagtgaccttggatcctaaagctgggctctgtccttgcttcacagtgagaatcagtaacacctcatctcattagctctcttatcttcaaaagtatccaagtcatacctgtaatttgcccctcatcctccaagagttgtacaaatttcaggttcagctgaaggactctgtggttcaggtggaaaaaaaaagccataaatacaaagcattattgtagggtgctttggactagaaccctgtctaatatctgggccttgatatttcagcctttcagacaaggccaaggagctcagagacaaggactccttcaatcagccagcagtgccactgaggtgccccggcgggctggacaggaaagcatggagaacatggctgcaatggaagccaaagcagcaggtcttccaaacacagactcagatgcctgtgtctttaagaccagaccctcataaatggattgcttctgctggacaccacgctctaaataaacagactcttctggccgacacacaacttcctgtaggattctggtgggtaaagcttgaaaaggctgccaaatccaatgaccagcaacttttgagctgacttagaaaacaagctacaaagacttgagtccagagtaaacaaaggaaaaagccatattaaacagggaacaaattactatatcggcagggatattttaagtactcactgagcaagaaaacaaaatcaaaaaaatcaagttataaggtatttaataatacacggtagagtaaaatgccctctttcagttagaggaatcaaagttaattaattccagcaatattaagaattggctggagtcaccccctacatcatgaggacagatcattctcaatggcccaacttcaaacctggctcagatcaaatgagcaacccaagggagctgcatagagttgaaaaccatttatagctttttacccagctgacggaaaggactaactagtttactagcagatgactaaaacccctcagagtaaagaagaatgtaacaaagatttagaaatgggctagggaaaagactgaacaaagatctgcagtttagagtaaaaaataagattaattaaaagagatttaattaaaaaagtaaatcaaagcagtcatacaaaatggaggacacctgcttagctccaatgttgaggggcctagggaccaaacactaagtccactaatagaatgcaaagcaaataaagatgcactatgcaaaaggaaagtcatttaagaagactttcagttatactctaaataacatccttggtgccatgcaataacccaatttgcataatgcaaaaaaagacccaagacctagttcctgcccgaaagcagtccactcaccagctgagtgtgcagaattaacacacacgattcagcagcaagtaatacaataaaacatataattccatactgtgggaaggcacaggttgtggtagggggaagaagattcagagcgatgtttagaaaagaaagaaatggaggagggtaaagcaatcaggcaagggtttggtgaagagctaagacctaagcatgggcttccaaagtggcaagaattgagagactgaagaaagaagtccaggtggaattaagaataagggcgtggggcaaggggtttagctggtaagcccagggggaggctcaggaatctatacatcaagggatccgatgcaggggcttcacacagcacacacactttgagaagccgatccacaggattaagtccaaatccttacgtggcctttccagtctcatcttccactcagccccagcctacccccttcattgtcttcatcctctattacaggaattgccaagctcttcctgcaaagggctgaatagtaactatttaaagctttgcaggccatgcaggtctctgacacaatactcaactctgccacagtagtgagaaggcagccatagacaacatattatcaaatgggtgtggctttaaaactaataaaactttaaaaacaggcatcggactgatgaatgcattaacaaaacatggtatagccacacaatgaaaactacccaggaataaaaaggaatgaaacaactgatacatgctacaacatcgaggaacctcaagtgctttacgctaagtgaaagaagctagacacaaaagatacatattgcatgatcccattcatatgaatgtgcagaacagataaatctagaaagtagattagtggctaccttgggctagtgccgggtcgtggggggcacacacagggaatgggagagtgactgttaatagatacaaggtttcttcttagggtgatggaaatgttgtaaaattagattatgggccactggttgcacatttctataaatatactaaaaaccactgacttgtacactttaaacaggtaaactttatggtacgtaaattatatctcattaaagctattttaaaaacacaaacaggcagcaggcagaattcagtcctgcctagcacccttgatctgtccaccagccacaccgtgtaggtgaagaactttcctccacacctggcgcccactctgtgtatattgagtcctcccatcccttggctcaacaacactaatttgacttttaagccctccgtcaaatgttctttcttctgggaatccttccctcacttccagagagaatgaacacaccctttgttgggcttctgtacttttttttttttttttttagacagcgtctcgctctgtctcccaggttggagtgcagtggcgcgatcgtggttcactgcagcctcaaccttcgggctcaagtgatcctcctgcctcagcctcccaaatagctgggaccacaggtgcacactactatgcctggctgtttgtatttttgatagaaacagggttttgccatattgcccaggctggtcttgaactcctaagctcaagcgatctgcccgcctcagcctcccaaagtgctgagattacaggcgtgagccaccacagctggccttctgcaaatttttaaaatatattagtcatattatttgtcatgtttcattaaattcattctctctcaactctaataggtgctaaagacataaaaatgagtaagaatctggcagagcacctacctagcacacagtgggttcttaatagtgattcattgaacaggcctgtgaatgaataaacaaattcattatgagagcattatttagagaagtttggttttatgaagaggttcacaagctagacagaaagaatcagggtctaaagctgaagaggccagtcccaggagaccagttaaggaggctccagggtaagtggagaaaaacagagaaattcaagggcaattgcagaggaaatgtcaataaaatgtggtgattggccaaatatagggtttaaagagaatgggcaggccaggtgtggtggctcacacctctaatcccagcactttgggaggctgagatggatggatcacttgaggccaggagttcaagaccagcctggccaacatggtgaaaccccatctctactaaaaatacaaaaattagccaggtgtagtggcgggtgcctgtaatcccagctacctgggaggctgaggcaggagaattgcttgaactcgggaggcggaggttgcagtcaaccaagatcgcgccaatgcactccagcctgggtgacagagcaagactgtgtctccaaaaaaaaagacaaaaaaaaagaggatgagtaaatacaagatggttcaaaagttccaagatggatggtactggtgacattgatgggtcagggaagccagattgaaaagccagcactagggtcaggagaactggcctgggagggttcttaaattctattttagagagaataaaaattactgttagctagcagttgactgtacctataccggccctaagtgccacagagacatttctcaatggtcagtgaaccctctaaagaagtgctactagctgggcacagtggctcacgcctataatccccgcactttgggaggctgagacaggcagatcacgaggtcaagagattgagaccatcctggccaacatggtgaaactccgtctctactaaaaatacaaaaattagctgggcgtggtggcacatgcctatggtcccagctactcaggaggctgaggcaagagaatcgcttgaacccaggaggcggaggttgcagtgagccgaggtcacgccactgcactccagcctggtgacagagcgagacgccatctcacaaaaagtaataattaaaaaaaaaaaagtgctattaacatctccattttacagatgaggaaacagggcttagggaattaagtaactcacccagggtcacacatggggagtggcagagctgagactagccctgtatctaacatgggagcgaaccacagtgacagccactcctccagtccatatctgaggcacctggcagctcaagatgggacccaagagccgggatgcttcagccatctgactgtagttccactggagaagcccaggcagagtttttggagttgtaagcaaggaagtgacaagcaaaatcctaagaccagacaagccacctcagggagaggagacagaggaaaacagaaagccaagggctatgcctcagtcaagaacccccgaggttaggcacactggctcacgcctgtaagctcagcactttgggagtccaaggcgagtggatcacttgagctcaggagtttgagaccaacatggtgaaaaaaatacaaaaattagccgggcgtggtggtgtgcgcctatagtcccagctactcaagaggctgagatgggagaatcgcttgaggttgcagtaagctgagatcgcaccactatactccagcctgggcgacagagccagaccctgtctcacggggaaaaaaaaaaaaaccccaagaagaaagagtgagcagctgagaaagaaacagaaaaacagatggaatggtagaatgagaaccaggaaaccaagagggaggtgccagaaagggagtgcttgacagcactggaggcttcataagctggggaggagcaagagtggggcaggcagatgtgtagaggcagctctgcaacagaagttggtgccccgaggggctagtccagtgctagcaccaagttcttggttaatagtgaacatgtcaccgctacaccctctggcctggttcccctaaggtattagggctaggtggaccccagggaccctctagtcctagcagcccttgagttgttcaaaggggcatcatcagggtctccccagagattagctcaggccacagagagggaagaagggaaagaaggacgtacagatgttcactcattccagtggagcaggggaaggaaaagagaaataagctgacctgaggcatcagaggggccaagtcatacatggcctcttcatcgtggaagaaagaaaagtgaaataattaaacgtgtctaaacttacacagaaatatttagaaaataccgtggaaggagtgattgaagtcaatgcaataaatacttctgcagagtttaagtatttaaatcagcgattagcagttaagtttccttttactctcaaacagaatgtcaagaagcagataagcaatggcaaggagaaggctcaagctggaaaactggagacgctgcacacgcatgcactgggcctttgcccaatcagcacatctgcatctcagatttgcagagctgctcctgacttgggtctattgcttttttttaatactctcccaaaagttctaagagcaaaatgtcacatttttaaatgcagagagtgctcttgtaaaaacattgtctaacaacactttcaggaaattatataattctttttttaaagccaagggcagttaccatggcaacagtagtacaggtcagggttctaaccctaacctccataaagacaaaacaccatactggttggaaaatgctgctgctggacaaattttaaaaggggtcagctgggcacggtggctcacgcctgtaatcccagcactttgggaagccgaggctgacggatcacaaggtcaagagatcgaggccatcctggccaacatggtgaaaccccgtctctactaaaactctactaaaaatacaaaaattagctgggcatggtggcgtatgcctgtagtcccagctactcaggaggctaaggcaggagaatctcttgaacccaagaggcggaggttgcagtgagccaagatcgtgccactgcactccagcctaggcgacagagtgagactcgtctcgaaaaaaaaagggggtgtcaaggcagtctctatctgggggaagaggcaataatgacaggtttttacaatctgtccagccagcatagaacataaatcggcattacctcattctaaaaaggccgagtccaaccaggctcagtccctctgccggggcaggggctgtactttcctggggcaactttacagcatctggatattactgtgacgaatgacaggatttaagtgacgtgaccaacctgcatcttggtaggaacgttttaacttcttagcttagccttgtgtcctggtttgtttcctaaaccccggtgtttgctattacctctctgatttctgctttcactttttctaaaagtccaagactgcatttttggagagttcctattggagagttagctggaattttagattgaacatcttgccccaaagtgttagacatcatccttgactagtgtgaccagtgccagctctcgcttgcattgtcctctgttgtgacagctagcagatgcattgccttgctgtccctaaccctgctcccctttccaggcctggactggcaccttcacacgacctagcagggtgtcattgtttaaattgcattgagtgtcttcaagtaaaggagtaactctttttatataatatgagtgtcctattcattcaggccctccaatcctatgtggacagacagattcagttgcctttgtaggtaatgaaatgatttctatagtaatactcaaataaatggggaagggaagaaaggagagaggaaatgggcaggtggggagagacagagaaaaaagagagagagagagaaatagtacaggcatgggccacataacaatgtttcaatcaacaagggaccacatatacaacggtggtctcataagattatagtaccataattttcctgtacctttttgacatttaggcatgtttaggtacacaaattcttaccattgtgttacaattgcctacaatattcagcatagtaacatgctgtgcacatttgtagcctagtagccatgggctatatataccatatggccgaggtgcgtagtaggacataccatctaggtttgtgtacctacactatgatgtttgcacaacacaatcccctaacaacacatttctctgaatgtgtctctgtcatgaagcaatgcatgacagtatctgttaaggactggtggaaaactaaatgaccatttcagaggtaatcttccctgtcaagctgggtgatttccagaacagcttccttttaaacaaacaccaggcagtgcttatatgcggaatgtatttgtttagaaaccaaatttcactgatatacagtgtctgtgtgtgaggggtttcctttgacacttgcttagtacataccacataaaaggtatctcaaacataaatagccctgggttttttgttttttctgcatatgcacaggactgcattaggaagtcatttatgaatagcagcagggtaaaaaatgccccagatagagaaaagaatgtagctagtttaatgtttttgctctcacatatgtactctcccaaaacccagccttgagattttgtatcagttcttttagtggtgttgggcaaggcacacccactcctccccaagcactgtattatctgaatctcgataatcgagggggaaaaagagaaaaggtgttcgtgtattaatattgtggaaatggggaaggattacatatagataggtaggtaggtagataaagatctccaaaatggtcaatctttgaattgccaaattccccaatgtaagcaaaaagatgtcaaatcagatggcgaagtctgaatactgaagctcttgcatatcattcttagcaagaagagtcagttaatatgctagttctctcttaccacacagttaaaacaagtttggatacaagacgtagtaaattataagcagaggacaggtgagctatttgtgtgaacacagctgaaggcctgggggtggggggaatgtttaactatgaaaacagacaagaacataaaaggccccttggtggtgccatttagcatggggattagcagccacatagagcacaatggctcctgagctcagccctgcattttataattactgacatgtggtgtgataatcctaaaccatgaaagggaaaaaaagagacactgccacacacagaccaacttaatactgccccaaagctgcaaggaagggaatcaaaaaggactccaagcactgcaaagagttattacaaacctatgcacagaacccaaaccctcactaacagacctacttgctggctgtctaacaaagcagactcagcagactagcaggttctgtagcccagaaccaagtaagagctaaaaggaaaggacaactagctggagtatgggaaaagcttgcagcttgcactgtagaatccaacagacacaactcgggggctggctccacaactcaccatctggttgtataacctccctaagcccaagcatcctcttctgcaaaaacagtgaccaccaagcctccctttcaggctgacgacaagactggcagaaccaaacaagtgcctggcaggtggctggcccacaggagacacgcagtcttcaccactacggctgctagtattgtcatttgggggatgtgagagctgttaagaggcaagtcgagcagttagcacttgacagtgtttacttccttctctttctccccactgtggtctttcctgccctcaaaaagaaccaaaaaagggacagctttatgccaatcctcagagaaggtacaaagtaaaagtgacttggagccacatgtgtgattaaccacacatcccatttgtctgtgcctgccaaaaagcctggagccaaatttcaaacacaatcataccaaccacataaacccaaatggctcgcaagctgcacccttctttttcccttggtcctcattctgtatttctgcttacactgttggtatgcctgttgctggaggctcatcccaaatcctcttttggaatgaggcagagaagctcatagggttatgagctttttgacgggtgaagttattaaacctggcccctttcccatggtaatggagcctcctgatccccactccacccctacagccaggcactggcacgcccattgctcctttaatgtcaaaacaaatgcataaatttaaatgtccatatcttttctacacatatgtaatggctaacttgggacttatcctcagcagcttttcataataagcaagcaattagataggtcagaaatagaaaagacacaccaccacataaaagcaggtcacaagtaaaaattagatgataggaaacaaaattgttgccattccagcaactaatgaaagtatgttactgtaaacaagcctctaatggtgctgtaacccctctcaggaatcaggaaacgccctgagcaattaaactcgggagtccgacacaagggggcggctgcattttacttcaaagtcagagggtactaggagctggttttcatggggatggaaaccatgacactggtcctcacttgctctaaaagataaatctgatctctcagcattgtttatgctcttctgctgtcctctgttgccagaaagtcattttccagtttcctgttcgcttccaaggctgttgtttccgaaaccaatgattacaaatgagaggtgtgttctcagatgaaaaatacaataggtctactctgacccgaggagaacccagcagggaggccgatgacaaaacattgctttggtactgagggctttttatgtactgttgtaacaagtgtgtttctgatacaaattctctgctggcctataaaactgttcatccaacttaagcgttactgtctccctaaatcttgtcaacctgctgcagttactacttttgggtgtaggctctgtcaccgcctctacacaggaaaattaaaaatctctccccagctgaagaactttaaggcacctgggaggtaggaatttattaatagtaaaatattagatatggggtgatttataatagatcttgatactgatcttgcaccaataacaagccaaggggaaatggggctgatttagtaattccctcacatttaaggatgacatcatgaaaaccaactactccagtcttcagtcatagtcaattacagcttggagccagcacggtaattgttttgctaatttgtaagtaacggcacttatttcattttgaaaaatatttgcctttaatatttggtagaggccaggtgaggtggctcacacctgtaatcccagcactctgggagtctgaggcggacggatcacttgaggccaggagtttgagaccagactggccaacatgatgaaactccatttctactaaaaatataaaaaattagccgggcacggtggcatatgcctgtaatcccagctactcaggtggctgaggcatgagaattgcttgaacccgggaggtggaggttgcagtgagccaagatcacacaactgtgctccagcctgggtgacacagcaagactctgtctcaaaaaaaaaaaaaaaaaaaaaaaattggtagagactgcacaaaggctgcctctggccctcctactattaccctcaaaacagatcagctgttatttttagcatagaccatatcatgacatatctacaaaaaccaagttatccattgaaaataacaaaaagcattaggtgagtttaagttgaaggagtaagcaatcttggtaaaagtgaattgagccaacgtaaactttatagactaattagcatgtcagcaggtcaaacggtttttttaaatagtttcattgagatacaattcccataccataaaattcacccacttaaattacaattcaacagtttttagtatattcacagaattgtgcaaccattaaaattttagaacatttttgtcatctcctccaccttttttttttgttgttgagatggagtctcactctgttgctcaggctggagtgcagcagcgcaatcttggctcactgcaacctccacctcctgggttcaagtcattctcctgcctcagcctcccaagtagctacgactacaggcacccgccaccatgccagctaatttttgtatttttagtagagaaggggtttcaccatgttggctaggctagtctcaaactcctgacctcaggtgatccacctgcctcggcctcccaaagtgttgggattacaggtgtgagccacctcgcccggcctccacttttttaaaaaaacatgtaacgtttagcagtcaacctccatttccttctttcccctctagccctaagcaatgactaatttactttgtctctataaatttctgtatcctgaacatttcacatacatggaatcatatgatatgtggtctttgtgtctgtcttttttcatttagtggattttcaaggttcatccatgctgtagcacctatcagtatgccatcctttttactgctcagtaacactccattgtatggatataccatattttatttacccattcatcagaagatgaaaatttgggtttttccacttttggactaatgctgccatgaacagtcacagacaagtctttgtgtggacatgtgttttcacttctctcgggtatatacctaagagtggaattgctgggtcatgtggttcaaatgatttttaaaaactgtttgcatagctgcgggaatgttctccatagtcatatgtcaaaagagtgagcgatatttaatccttatacacacccatcttaccaaccacaaacaatctttcattctctcgtcctgaccctcattctgatgttatcctctatgctcactttgtatatgcaaactactctgagatctgccgtatgtgagcaacgcagagccagatggaatctccaaaaatcagttatcccaaaatcttgttttcaaacagtattgaactacaaccatctaattcttaaaggtccgtctgttgtctattctcagaaacatcttcaaatcactggcccaaaatcatacatatactatactaatatcgaaagagaataatgttcaggtttttaaacaagtttgagactaccctttgtaggccctctttcttttcttcctcactgaacacactatgtccctgatgccagctaatgttatgtatcctcagtactgccaggtcctaaaatgaatcccattttgaataacatagtaaccaagtgcaggagagctctgctgtcactcctcgaggtatttttctcttgtttcagtagtcttactcgaatttgttttcagagtcaacaacagtactgcacaatttaacgtcaagaattttctgctgttgctgcttctgtaacagcttggactttcttttccctctgagttcctctgagagaagcatatataaaatgagtaattgtcgctgctaaagaattgctggagtcagcaacgcttcataggagctgcatttcctcctctcctcctttccctctcaccacaaactctcccccatcagttcagaattaaaggcacattactgggataaagaaatctgacctgaaatatgagttgcagcaacaatggcaagcaaccaagagtattaacaataatttccaatgttgctggaaaggttagatgatctgtctttgaaatgagccaactctgcacacgttcatgagattaaaatcagcttgcttttccttaacatctcgtgcttctcctcttcctaccaccccaaaaggatggggtggctgaggcacataaacaagtggctctggaaattaactttcttgaccagaagaaagctcaaagataaattccattctgcattacttttcctatacttcactatgatcaggattttttgtggtttctctctccctggagagcgaatacctgagtgataacatttctgacacacagaagcttaaaaacagaatactctgtgttatcttgttgggaaatctgtactcttaaatgatgaccattcacccacaatctaggccatttttgagccacaggaaagaggacgccatttctctctgaagatgatgaccttgcgcaaataagttttctgcacctgttttgtcacctgtaaaatgagtataattgtaggattcatggagttactgtatgagtgcttcgaacagtgtttggcagagtaaatgctgagtaactatgagcatatatctttatcatcaccatctccgctaatgtcaccgccacctttgggaagctgcctagatagtgataaggagctatgctcagggattttcaggcaagtacaaagtaccgccatctttattccagagtgttcccatttcccctcactcatcctgcagaagcaataagttcatatgacaaagtaaagaaagaagacagaggacacaggaggaaatgggaaagacatttcacaacaacagagaaaacggtaccttatttggtttctcacaatcatgtttaaaagatgaaattattattattatttttgaaacagggttctgctctatctcccaggctggagtgcaatggcaatcacggctcactccagcctcgatttcccaggctcaagcaatcctcttgcttcagcctcccaagtagctgggactacatgtgctaactaccacaccctgctaattttttttttttttagttttatttttagtagagatgaggtcttgctatgtttcccaggctggtcttgaactcctgagctcatgcgatcctcccaccttggcctctcaaagtgctgagattacaggtgtgcaccatcaccatgcctggcctaaaagttgaaattcttatgaacgtttttttccaatacggagggccaggaaatggggagagccaaccaatctctagacagagaaatcctaaagttgcccaatccagacagcagctggtattttaaatctgttctcttatgttcatacatgagcttcttttgttgaaccccagaagagaagaaaaggacttctgtccagaaaatcatctctgcagactcagtggcagtgggctgagagctgacacctgcacctacctctctctgtagctggccaggcccctggcctgcagtgcggagattcaggacatgcacctcctgtggcagcccagttgtgcctctgctggcacagcctgacaaaacagtgaagctctccatcaaggcctggacaggatgggaggcactgacaggtgacagttcacacagtgcaccaggctctggacctgccaagggaatcacaaacacaagccactcagaaacagcaattaattctgccccaaaggggcaagggtgatcaaaccactgccaacccaccagagatgcctttccaggtaaactgttccaagactaagtggccaaaaagctagcctatcttctaaaatcccaatctcttaaatttcttttggataatttggtatgtatttgattttttaaattcccttttggactcacaagtcatgaatgcattcctctgggtagaagacacttcccatttaacatttgtgtttaattccttcttccctcttggtagaaaatcagagataaaataaattgcttaaagtcccaataatactatacataaataatattaaatacctaaaattgcacttaacaaaagtataagatacagatcctatcttttcagagcttccctttattagggaaagcaaaacaaacttaagaacaatacagagcaagatgtaacatgtagaggcgatcagggccagagctgtacagcaaaatttgggccagaggtcagaaaaatcctcccaaaagaagtaggatctgagcagagcctcaaatagaaaaagtagagtgctggtcatacttggttcctgcttcttcattccctcttcctctaatcagtcaagccttaaatcctaaatccatccactcctctccatctctacttctttaccaaccctagacaattacaaaccttcctgaacggagtctgaggactcaagctctgcatgccaccttccacacaggcactgtccacctaacctagaggcactcaatgttacgggtgttcccaaagcaaatgcctgccgttggcatctctgtgggaagttcctgtcccttcagaatagctgccctaccaaataaagcctgagctccaccacagagcacaggaggcccttcttgatctagccccttcctatgtctcatccctccccactccacgtcaacttatttaaaggtctccagacacaccaggatgtttcccaactccatgtcctcattcaagcctgcttcctttacccaaattcctcttccactctcactccgcccccacaacaaacatctcaagctgaggaaggctctctttctctgccctcccgcaatccatctgcctgtctccactactgcatttacatgatagccactggtgtacacatccatctttattggtcgaatgtgacctctctgagggctgtgggtactcatctttgtatcctcagcattcatctgcagtgcctggcatatatgagatgctcaaaaaacgtttgttaaatgtataaatgaatcattgagcttaaaaaaaattgccccctctcagatcagtgagtagggcaccattccagggacttggatttggctgtagggaataagggaaataggctgctacagccctgacatcactgcagcctcctttcacattggctggattgatagagacatacccaggggaagaaggaactggatgcttactcctcacacacttctgtgagcttggtgctattgtctccattcaatcacccaggaaactgggctgaaacagtgcccactacaccacaacctcccagatagaacccacgaaaaaggcctgaatgtactccagtttgttcttcctgacttctaaataataaaggtaccctccagggttgcaaacaaagttcagaaccagccagtctgcacccagaagcagacaccctgcctggtgggccaagtctatttcaggacttacagaaattatctaggctgataatagctatctggtctgaaatgaagtatgtgccttctcaaatagtcactgccactctctggactgtggccagctgctttctgagaaagcataaggtggtgaaggaagatgtcccgagagcaacaacaggaggtactgactgtaaattccctggagcccctggcggggtgcggggaaaccatatgggcaggtgctccctctgctgccctcatcctgccctcctggcctccggctttcccagccgcagtgggatgtctggtatacttcacacccagagcttcaagaaattatcctactcctactcaattctggggacacacactggctacagctacccacactgggaaacccttctgaactggttgcagagcctcctgccatgaatttacaattatcacaaattaagcacaaataaaaatgcctttcagttccattcttgtatgtgtgcaaagctctgaacaggctgaaaacacatctgcaaaaaggcctgcaatctatttgatctgccctcctctgcatgatgccaccatcacccattaagatcttccttaaatcaccatactgctcacctccacactggggcaggggcaaaaactcaatggaaacaaatcaaataataaggtactcccaaagagggagggaactagtgccaggaagccttcagtgctgaagatgtgcacttcttgccttagagtctatgctctctgttttgccagagtccagaacagggcaaacaccctctttaagggctagagctctagccacgggttggttatatgagtcagtccaaggtcaaagaaaagagaaagcaatgcatggggcacaccctgatgaagtgacaggacagcgactctttacagagacccactggaggccaggtgcaatggctcatgcctgtaacaccaacactttggaaggccaaggcaggtggatcgcttgagcccaggagtacaaaagcaacctgtgcaatatgatgaaaccccatctctacaaaaaaaaaaaaaatatatatatatatacacacacacacacacacacacactcacgcatatatatacatatatgcatgcatatatgtatatatatgtgtatatgtgtgtgtgtgtgtgtgtgtgtgtatataaaagcagttgtggtggtgcacacctgtagtcccagctacttgggaggcaaaggtgggagaatcacctaagcccagggaagtccaggctgcagtaagccgtgatcacactattgtactccagcctgggtgacagagtgagaccctatctcagaaaataaaaataaaaatacagagacttacttggcttgacgtttaaatacactcaacagtgtgttcctgaccatctgacacaatagagtagtatttggttttcgaagttcctcatagaatttttttccctccaagattgaaaaagaaaaaaagctacaacatatgattaaactatccttacaccaaaaagacaaaaaaaaaaaatcaggaattatctaccaccatccccagggtcatataagaaatggtatctttaacagttcagcatacaacgtaataagagacactgctcggcccagtgcggtggctcatgccggtaatcccagcacttcaggaggccgaagcgggtggatcacctgaggtcaggagttcaagaccagcctagccaacatggtaaaccccgtgtctactaaaaatacaaaaattagctgggcttggtggcgtgtacctgtaatcctagtactcaggaggctgaggcagaagaatcgcttgaacccgggaggcggaggttgcagtgagccaagatcgcgccattgcactccagcctgggcgacaagagcaaaactctgtctcaaaaaaaaaaaaaaaaagagagagagagagagactgctcccatttattaagtgcccactatgcaatgctaggtgctgcatatccttctgacacattgcaaggaagcagcactaaccccattttaaagaaagcaaagtaagctcaatgtgcttaagtaactgtttcaaggttgccccagtcacccaaagcttcagacttggccctccttgcggctctctctctcaggaggcagggtcctgaagtgcccggccttgcagtaatcagggcaagagagatgatggtgcccgtggagatggagagaaggggacagagttaagtggccagggagagaatccactgggtgaggagagggaaagggtgaccaagcattgtacggtgaacatccagcccaatgcctgggctactgtgccaacactttctgtgaaaataaaaaagtggtcatagatttaggggtgagatctaccgttttgtaacttactttgaaatacctcccaaaaaataagatggattgacagatggagagatatttgataaagcaactattgcaaaatgctaattgtggaatctaaatgttccctgtacaatggtttcaacatctctacatgttgaaacttttcattaaagaaaagttgggagagggaggcaatgcttataaaaaaaattaagcccagaaatgccttaagaaaccttcctcaaaaagtgtgccagcatcacactgctgctgagagagcaaattggtataatttttcagtggtatccaaggccccacaaaaggtacacatcctttgacccagcaacttcccgctaggaattttatcctgaaaaacataactggataagtttgcaaggggtacagaatgtacaagtgaaaaaaattaagacttaagggaggggacaaaaagtccctgtgaaaacacccaggctaaaggacgtaggttaaactctaagtatggggtagagtagtcctctcctaagagaacagacacagtgtaggaatcaggggagagggtttcctttgggtaaaaaacaagcctctctggccaagaaaggaaagaggcagtgtgattgtatgaagttttcctttgaatatcttggagagacgctcttctgccaccagctgttccatcgccgccttccaggtaaaatgcctgccaggccttcctggagtgcactatcctttttccatagattttctcaaacacatccatgggttcaactctcatctctttacagaaatgactccaggccatctcagacttacttatttctccttttttttctttttctttttttttttgagacagtctcgctctgtcgtccaggcgagagggcagtgacgcgctctcagctcactgcagcctccactccccaggttcaagcgattctcgtgcctcagcctcccaggtagctaggattacaggcgcccgccatcacacccagctaatttttgtattttcaatagagatggggtttcatcatattggccaggctggtctcgaactcctggcctcatgtgatccacctgcgttggcctcctgaagtgctgggattacaggcgtgagccaccatgcctggcccatacttctttttctaagctccaggcctgaatattcaacagctccttcaccatctacttttgtctcatggacacccaatctcaacatgcagaactcaggatctttacccctcgtgcctgttgttcctccttcattccctccctaagtaaatggcaccagcctcttcctacgtacacctggcaccaacctgggggaggtgccccaacatcaccccttccctctcctcacccaatggattctctctctggccactcaactctgacccctcctctccatctccatgggcaccatcgtctctcgttccctgattactgcaagatgctcttaattcttatctccaccaaaatgtcttctatagagcagccaaactgatctgaaaaacccaagtctgatcctgcttttctctgctttaaaagacttatcactccatctctgctgtccagatgaagccccaaaacctcaacgtgacttacaaggccctccaagatctggccctgcttcctgccacggccccgtctctcattcctcggacacttgctcccgtgttttggccattctggtgaagcacagaagtgctcactgtctccctatagccatcattctcctttcttcaagtgccagctggacacacagccacccagaacgaaagctatgtttcccaatcccgctagcagctggcagcttcctgtatgaagggaaggaggtcagttcttctgccatttccttctgactgctggttggaatgtggatgtaacaggcagcactagagcaagcctttggggccatgagacagaagcagcatgctgaggagggcacagcaactgagaagccacctgggtacttgatgaacatggagccacgggatcagctctgaactgcttttttttttttaataggaaacaaatgtaaactcttttttttatataagccaatgttattttgggttttctgacatttgtagcttaacctaccctaattaatgtacttgccttcttttatttcatcagaagtgccaacctttgtcccaaaggagcctctgaatagcaaggtttcctccaggaacacattccccaccgtttctgttccttcccaccaccatggcctgacaaactcctgctcattctactgatctctcaaggaagctccccaaacctccctcactgtgttagatctgtattttttcatactctcatggtactctccgtttctctccacagcacttcctgtgatgagatgtacataattatttgtgcaattattggtttcacatctacatgctcccaaagactgcaaacaccacgaaagaacagaacccaaccactctgtctgctgctgcctgcctcaccccagcacagtatctggcacaaaacagacactcaattatcgctgagaaatggggaagaaccatggggtgatgcatgctgcatgggctttgtgccaataagggactgtctgtctcagacttcctgctttcactctttacctgagagccaaagcctcactcttatactaaaaggggcagaaaaaaaaaacaccaaccatgaaatgaaggaggtggcatttttggttgctaagaatcaagtcccagttggggcttccccaccttcaactgtcacagaaagcaggaaacacaaatctgtttttgtcttctcttcccggacactcttctggccaatcccctctctccaggtggcaggacaatcctctatctctccgttggcacaccacagccccagcctcatcctgccacttctgggtcaggccctagccttcctgtccctttccctctgccacagccagctcatgaacctgtctcccatccttcccccttggcctcatagtggttccttccgcaatctgtctgcacaatgccagggccagctccattcaggaaggcttccacctgggaacagcatgatccaccccacaggctctagcacaagtgcctgagttaacacagtggctcagattctcacttgaccaccatggggcccgagtatagcacctcccagccacgaaggcttggaaaccaggaaaacatgctccgaaaccccatctgactcatctgctcacttttgtggtgacctgtgagctctggagctgctactgtaggccctcaccggcagcctcaaaaggctgggagtgtctcctgtggccacggctgaaaacccacatcccgtcttccctacgcaatctcttccctgcagtcaagagccaagtgagtgacatgctctgatgatgctccttatcagcagcacagcaaaagctgtgttaccacgtaaggatcaaccagggcgtggacgatgacgaaagaacacacctgaaagcaacaatgctcataagcacacacgcgtgctcacttcacaccatactctatcatgaaaaggcatgttgcagatacttcatccaaagcctcacagaaactctataacccactataagtaaactgttgtgagccacacagaggtagaatgtgtatttcagaaaagtgcttcctggcagtaatgtccatatggattcacctccagagacaatcctcactggtgcctcccaatctggatatttcagttcattctgggcatctggtatgtgacgagtacaagattccttaagggtagctcccaaagaaatctaacttttccttggactcaaagtgtgagctgagtttaatcctcccctgctggcttactcgagaaatctgatctcaaaatcttgccgggtgtcgtgtcttgtttgaactgaagtcaggctctgctcttctgtttggtacactctcctcggccaccagcacagaggcacagcccccttcacccacaagatgctacttctactgacaaaaatatttactgacctgaagacagcacaaattcaaataaactctggtgagaaactccccaggtggcccagaccacggccacactgccaaggccactgccaaaccagcctccttcacaaagcaggcccccaccgctcgggtgctcagcagctgggccacctgaggccacactgtgaagcacatggtggctccctgggccgctgccttgtgtgagaagctgggggttaactcttcatatgtatggttaccacaccactaggggccacacatcttgtacatgtttctgattctcacaataccactgtgaagacagtgttaatgccctcattttagagtgatgggaaactggagctcatgagaggctaagaaacacatcagcaggaagtggcaataggggatttgaacctgggtctctgagactccagctccagacttttcccctggcagagcaccacctgcctctgccttgtactttccagttcctcgcctcaggactgggtgaacagatgcataggccaaatgtaaacattcattcatatctactaaaataaaataaactgctcggttcacacgtatcacctttggttgacttaaaagacttcatgaacttaatgaaactcgtttctcattttaccaaatgccctcctccatccttttcactaatgcttgcttatctggacacatgggaaacgttcctaagatctcgctataacatcaatgtctaaattcccagttccacttaaagaaaaaaatcaaatggactcaccctttcattatgtcctttagctgcaacacagcattccaatctcagttacagaacccccacatccctgctggcggtgggccagctccaaaactcgacagaacgcagacaaagcatttgggaacagatgcatttgctgcacagactttaaatttaatcagtgccaaaagaaattactaatatcacacctcatgcaacatggacaaaaatactggcggggggggtaatgttttggagaagacatagtaagtaattttcacatttaataaatgtgatcctcaagcattctaaataccaatgcataccaagttgacacaaacatctggtacctattccacataattttcagcactctgattccccatatcacccagggttctaatgaggagcgtgtgttcagctgtaataaaagtggtaaagatgcagagggaattaaggggtaacattataggctgggaccaagacatcgcagtggggagattttattctaatgacaccattggctaataaggtttttgttattgtcccacagggaattctgaaatgctgtcagctgcaaagagggacaaactcccacagattgtgggactgggtactacaggatctattctgcccttgggctgaaaatcctttctacccccatgggatgcaagaatctgtaagaaagggcacccaggatgatttctcagccaatagcactgcctcacttcaatcgagcttcatgagaaggaatgttaccaacacaggatatgacgcaaaaacaaagctccaagaaaaaaacacctggaatgccctgagctcacaaacacgcctgacgtgtacataacatatgctcatgtttgtaccatctcaaattacaattcattggaactacagcgccttggggatggagcggtggaatgtaccaccattaaactccaaagagggcgcttctaccacagctcctacctgggtttttcaacaataaaacctggcttcaggctgaagcttatccctagtaggaaaaaggtagacaagtcctaaaacttgtaatttggatttctcagggggaaaaaaactagatttttctacagcacaactcttaggcatatcttatcatggtttctttcaccctccaagcaaaatctacatccaaaccttcctcctaacaaactaaccctcttccaagaagtcaaccaccaactttttgggccaaaagccagtgcatatttgtgtattgttgtgttgaaatcatggagcaaccatgttggagaatttcctgtattcaattgtgttttcaaatgttcaaaaggaaacaaagggcacaggttctttaggaatccaaattctcaaagtgttgggaagtgccaagctataaaaggcacatactcttccatctaaacaagataccactatacaatctggacgtgccaacagagggggatttctgcagccctctgaggaagtggtgctgttatgtttcatggtttttatgacctgaagtgaagcagtggcatgtctcagaagtcaccactggacatagcaagaggtgtccttgtattacagaagcaccgggaaatagtgaaccaggagatacaggagctgggttttaagcattccatgatctcttattctatgacaggcttgacttatagatcaaatgatgcactatatgtgaaaacgctttacaaacttcaaatactattagagacataaagtcccttgaggggaagagaaataaatgaatgagaacattttctccaatcaaaaactgttttctctaaaaacttttagaatgattaataaaatatctaagataagatgttcttatactactccctagcattactccccagaaattatttctatgaattgcactggaaagacttaaaataaaactacagctgggcatgtactccctgtaatcatgcctgtaatcccagcactatgggaggccaaagcaggagtgcttgaggccaggacttcaagaccagcctgggcaaaataaccagacccccatctctttaaaaaaatttttttaattaaattaaactatgcacagtattagagtaaaaattcctgttctctgagcacattctggaagtacaactcccaaaggcgagaacaggccatgtttctgcctccagggaattccatcaatccataaagacaatcagttggcatcatcttggccaacagttcttctgatttactttgtttggtattttgttttgttttgtttttggagacacagtctcactctgtcgcccaggctggagcacagtggcgcaatctcaactcactgcaaattccgcctcctgggttcgagtgattctcctccctcagcctcccaagtagctggaattacaggcatgcaccaccacacccggctaatttttgtatttttagtagagatggggtttcaccatgttggccaggctggtctcaaacccttggcctcaggtgatccacctgcctctgcctcagcctcccagagtactggaagtgagtcaccacaccgagcactgatttacttttgaccaataatatggtgcacctgtccctattcttctcacaagaaggaagcttaaacagaaggagacactggctacagcattcattttggaggggataagaatttatgggatgttactgcctaattggctcagaacagagaccaagaacaaatctgaaggtttgaaggatgggagaaaataagatcttttttctcctaccctatgaatttggcagatacaaaataactgaaggatagtacacttctttattaaaatgcaaatgctttatcgacttagattcaaaatattaaactgaactttatcccataaaaaaattacaacttaattcctactaatgcaatatctgatggcaaagtaagacttgcagagctacaaagctacacctcattaaccctgagggatgacattaccaaatctgttcatctctcagaccttgatttgtacctaagatgatcactaattttctcttttttatcatttgcaaactggtgtctagcaagaaagaaaaagatgggagaaagagaggtaagaatgtgtgcaaaagcacggaggaataacatgcattgcatgtggcatgctctgggcctggtgagcattctgttagggctggtggccagggtctggggtgcagagtctgaagcagagacaagtggcaagatgagaaactgtaagagggtcaggaagggcagaagggggaaaccacaactgctggggagttgaatcatcgcctataaccactggtcctgattgcagataggagaccatggattaaaaaaggaaaatctgcaaacttttggtttggctgtgcaaaatattgttaattacagccatgtgtacacactgggccacgaactaaaacacatttactttaaggagtttatacataatcagggcactcacaattggttacaggaatgagtcaaatgcttaacactgaatgccaaattattcagcttaatatataggtcccaattataagactaaactctattccttcctcttcaggctagctagcctgctgcttcaggtgcttctgttaggagggaaactgagagctgacatttgcagagaaattatgaacacctggtcactggtgtgctcttgctcctttcacagtgaagctaaaaggctctgagaagctgtggacctggtttttccagagcttgtggcagttacaggcccatcaagcagtgccatcaacagaactactcagtgtagactgggtcttagagagacagaaggattgtgctcggctcagttgctgtggttcagaaccacagttttttgggggtaagtggacggggacaaggtctggctttgttgcccaggctggagtaccatggtgcgatctgggctcactgcaacctctaccttccaggctcaagccatcctcccacctcggcctcccgaatagctgagactacaggtgtgtgccaccacaccagctcatgtcttatattttttgtagagacggggttttgtcatgttgcccaggctggtctcaaactcatgagctcaagcaatccacctgccttggcctcccaaagtgctgagattacaggcatgagccaccgtgcctggcccagaactacacttttgtattgcacctgataaaattcagaggtcccttaaactgttacacctgttactcctttatagcaaatataagcttttataaatctattgcttcatttatttgggcatatgtttgtgtgtcctctacttaccagaaactccatgagggcaaggactgtgtttcttttacttcctctctcccagtgcttgacacagtgcctggcatgcggcacgtgttcataaacatttgttgagtgatgaattcatgtgccaaacaaccaaactcccaagctgctaattctctaaggactatggagccagtctcctacgtttaatcccagcgctgccacattttagccttttaacctggggcagctacttagccattccctgcctctgtttctttatctatacaatggggataataacaggatctgccccataagactgttcttaggatcaactcatttttattattgtattactgtaattattaccatctcttcaactatgagatgtgttctggaaaaaaaaatgcaaaagagaaacttcatcaaagcacttagctaaaggaaactacatcatttgagtgccaaacctagctctgcgctttctagcaggcaggatgaaaagaaaatatgatgctcacatagatatcataaaaaggaaacaaatcacaggcaggtgcagtggctcacacctgtaatcccagcactttgggaggccagggtgggaggattgtttgagcccataagtttgagaccagcctgggcaagagagtgagacctcatctctacaaaagattaaaaaattagccaggcatggtggtgcacacctgtagtcccatctactcaggaggctgaggtgggagaatcccttgagcccagggaggtcaagactgcaatgagccaagatagtgccactgcactccagtctgggtgacacagtgagaccttgtcttaaaaaataaattaataataataataataggaaacatcagctcttgcaagaaaatacttttccaaggtctcaatttaagaggcctgtaataaagcaagaatcagtgatttttaactttttaaaccaataatttgcattattgtaggtatgaaagcaagaagcaaactggcatttatttgctaaaagcatgtgatggagtttgtgatcttggcatgatatatgccatgacatatatcaaaaagtttggattttgctgtgtcgggtcaataagcaatttctgaaaggataaaatctaagcagagatatcagttcaataaaaggctaagagagaagggtataattcaatcaaattgtatttaacctaaaaataagataaagtactgtactattattgtttaataaactctcccccaaaaatttaaaactgggataaatgagatacctgttcagaaaaacatctattgagcttgctcaagacgaaactttacatagtaacatactgtaaaacatacatctgtatctgacaaagcaaccttccaaaacagatgtgtcatatgatgtttcaaagctgatttccctttttttttttttttgaagtttgtcacattcagtgaaagtaactgctgtttttcagaaatccgtgtgtgttattttggagaaaactttgctttggtgtttttccactctggatcaactagctcctctcttttcctcccaagcaaaccttcgtaaaccacactgccagagggaactcacctttctcccatggagacagctctaatacttgcaaatggtcaaactgaaaataaaatcccttgcatgccatttcctccaacaaaaagggctttgtctcaagatttgcacagaaaaacataccaaagctacatctattatttaaagtagtaattccttctctcagtatttcatattcctttcttcccaccttacttcatctggcccaaagaaccacctttccgccacacaataaatgcctcacttattcaacattgactggcaatgagatattccacataagcaaattatccaaataactaagtcttttcttgtttcaaaaaagtaagtgtctttagtcagttttaaggaaaatctgcctaaaatgtactacatgcataatttcttcttggccatcttaaatattttgagcatcctgaaactcgcttattgtatatttttcttgaagatgtagggctgccattatgaatactaattagtttattaaaacttgatgtgatttcagttactatatctaccaaatggtcccatatttctgtgctttatagttttttcggtttcgtttttgaggtggagtctcgctcagtcgcccaggctggagtgcaatggcaccgtcccagctcactgcaacctccgcctcccgggttcaagcaattctccctacctcagcctcctgagtagctgggattacaggtactcaccaccatgcccagctaatttttgtagttttagtagagatggggtttcaccatgttggccaggctggtctcaaactcctgacctcaggtgatttgtccatctctgcttcccaaagttctgggattacaggtgtgagctaccgtgcctggctgctttatagttttgcctatacttttcatacttgtgggtttttttccagttctggctgcaggcctgtgtctctgcctcaagcctatcacttaccatcttttacactcttatatactcaattttaagtcaatcaagtctggatgaagaccagaagatggctccccaacccatccacagagtaacctatatggacttttgatggctattttccttgtaactcactaaaacgttctgacttccttcatgatgcacaaacctgctgtaaaactgatactgtatcataatattagtgacaatattagggacactgtccacagtaatctaatttgaatggcaaaccatcaaagaaagttaagcttatgcactaaaggtgaactgttgggaatttagttcacaacaaaaccatgctaaaagctctattctattgcttctggggcttcaagcttttcagaagttctaagagaaaaaaacaaatgtataactaggtatgacaaagttcttatggtccctcaatcccattttctcatggtgacctccccttttctttcaggatgaagagatattcaacctgtacagcccagattaattacaattttagcataatttgcacattttttccactctagtttctcaatggaagttgtattcaccattccttcctgtcttctttcttgagtcagtgccagcaagcactgttcatagaaatcagatactcctaccagtgctccctggtccaggtcagtacgaatgatctaccatgaaccacagagtccagggcaggctggaaagcaccacctcacaaagaaaacacctaacggggccacccaaaggcccctctatggcagcagtccccaacctttttggcaccagggactggtttcatggaagacagtttttccacagaccgaggaggagaggatggttttgggatggaactgttccacctcaggtcatcaggcattcgtgagattctcataaggagcaggcaacctagatccttcatatgcgcagttcacaacagggttcacactcctataaaaatctaatgccactgctgatctcacacgaggtggagcttaggcagtaatgctcactcacccgctgctcacctcctgctgtgtgccccagttcctaacaggtccgtggcctgggggtggggacccctgctctatggtacaataccatttgcagctttctaaaatccagccatgacatggaatcttccctgcctttccatgttgattagaagtcggggtccaaattcactctttgcaaatcattattatgtaaggaaaggcatatgtatatgtatatgtatgtatatatacacacacacacatacatgccaagggctattactgtttctcatactcaagaaggttcgcttcctaagctccttcctgaaatgaaatcgtttctttgcccgagagatagctcataatttatcctagatttcaaccttttttagtaaaaagtataggaagttacatggaaacaatgaatggaagtgtacttttttttaatcaaacaagaacaggaaactttccgtggtttatggtaaaactacatatttgagccaaagaaaaaaataaactatgctcaacccctttttactctcccctatccaaaacatataagaacatgcacaactgacaaccacaagacaaatctcaacaccagggacaaattaatatttataggcttcaaaaatatacttccccaaattacttaataaaccccttcaaacaggccgacacctacttcttctactattgtatgaccaaaatgagtcataataaaacttaggaatattaaagacaataagtgaggaaattccagaaaatataaaaactatttcagggagccaaaacagaactatatttatttttctatcaaaatgcataggtataaataaacgggcaaataaaacaggcgctcacaaaagtaaacatatacccggctgcagttctacaacatagtcttctaaattaccacctcctccacattagagaaattacttccttcaacaaaattaacctccaacaccctccaaactgtaaaaatctctactatactgtgagcaatttataaaagcaggcatttttgaggccaggcacagtggctcacgcctgtaatcccaacactttgggaggccaaggcaggtggatcacttgaggccaggagttcaagactagcctggccaacatggtggaaccccaactctactaaaaatacaaaaattagccgagcatggttgtgggggcctgtaatcccggctacttgggaggctgaggtaggagaatcacttggacccgggaggcggaggttgcagtgagctgggatcgcaccactgcactccagcctgggtgacagagcaagactccatctaaaaataaaataaaataaaataaaataaaataaaataaaatagggatagtcctgtcctagctaatcctcagggtcatcatgaaaacaaatgagatcatggcatttgagaagtgtttaattaaatcaggaagttctataaaaatataaagataacatcaataagtatatgaaagatcaacagaaaagaacctcctttctcctcactacccactttacgttacaaaaaagaagcccacaggatacaatgggaaccttgggagcacagaggaaagaacactacatttggacctagaaggcctgggttccaggctcatctctgccattaacaagttccttgacttagggcccctctcttggttgcctcacctggagttaatactacataccttgccaaaatgaattaaagtaaaggatagcaaagaattctataaactctaagtgagatccctatagaagagacaaatgaaatcaatctgctgaacaaaaagtttgaactttaatggtttgtgttataaaatcaactgacaaggaaagaagttggctgtaatcagactcttcccaaacaccccaaggaagaaagccaaccaagacagaggagtggagaagcctccacagtgtgaacctggaagggctcagcttgtatattcattacctaatgaaacgggggctttagaagtgggaattctgaacctgtcactgtggatgagaacctctctgaatccacttaaacccatgaattgaaagactgggttggattttttccattcctggttaagatagagccacacaaatcctaattctaaatgtggatgttcaacattccagaataaacagcagctcatggagaaagcaacagaaggatggcaagaggaaaaaatagatcaacaaactacaacagattggtcacttagtaattaaaaaagaaaaaaacgaaaagaaaacaacccatctcaaagttcaactcaaggctgaattcctatcagaaactaccagaggccaaagactacatctgcataatattttaaatctgagcctggtctttgagaaaacatttgacaaagattaccaaaacatctatttttctttctttctcctcatttttctcaattattttccctaatccctacacttcactgaccactcctgcgttctcaactgcagtaagcaaatacatactaagttggataacatattattttgtatctatggtacacagctacagtgttggaatggctcctgattcttcctgggttagcaaatgttcacttaaatcaagtgtaccacctatttcagctattgagtctctttcatctttatgggactatattttgaaaatcactagaaactgcgtggttcccatatattgggctcaactgaaactttaaactcatgcaataactgttaatattcaagtataattttacctagcagtaaagttatattttgcacatcaaaagcaaaatgaagcattaagaaatttagttatatacattctttcatatccctttacataagcagaatacaaagtacttactttttttcccccaaatgaatacaggatttcaacaacattaagacatgattattttcacttactcccatataataggtattcttattaaagaaaacatcttaatgtcaccatatatgaattcatctaatctctgagtactcatttatcatctctacaactacacatttgacagaaccaaactgtggccctaagaaacaagaattactggcatagctaagaattcaagaaatcagaatacagtctccaattatgcatttacttcaaataagaacaataacttgaaactctgtgttaggctttgaattcacctccagcctgactttaaaaagctaccatgaggcctaactccagctggcagtagtaaacatccctggctatctaacaatatttttataaacaaagcatcataaagaacataacgttcaaacggcatggaaactgttttccacggtccatatttgacaatctttcaaaaaaatgttaatattacacatattagcactgtgtaatatataagatgtaaccccctcttcacaccaagatcagttgcaaaagaacactatgatcatatttcagaaagtaacatgtaaggaaaaagaaaaaataaagaacactatgaccttggcaaaattctcaagtgttcagacagaaacttctagaagtgcttgtttgtttgttttcaaattctgctttttgaaattactcacttgatttttaggccagaaaggatgcaaacgtctgaatttctgcagtcacctccctcccactgcttttaattgctctataaagcaatccctgtggatacctatcttaaactgccctggccttgccaggacaaatgttggcccatgtattccagtaaagccatgagtattctgaaggtcaaacaaaatacatattatttccaatcagaaaggaagcctgtgctttctggaataaggccccagctcaaccttgacttggtgcgctatgaggcaaataaaccaagaactgggaatggccttcctttttaatcagtactttctgaaggatgctactgataacagaaaaaaaaaaaaaaagtcaatatacttgataattcacatctccctctgtcttggctggagttttttacagatgcatttacagatatttaaaataatgatcataaataaagctttaagtttagagtatataaatttttatttttcccccactcctgaaaaaggcttgatggttacttagctttttcttttccttttttttctattttaccaaacaagtttccacaagtccttcctacgcgtgtcctcacagccaagcaaagagcagtgagatttctcaccattaattcactcttcatttcacatgttcctacagcaccagctgttagtttatattttcagtctttactattaaaaaaaaatttcaactgcaactgcaccatttccccttagccccagcctttttttttttttttttttttttttttttttttttttttttttaggaaagtttaggacagcagaaaaactgctgagctgtgacacaaagaaaagctgactctgcacatgcctcattgttttctattttcattccagcacagttgtggctggaaaccagccttcaggattccccgtggaccttgccagccctggtccctggtgttttaaaatgttacactttatacactactcatagaggtgtgattcaattgagtatgttccctgtggttctgagtgaggctaatatatatcatgtatctttggagaagtaaccaaaatatgtgtttagggaaaaggaaaaaaataggatcaagggagtattcagagatgtaattacacatactcaagtgggaccttttgtgtgtgtgtcttggaggtgggagatttaatgtaaacacagaccacgtttgtgctttctgttatacacatcctgcatcaccacacactgagcacacatgtgttaaaatgctgacacattcattacaagaacatcatttatcctattacaagttttagagttttgcatgtcttttgttgatggtggggttttttccagattttcttagttttcttcctcaaatacacttgataacttatttttaaatgtgagagcattattataacaccaacagcatcctcctgcaatctatggacacagattattttgccagagtaaaacagattccaaaaggctgttcacaccttctttgggggacctaaaacacagggtccaggaagagctcagaaacaatccttaaatcctgatcatcgccaggtgtggtggttcatgcctgtaatcccaacactttgggaggccgaggcaggtggatcatgaggttaagagttcaagaccagcctggccaacatggtgaaaccgtgtctctactaagaatacaaaaattacccaggcatggtggcatgcgcctgtaatcccagctacctaggaggctgaggcaggagaatcacttgaactcgagaggcaggggttgcagtgagctgagatcgcgccactgtattccagcctgggtgacagagcaagactccgtctgggaaaaaaaaaaaatcccgaccatcatcccactccactgaccttgtaagcgaggccactcctcaaagagctagggatcccacaggctaaaaataaccctttgacccacatagaaattacaactcagaggaagctgagacaattcatccactgagagccattctcctgtttggagagggcctacaggcatcagcagcacctaaacatacagcctttcctggtcatgatttatttcttagcatgacagtaaatccatagcttacaatagcaggacgttgctgtcagacaccaaggtctctcagcatagccactatcctgaagtcatgaatcacacctccaagtccagtgacaggttcagaggctttaccaccccctccctcccctaaatccacaggatgcccactctgcttctctgctcatgcgatgatttcattagttcaaagatattctgccttctatcatttttctccttacagttcttaagagaatgaaccagcttcagaaaatggggaaagaaaaaacaaactgatcatcagatgagggttcaaatcttgaactggcttcttagaagctgtgtcactttatgcaagccacagtctttctcagtcttagttccagataaacagtgaatagcagcacattctttatgagattattataagactcaaatgagagaatacacaagaaaatacctagcacatattaaatgcctgctaaccttttacctatgagcaatcataatgctcaattcatacttttcagagggtgtagtcattcaataataaagaccagtagaaatattttaaatcttttgtaatcttctcagccaggtttgggacagcaactgaactgtccaacctctctctaaaggcattacatcataactgtaattacaccaggctgtaactgatatcaatgtaaatacacctactgtactacaccataacaacatcactgttatggtactataaagtattacaggcatagatgttaactgccacagtatttataataaacaaatactttaaaataaccagccgggcacggtggctcacacctgtaatcccagcactttgggaggccgaggcgggcggatcatgaggtcaggagatcgagaccatcctggctaacacgttgaaaccccgtctgtactaaaaaaatacaaaaaaattagctgggcggggtggcgggcacctgtagtcccagctactcgggaggctgaggcaggagaatggcgtgaacccaggaggcggagcttgcagtgagcagagattgcaccactgcactccagcctgggtgacacagcgagactccgtctaaaataataataacctaaatgttcatcaaaaagggtgtatctatatcatgaaatacatatgctgcatttaaaacactgttatttgtacagacagaaatatcttatgacatgttctttttgtatgtaaagaatgatacaatttattaaccttctaaaactatgtgtatttgtccatatgcatgcacatacatgcatagaaaaaggattaaatggataactctaactataaatggttcttacctaaggtaggggtgatgctagagacgggttggagacacgagaggaactctgactttgctctccatccttctatgaggttgacacaaaagtaattgcagttttttccattaaaagtaatagtaatggccgggcacagtggctcatgactgtaatcccagcacttgggagactgaggcaggcagatcacccaaggtcaggggttcgagagcaacctggccaacatggtgaaaccctgcctctactaaaaatacaaacattagccaggtatggtggcacacgcctataatcccagctacttgggaggctgaggcatgagaatcacttgaacctgggagacagaagttggagtgagccgagatcatgccactgcactccagactgggtgacagagataagactgtctcaaaaaaaaaaaaaaaaaaaaaaaagtaatggcaaaaaacacaattacttttgcaccaacctaatacattcttaatgcttttactgtgcaaatgtgtttttgaatattacttagataattaaaaatttaaaaatatgctctactttatcataaaaataattctgaccaaagccaatgctagttgattggtttctgctctacatatcttattttaaaaatcatatgtggtttaaaggaacaatctcagtgtctctctaggaagcagagaatcctggtttcctccacttcagtgacaacgccctctcatagacctgagagctgtggcccaacttcctcctcctctgtggtcagcaactctacggacctggggccttgcctgggtaggatgctgtagagaaaagacctggctttgaatcctggttctgtctataccatctgaaactttgccttagttttctcatttgtaaaatgaagacatctacactttgtgaggattacataatgcatgcaaatatacgatacatattaaatggtcaataaatggcagcttttatctttactattattaaccaggttagtctctagatttcagtatcaattctcctctgtaaagggagggcctatcatttgattattttgaaagttcccagctctaatagtctatgaacatgtgctatagaagacaatggacaaatatgtgctaaatagtgaagccaggtggctgagaccaaagagaccagacaaatggctaagcagagctttggcaatagtgtgacttatgtgacctattaccatatggggtaagaggcaaagaggataagagaagtcttttcaatcccacctagaagcctttagaatctggagagatgatagacaaaccgccacatttatattcttctactgccaaacagaaaacatttccagtatctcctagtgcccgctgtaggctgagaagagcaaagcattaaaaaaaaaaaaaaaaaaaaaaaaaaaaaagatgaatcttagtgtgaccttcccaaacataaacttcattttccagcctcaccaatcttttagaacagaagatcaagtcaaatccctttagaatcaacgggtaataatatctcagcacatctaatctattttgggggctcagttgaaaccccatctcctttattagccttcccaaatcctcctcactaaaagctatcactctctttcacttctcacagactttgttcttcaactctattaatttctgcttcacattagttatttgcatgcctattttatctcccttacagggccataaacccccttacaaagctgaataagggccgggtatggtggtacacgcctgtaatcctagcactttgagagaccaaagcaagggaatcacttgagtctaggagttcgagaccagcctgggaacatggcaaaaccccatctctacacaaaaatacaaaaattggccagcgtggtggcacgtgcttgtagtcctagctacttgggaggctgaggtgggaggactgcttgagcccaggagccagaggttgcagcgagccaagatcacaccactgcactccagcctgggtgacagaactagatagaccctgtctcaaaaataaaataaaaataaagatgaataatgtcctatttagtcgcccattcacaagccttattgagcacctatctagatggtaaatactatataaggtcctggggatacagaaataataacgcattttccttcttcaaggagctcacagtctaatgggaaagataggccagtgaacactcaatcatcaaggtgttaagggagcctggagggggagcctccctaattcacctcaaagaaggggaagatgagaagggtcaaaaaaaggcttcctagggcaggtgatatctgaggtgattcttaagaattaatataatctacccaagcaacatggataggaaatgatgaatctgtattaaaaccaacataggtacacatactttgaagaactgcgtggcaagttcttataaagttacatacaactcagcaattacagtcctaggtatttactcaagaaaactgaggacatatgtccagaaaaagacatgtttatagaggttcatagctacttaactgcataatactaaaaggaaacaacctaaacatccatcagcaggtgaatgaataaacaaattggggtatatccataccgcggaaaacattcaacatcaaaaaggaacaaattactaatacatgcaacaacttggctgttgattctcaaaaacattttgctgagcaaatagaagtcagacacaaaagagcacatgaacttctagaacaggcaaaactaatctatagcaacagaaagcagattagtaattgcctgggactggggatatggactacagggaggctgaagagaatgaaaggggtggagatggataatagaaaaattctctgtatcttgattgcagtggtgattgcacaggcatatgtattcattaatactcatcaaaatgtacctttaaatgtgtgcaatttgctgggtgcagtggctcacgcctgtaatcccaaaactttgggaggccaaggtgggagggttgcttaaacccaggagtttgggaccagcctaggcaacatagcaagaccccgtctctacaaaaaatacaagaaatagccaagtttagtggtgcacacctgtagtaccagtgactcagaaggctgaggtaggaggatcacctgagcctgggaggttgagggtgcagtgagccgagactgtaccactgcactccagcctgtgtaacagagcaacaccctgtctcaaaaataaatatataaataaataaagtgtacattttaatctatataaattatacttcgatataaagttgattttaaaagaaaaaaagagtatgtagtacagaacacagactctggagccagactgccagctctataatttattggctgtttaagagttaactagtaatggcattaatattcacactgcattaatatttagattataggcaaagatctggaagtaagaaatgacatgatagtatgaggactacaaacagtttggtatttagggaacataaatcaagaggaaagatgtgaaaacagatgaggccagagagacagacagccgaaggctgcaaatctctttgcccccacacctaagaaagagcatctgacatgccatgggtgcccattcaaatgtttattttcattgatgaacatccattgagataccattacacacccactaggatgactaattcaaaatgacagataataataaggtttgcaagcatgtggagaaactagaaccctcatatattgttgctgggagtataaaataatacaacaggccaggcgcagtagctcacacctgtaatcccagcactttgagaggccgaggcaggtggatcacgaggtcacgagttcgagaccagcctggccaagatgatgaaaccccatctctactaaaaatacaaatattagccgagcatggtggcaggcacctgtaatcccagctacttgggaggctgaggtaggagaatcgcttgaacatgggaggcggaggctgcagtgagccaagatcgcactactgcactcctgcctgggtgacagagcaagactccgtctcaaaaaataataacaataataatgcaaccactttgaaaaagagtttggcagttcttcaaagggttaaacacagagtaaccatatgacccagcgattctactctcagacacatataaatacaagagaaataaaaacataaggatgtgcttgactctggccttggccaaagccatacttcccagaaaaaagggaaaaaacataagcccacacaaaaacttgcatgtatatgaatgcccataacaacattattcctcatatccccagacaggaaacaatgcaaacgttcattaactgatgatgaattttttaatgtggtatatacataaaacaaaatattacttggccataaaaaggaatgaaataccaaatacatgctgcaacatggatgaaccttgaaaacatgctaagtgaaagaaattggtcacaaaaggccacatatggcatgactccatttctacagaatgtccagaataggcaaatccatagaaacagaaaatagattagtagttactagggcctggggaaagggaagaatagggagagattgccaatggataaagaggttttttggaggatgattaaaatgttctaaaattgactgtggtggcagctgcacaactctgataacatattaaaaatgattgtacactttaaagaggtgaattgtatggtatgtgtattatatctcaataaacttgttataaaatgtgcaatgaatatactatcaatagtccacttgtggttaggttcagtggctcacgcctgtaatcctagcactttgggaggccaaggcgggtggatcacctgaggtcaggagtttgaaaccagcctggccaacatggtgaaaccccatctctactagaaatacaaaaattagccaggcgtggtggtgggtgcctgcagtcccagctcttcgggaggctgaggcagaacaatcccttgaacccaggaggcagaggttgcagtgagcccagatagtgccattgcactctagcctgggtgagagtgagaccccatctcaaaaaaaaaaaaatccacttgattcaagcaatgtttgataaaagttaaacacaaaggaatacgaagtatcctttttcgttcaatttgctgaaacccatattaagtccctgctatgtgccagctacagtggccacaaatagtaagacagagtgccttggccttaagcagctatactcccagagtcgagagagagtgacaggtggagtcaggatagagagacaggtacacagtgaggtagcacattagagggtcccctagaaggctgccgagggaacggaggaaacacaaacaagggccatgatcgcctcttcattaccttgtccagtaccttatccctaagttatggtcctgttagatgtgcatttcttctattttaagtcccgctcacatttatatttagtaggaggccgctgtggtgagtggtgtgactgattctccagctgactgtcctaagccaatcactgtaactccattactctaccagggactgattcaaggatgggaggaaaagctgagtcaattcagccaatgattgcaaagagagacatactgggtgtctggggaaagaacctctctcgctcttagctgaagccagcattgcccttcctgtttgaaggagcaaaccgatggctcctgacagccattcctaagcaccagcacatccttcttcagctgaagatgaccctatgccagtaaagcaaacagacaaaacaacctaagtattaaataaaattagtcatattcccattttctcccatccactattaaaaaaaaaaaaaaggcctggccatgccacctgatgcctgtctcccctccctggtctggaggcacctacagagcagggggccaggagttccacgggtctcatttcctcccgtcagagcctagcacttagtcaaccactgcaagtcacatattttgcaagaacggaaaagcgatgaacagagagttatcaatctgttgttatactcaaccccaaacatttttaaaagcagattttaacggagaaaaaaaattacctacaggcctttcctattaaaacagatgaacatagttgcctttattgattcaagcaaagaccacattttactgaggaaaactttctgtcccttgccctctacctattcctgtggtgccaacatagaaaatgtcctggacttctagggaaggtaagctcccggggtggggacgccgtaggtgtgatgtaaagtgccaggcatgaggctggcatttgatgttaagcgctgtagcaacgatcacaacaacagaaccagcggggcgtgtacaggctggcggttacgacatggaatggtactggtttctattctcagcatgtgtcactgacttactgacaagacagttaaacataaaaggggtccattatcagtggtaactgggatcaagtccttgggatagcaggaataagaaaaatccagcagtaatccccaaacctcctgtttctcaagagtttcaatttcctgctccaaaccttttcaaaaactgctattaccaaagtaaactgatttaagttgactgttacttcctttccgtgatgtgacagccccaaaggatgagcagggagagacaggcccccattatcctccacttcttaaggcttctttgtatgcacgccgcatgagataattcattaacgaagaaaaagttactggttatgataacacagtccctggcacacagtaagcacttggtaaatgtttactgaatgactacaggaaatatctgagtgctggacagaggaacaaagcctcaactctcccaggtttacttttttagccaacctgttaacaacaataatagtgcatgtcatcaaagagctggaaaggagctggcttcagtaaggctgcagtcactcactactcagtgaatgaatcgatccattcagtttctctgacccccatccagaatacaaggtagttatggccagcacaggcataactcccaacggacttgttattaaccacactgggtaactatgaatggatgcagagacaccagttcagttcagctgcagactgtccggaacattatcttggttaatcatctactccagggtaccggctcttcagatcacgctgaggtctgcttctcaaagcctgacaggatcagaactgtacaacctctcacagtcttctttatcccttccccaagataactcgtcatgatcgctatagaataaacctgaaagggtttacttactaccctaattacaattactcagggtgaagcactggattctcctgcaccatgaagaactttcaaatgtaaccatgcacacctcctcttcccctaactccacacccccgtcaatattttggcttcattaactagtcaaaggaaaaagagtttgccaaatggcaaactcatatttcacacaggtatctcagccaagacaggaaggaaacatcaaatccatagcccagtgtataaatgttcagcactgaaatgaatgaaaacgaacaggacacttgtggttacgctttgacttaaatccttagttaaagggaaactaaagctgatccagttcagtttatcaacaggagagttcataaggaattatcatgagcaaacaggggcagccacccccgaaactgtagttgccttaagcagaaacggaggtgcaagtgaacttagctgtgaaagggtccctctggatggtcacctccacagaagcagcagctgctcaagccccaaggcacactactaaagttaaggagtgaaaggctgctggggtagaggaagaccgaaattcttccaggaaggaattctagtttaagcctgtattactgtcactgcagttccaggaccctcccactgcaggtccctctctcccaattccctggcatctagtcagaccaggaagagcaggtgagggacctcaaggactcctcaatgcagtgagtgggtgtttgaagctttaaggctaaagctgacttatacgtacgtgaaggagtccctctttttctgaccatcttcctgggcatgtgtcctgctggcaaatcaccaatgccagcactctctacctcccaaccccgccccctccaccatgacacctgggccatgacccaagcagacatgcagtaacaaggcacagtgtggctgggcacgatggctcacacctgtaatcccagcactgtgggagggtgaggtgggcagatcacttgaggtcaggagttcaagaccagcctggagagcatggtgaaaccccgtctcttctaaaaatacaaatattagccaggtgtggtggcacgcacctgtaatcccagctactcataaggctgaggcacaagaatcacttgaacccaggaggcagaggttgcagtgagctgagattgccccactgcactctagcctgagcaacagagcgagactcgaaggtcttcaaaaaaacaaacaaacaaaaaaaaaaaaacaaggcatggtgtggggaagagagccacaggatggcatcagaagacccatgcactggctgtggttctgacaaagtgacaccaaagggcacatatgctagaagggtccagccatagaatcatagaacctgtgaataccagaagcacccagaacatagcagtcccctcaaaggaagctctgagattcaaagtgtgctccaagatgatgtccatggctcaccaattcccatggagagttaaaactaccaaggatgctttggacacaagaaaacaatcactatgaaagcaaggactctaaggggacaacaaactccaaactcagttgttccagacaaggggtttttttttgttttgttttgttttgtttagagacaggatcttgctatattgcccaggctggaatacagtgtctattcataggcacaatcccactactgatcaggatgggagtttcgacctgctccatttctgacctggccagttcatctctccttaggcaatctggcagtcccctgggagtccccagggaagtcaccacactgacgctgaacttagtgcagacacctgattggcatagtgcactacaacagcccagaactcccgggctcaagtgattctcctgcctcttgagtacagacccaaatgatcgttacagtttacataaaggcagggcctgaaataaaattttcaaaaagctagatctttggtactcaacactctttccatctaaaaccagaactagaggccagacctgagcaatacaaggctgtgttccaaaaactgccaatactagtaccatgttctttgcctctgtctttctctggcataaccaagatcagctcagcctggcagggttatgcttggtgaagagggatacaggcaatcgggacttggtgctcgtccccaagggcagaatacttcctggctacttgtgtttggtatgtctttgttttggtttagccctggcaatctggcaggcagtcgatttccagggggagctctgtccacggtatggatgccccaggcttgaggtcctcattcattttcataaacaaagcccagttgccacagtgactggtgctgcaagcagctgctaaataacagaggtcacccagagctttctctgggttctacagtctgttcctaggcttctgtgaacagtgagtgggtcaacgggagctgcagtcataccagccagtactttatatgggagtctgccccctgaggagaaactcccaagaaagctgccagatacacaagtgatttcaggtggggtccaataccccacccctgacagatctcggtctggggcacaggaagaatgaagggcataaggagtagcaacttcctccttgtggcttcaacagtccccagagcagtgagagggcacagggtcagagcttggtgcaaaaggaatgatcctggaaaagtgagtgtggagttgggccagtgctgcttctgcaccctgtgtgccgatcagacgctttctccctgtcccacttaggtgggaaacggctctcaccacccccatagcaggaagcacaacacgcctcccacccagtacacacaggtaaaaacttctggactggagtcccaaaggtctcttcaagttagaaatcatcaccattgtgtttccacctccccaaggcaagcctgtccaaaggccacaagatctgctagacctcacaagctggggcacaacctgcaccatgcccacctgcctgggttgttcatttgttaaaaccagtaatagtttgtcttttactctgcaaagtacagcttctgtcctcaaggtagatcatttcagacaaaaacaatttaaaaaaaaaaactgcactataaggcaggtcctcttcgctcttgcaaaaccaagtcaccttggctagagcccaaggaagctgtaaaatagaagtgagcataaacgtcacttagtctttagactcattcccatgttaacatggaataataaacattcttcgaccccagtgccagttccagaaataagtgatcatttaaaacttaagcaaaattaaggtttaccattcccagaaacatatgcttctgtctttatcaaccatgaaccaactaaaccactacaaggaaaggaaaatggaaatgaaaggtccctaattcgcagtgtaactcaaaggtaaacctgcagatttgggtcaaacacgcaaccaggacccaaatgttttatacacaggattttttgtgttatttccaccactgtagtttattacaggccagaagaaacctaaacagttaagaagtttgtccttaggcaaatagttcaataatttagacttcaaagactccatattaacctctgtttacacaaagtaatgtgtttcctttgcctgctgaacatcaaaacacgtaacaattaattacctctatttttgaaaacgacgtaagtcctgtgaaatataatagccaacacattttaagcagagggaaaaaagcatgttcaaaatctgctgcattctctgtagagacaaagtaataacaaaacatccatggaatttaattaacatagaaaattatttaaaaacaaaaacttttctccttaaaattgtcatttttctttctgtattatctatttttttccatgttgccttatgaacacagtgaatctaataatagagcagactggcttttatatccctttacttaaaaattcaacaaagttaaaattccacgtaaaggtaaagcttagataattcaaagttatgtcatgttctaactagtcagctctcctgagagcattcctagtccatcattaaccaataattaatggctaatttcctagaaattaactctatatcctgtatagggaagtgtaaatggaaaaacagctagtggccctaaatgagagagagctttgcaaatactaaggtcatctttgatatacagagacaatcgatattcctttgaatttgtacaggaattttaaatttgcattttttccccattatatgaccctcaaaataaccacatttggctaataataacattattatctatggagtgtttactattgtgcaagggtctcttctaagcatttgacatgtattaacatgtttattcctcacaacaaccttgagatacactattattggccgcactttacagatgaaagaactaaggtagagtgatattaagtaactcactcaaagtcataaaattattgaatcaagtgattaagccaaaccagacagcagggggaaggtagaacctagactagaaggcagtccagcctcctgggttccaaaatcgaagggagtttcttctcagagaaaactctgaatcggggtcacgcatggtggctcacacctgtaatcccagcactttgggaggccgaggcaggcggatcacatgaggccaggagttcaagaccagcctggccaacatggcgaaaccctgtctctattaaaaatacaaaaattatataaaaatataaaaatggtacatgcctgtaattccagctactcaggagactgatgcaggagaatcacttgaacccgggaggtggaggttgcagtgagcccagatcacaccactacactccaccctgggccacagagcaagaatctgtctcaaaaaaaaaaaaaagccaggtgcagtggcctataatcccagcactttgggaggccaaggcaggtggatcacagggtcaggagtttgagactgacctggccaacatagcgaaaccccgtctctactaaaaatacaaaaaattaaccagtcttggtggcgggagcctgtaatcccagctacttggaaggctgaggcagaagaatcgcttgaacccaggaggcggaggttgcagtgagccgagatcactccattgcactccagcccaggcgacagtaggagactccgactcaaaaaaaaaaaaaaaaaaaaacaggcctggtaacccacgcctgtaataccagctactagggagactgaggcagaagaatcacttgaacccaggaggcggaggttgcagagagccaagatcacaccactgcactccaccctgggcgacagagcaaagctctgtctcaaaaaaaaaaaaaaaaaaaaaaaaaggccaggcacggtggcttacgcctataatcccagcactttgggaggctgagacaggtggatcatttgagatcaggggttcaagaccagcctggccaatatggtgaaaccccacatctactaaaaataaaaattaaaaaaaaaattggctgggtgcggtggcacacacctgtaattccagctacttgggaggccttgaggcaggagaattgcttgagcccaggaggcggaggtttcagtgagccaagatggtgctactgcagtccagcctgggtgacagagtgagacttcatctcaaaaaaaaaaaaaggaagaaaaccctgaatcaagatatcccaaggaatatcccagtgagatctgacctaaatatatgtcctaattctatggaaaactcaagtactaacatattaaagaaagaaagaaacaaagaaaaaaggaggtccagatttccttaatcatctgctcagaattctcaatatcattttaactctacacatattttctacattgtccaatattctttgcaaattacctaagaaaatgtttaaagcctccagaaaaaggaactatttggacattatatactggaattttcactacatttttttcctacattgtaatgttttcatggttttttaacaattcatgtttctggcaaacttgttcttttaacactcaaagctaaactcatgtaacacatcatgctggctgcagtttgaagctactatccagctgggctgattttaaaatccaattctgatagcatggtgtctcccgccttcaataagagttgaaacctctcctttctagaaaatcttcacatatcaaaaagacaaaagatacttttctctttatgtatttgaaaattgcaaatagtaacagacgctgctgagatctcatttcctatcctctgacaggttcccctttggttcaggcctgaagaatgggcatgacatatgagtgtttattttcctgcactaaagtgaaaatctatctgcctttgagagttcagagttgatctttaattccatcatttgaataccgaacacctactacctaaagtgccaagttcttgtggctactcgagaaacagcagcgaacaagataagcagtttctcctctgctttcatggagcttccattctatgcaggaggagaaatagacaatgaacaaatacgtgagatggagtttgttttggtttggtttggtttttaagacagagtcttgctctgttgcccaggctgcagtgcaatggcgcaatcttggctcactgcagcctccgcctcctgggttcaagccattctcctgcctcagcctccctagtagttgagattacaggcgcctgccaccacacccagctaattttttgcatttttagtagagtcagggttttgccatgttggccaggctggtctcaaactcctgacctccggtgatccacctgcctcagcctcccaaagtgctgggattacaggtgtgagtcactgtgcctggcggtgagataatttttaaggcacaaagaagctcctcctccaggaaaggacaagtatagcaatggatgggggtgctttatgcaagtggggggcccagagacccagccactgcctatcccctgtctggctcacagccccatcataggctcaatgaggcaaaagtgttcccaactagatcaggatagctctaaccacaaatctgagccttgcttcttttaccaacagggagcaaagtcctctgagctccctcaactttgacacacaccatccggccacttttatacaacacttaaattgtccagaattcatttgcttcactgtcaccattcagatgggttatttgttagacaaaaattctatgtagctctacaaggaagaagtaagggctgggagaggaggttacagccagatgaactgtagcacaacacaaggaagaatttcccaagagtcagggatgttttaaattcaagtaaaggttgggggcttagtcaacaggatattagaaaggtagtttacatatcaggctgagtttgaccagataatctccaaggattcttaaaatgccaacacaggccaggcgtggtgctcacacctctaatcccagcactttgggaggctgaggtgggcagatcatgaggtcaggagatcgagaccatcctggctaacacggtgaaaccccgtctctactaaaaatacaaaaaattagccgggcgtggtggcggatgcctgtagtcccagctactggggaggctgaggcaggacaatgacgtgaacccggaaggcggagcttgcagtgagccgagattgtgccactgtactccagtctgggtgacagagcgagactccacctcaaaaaaaaaaaaaaaaaaaaaaaaaaagccaacataccactagaactctaccatgccctatgaataccaaatcttcccagatgtaacttaccctaaaacattacttgaggatatatgttgttaatgagataaaaattcagatgtcggccgtggttcatgcccgtaatcccagcactctgggaggccaaggtgggcggatcacctgaggtcgggagttcgagaccagcctgactaacttggagaaaccctatctctactaaaaatacaaaattagccaggcgtggtggtgcatgcctgtaatcccagctactcaggaggctgaggctggagaatcgtttgaacctgggaggcagaggttgcggtgagccgagattgcaccattgcactccagcctgggcaacaagagcaaaactccatctcaaggaaaataaacaaataaataaattttaaaaaaaattcagatgtcatgaagaaataacctaaaacttaacaattgctaactaaacaataatggaacaacagagcacttgaaacacagtatctcgttagatcttcaaaacaacccagggagatggatattatctccattttacagaggagtacactgtaaaatgtagcaaaccgaggttacacagctactcagtggcagccgtgggatatgcacccaggcagctggctcttaacgtctatgctctaaaacgctgcgctccattaagttctcctgctggcagtgaggagcattttcctcttagattgggttctatgaatatcctaaaatagtacttaaacctttgaaatttgatgaaacttttttatatataattatatatttctattgtatttataatatatgctgagttaactttactatagtttaccaaattgtagaagttagttcagcttccaaatcttatttccaagcagtagcttcaaaacactggaagaatctggctcaaaatcagttacaacattttgccatgacagtataacacatacacgctgcattagatatttatatttctgctaaatatcagagatgctcaagttggtgattatgacagagctggccctccactgtggcagtttccattactaaattcactttacaagaatgcaggatcctgtttaacatttgatttaaactgatacttaacacgacaagatactactggcttcccctcccttttgtttccccattttaaaaaactaagccatcaaattgcctttcatttaaactaaaaaagaaaaatgttagttccaaagttggggattcttaatagattctagctggtacatttttaagtctgtatttgtaaatacagacctaataattttttttaaaaccaaagaaccaaaataacaaattaacttcatgaagactataagtaaggatattatttatttatttatttatttatttatttaattttccaagatagagtcttgctctgtctgtcgcccaggctggagtgcagtggcatgatctcggctcactgcagcctccacctcgtgggtttaagcaattctcctgcctcagcctcccaagtagctgggattacaggcatgcaccatcacgcctggctaatttttgtattttcagtagagacggggtttcaccatgttggccaggctggtctcaaactcctgacctcatgatccacttcagcctctcaaagtgctgggattacatgtgtgagccaccatgcccggctggtaagtaaggatataatggatatgcaacccgagtctacttcaacagagacatcagtggtatatttagaacccattaacaaatttaaatgatttatgtaaatacttacaaatattcacataagtttacacatatacattagagcagaaaaattctcagaaatcatgcatttttaaatttgtgatatacataaattgacaaaaattttcagcaataattaaaaatctttcccttgctcattacagtaaaatctaataatcatgaaaacttctattcttttaaaggagcagtgaaagaaataattttacaggcccaaaaagaaaagtccctggagtccctgcttcacaaatactactgcattatatccttacatataaccttcatctttaacctagcaaatagcatactcgggagattgctgcataatgcccatgctgacaatgatagtgatttgaaatcatgtagtttggggtttaaagaaacttggagatagtacaaggcaatccccctcatctgccagctgagtacactgataattgagtgacttccctgcaaggaccaagagtccttggtggagtccttcattaaatctttatttggtccagaagaaaagattcccctactaagatatctcttctgtattattcagaaaaaaagcaattctgaaactttttgttgttaggatccctttattgctttaaaattactgaggactccaaagagattttgttaatataagtctattaacattttctgcaatagaaattaaaactgaggaaatttttaaatatttattaattcactaaaaaccaactataataaactgtaacataaacagtatctttcatgaaaaacaactactttctaaaacaaaatgtaaggtgagatgagcagcactgttttacatttttggaaatctcttttttttttttttttttgagacggagtctcgccctgtcgcccaggctggagtgcagtggggcaaactcggcgcactgcaagctctgcctcccgggttcacaccattctcctgcctcagcctcccaagtagctgggactacaggcacccgtcatcacacccgactaattttttttttttttttgtattttttagtagagacagggtttcaccgcgttagccaggatggtcttgatctcctgacctcatgatccacccgcctctgcctcccaaagtgctgggattacaggcgtgagccaccgcgcccggccgcaaatctcttttcttgttaaatttcaaagacacatgcacagcaaatctctttaaatgtctggcttaatacaagaccactgggttttcccatctacttttgcattcaattttttgcaatacattgttctggttgaaggatatgaagaaatctggcctcacacagatacagtatatgcagttggaagtttcaaatcttaagtttttttatgtttgtttgtttgtttttgagacagggtctcactctgtcacccaggctagagtgcagtggcatgaacatggctcactgcagtcctgaccttccgggctcaagagatcctctcacctcagcctcctgagcagctgggaccacaggcacacaccaccattcctggctaatgttttagtttttcgtagagacacggtctcgctgtgttgaccagcctggtctcaaactcctgggctcaaacaatcttcccacctcaccccgtgaaagtactggaatttacaagtgtgagccaccacacccagccaaatcttaagtctttttatatacttgtggttatttcttctttactattacacctaaactcaacaaataatcatttcttaagtttagttgcaaggtagcatctgaattacataataaatttttcatactccgtaacattaaaatcctttgctttccccaaaatactgcgtaatttcaaagtgaaaaatagtacctttacaccagagaattctggcagacatcactctagccaagtgaccaagattaacgtcactagtaataattcctatcaacataacatatcctcgatttgatgccctgaaaagaggacatcacctctatggtattcttccaaatgacacataacctcaatgtaatcctgagagaatgtcaggaaaaaaattaattgagggacattctccagtagttcccaaagcgtcaaggtcattgaaagaccagggaactgtcagcctggaggaggctaaggagacaaggcgactaaatgcaatgtgagatcctgggttggattctggaccagaaaaagaacattagtagaaaaactggtgaaatcctaataaatattatactttagttaataatattgtaacaagattaatttcttagttttgatcattgtactttggttatgtaagatgtcctcataaggtaaagctgagtgataagcctaaagaaacgctgtactacttatgcaacccttctgtcagtcaaaaattatctcaaaataaaaagtttttaaaaatcacttgctctggccaggcacggtggctcacgcctgtaatcccagcactttgggaggctcaggcaggtggatcacctgaggtcaagagttccagaccagcctggccaacatgatgaaatcccatctctactttaaaaaaaaaaaaaaatacaaaaattaactgggtatggtggcgtgcacctgaagtcccagcttcctgggagcctgaggcaggagaatcacttgagcctgggaggcagagtttgcagtgagccgagaccatgccactgcattccagcctgggcaacagagcaagactctgtcaaaaaaaaaaaaaaaatcaattgttctatcttgtactctcaagatgtggaatattttaccaatgcatgattttgtaatatcatgcatgattttgtaatatcatgcatgattttgtaatatcatgcatgattttgtaatatcatgcatgattttgtaatatcatgcatgattttgtaatatcatgcatgattttgtaatatcatgcatgattttgtaatatcatgcatgattttgtaatatcatgcattggtcatctgaaaaataatggtttactgccaaataagacatatttcattatataatattttaaaaatcacatttgttaatatctcaactgatttcatcagaaaagtatttaaccattgagaaactgtcataatcatggtaatggatgtaagttttccaaaattttaacttgtgtgaaaaacgaaattttattattggcaacaaatactgttgttttccttgaactaacaggttcactttgttcattttcttttttttttttgaaatggagtttcactcttgttgcccaggctggagtgcaatggcaccatctcagttcactgcaacctccacctccagggttcaagcaattctcctgcctcagcctcctgagtagctgagactacaggtgcatgccaccacacccagctaatttttgtatttttagtagagactgggtttcaccatgttggccaggctggtcttgaactccggacctcaggtgatcggcccaccttggcctcccaaagtgctgggattacaggtgtgagcccccgcgcccggctcactttgttcattttcaaaaatgtctgccaaatactgaagtctggataaccatcagttgtctgtcagtcactctttcacatcaaatggtgttccatgaaaaacagaccagatcagctcacaactcaaacaactgcacagtgcttttcctcaagaaaatcattgtactttggaatgcagaaatgcaacatacgtacctcccattttaccatatagaataaggaaaaaacatgtatctgagggtaacaacactcttaaaggaaagtggcagatgttttactgcaagtgtgtgccagtgaagtactgccttcattcctgctgagtcaccagcagttttatccaatattgctcttatacaattagagcagtgttaacccaatcttggaattattataaaaatagttggccaggcgcagtggcttacacctgtaatcccagcactttgggaggccaaggcgggcagatcacgaggtcaggagttcaagaccagcctgaccaacatggtgaaaccccatctctgctaaaaatacaaaaaattagccaggagtggtggtgtgggcctgtaatcccagctactcaggaggttgaggcaggagaatcacttgaacctgggaggcgaaggttgctgtgagctgagatcacgccactgcactccagcctgggcaacagagcaagactccatctcaaaaaaaaaaaaaaaaaaaagtagttttaggccaggtggagtggctcacacctgtaatcacaacactttgggaggcaggtggattgcttgagttcaggagttcgagaccagcctgggcaacagagcaaaaccccgtctctaccaaaaaatacaaaaaattagccaagcatggtggtgtgcacctgtggccccagctacttgagaggctaaggtaagaggatcacttgagactgggagccgaaggttgcagtcagccaagaaatgtgcccctgcactccagcctgggtgacagagcaagactctgccaaaaaaaaaaagaaagaaagaaagaaaagaaaaaagaaaaagctgcaccagagcaaaagcaaaactaacttgactctcacggagcttacattttagtgggggaagataaataataaacataagtaaattacaagcagcttttgaggtgagaagtgctacgaggaaaaacagagcaagataagaaggaataggagtttctgtggttagagagggattacaattttaagtagggtggttagactgggactgagcctagaggtaccatatagatgaggaaaactaccaatacacagcctcaatccacttcacttgggttctcctgtcccccactggtcctgatcctcagcaccgccaccgttcttgagcattcatctttaccctgtaacttccagttaaagaccaagtcactgcctcaaaagaaaacaaggtcttttccatccaggtgctcagttcaaatccacctggctcagccaacagctcctcagccatctcccaaggacattccccaacctgctttttctccattgggagcacaaagctaaacagcaaatgcattctgcccataataaggttgttctagctctctctccccctcttttcctacacatatatattgtctaaataaagattaactttttgaagacctaactactatgtgccataaacttctggctgctttacaagtattttatcctcatcaaatcaaaggaataggtataattagcagtattgtatagataaggcaacaaaagctctgcaaaccacaaaactgggactcaaatctccaaaacaaaacaaaacaaaaagttggggggcagggagagcacttcttatccacaccctctcccaactccatcactcccattgtaccactgtggtatttccactgtactgctctaagtaaaacttacggaaaataaagaaactgggcatcaataaagtctgtttaacagcaacattatatttcaggatcagatctaatttttgtaccaaaaatatgcctgaataatagaactgcaacttaaaagactgattaaatatgtccaccatgtgttacggactgaatgtgtacccccctaaaatttgtatgttaaaatcctaaccccagtgtgatggtattgggagatggggcacgctaacaggtggagcaattaggtcatgaggacagcgctctcatgaatggtatgagtgtcttaaaagagactccagagaactctctagtttgtctttttgaggactgtatccatgtgaggatacaatgaaaagtcatcagtctgcaatttggaaaaggccctttccagaacctaaccatgctggcatcttgatcacagacttacagcctccagcactgtgagaaaaatacatttctgttgtttataagacatacaatctatgtgtgacttatatgtgactttgttatagcagtccaaactaggtaagtactatggtaacattttcaaagaatactatttccagtagtttcattcataataaacgtgatcctctggtttatatgcattatctcatttataatcctcacaagaacacaactgagacaggaactactgatacttcaattttacaaatgaggacactgagcctgtggtcacacagcctatgatctggacctgaacctgtgtgcctgaatccaaaacccaaggtcacaactagtgcacgatcctgactctctgacctttcatatgtctctgtcaagaccactcttgacactgtggtggagaattactttccctaaataaaggtgcagcaacccaacaaagttactcttcatcttgataaagccctcaggtattacccacattcagagggtaaaatctctacaaaatccttttgttacaagtccaaaatgaaagttcactggagtgactctgttccagcgaaactctgctgggaaagcccaacggcctgatggaaaggcacaacatccaatctttgggttccaagactgcctctaactctgacatttagtccaaaggaacaaggatattcattttactacatctcttgctcagcaacactagccttcagccttaaagaacatatctcacagtacacactgagctttgagttcctacaacttagagcaaaggcagccaggccgataactcactttagcaatagccttagttacacacccctgagctcactctccaggaaagtcagagggagtatcagttttcatcattattaatgaagagtagattgaagaggatagcattacagctctaaaacagaggttcttaaacataattctaataagacagacatgatgaatcttgttcacatttggacacactagagtcttcaaaagaaactagtgaaaactacaaaagcagtgctgaaagaaattaaggaaaacctaaacaaatgaatgggtgtaccatgttcatgaatagcaaaacagatactacaggcaacaaattatgagcacttttcattctatcacttgtaatcctaacttctctttctccctttgaaatatttttaaatgcaaataaccatacttattttagaataaccttgaatttagttttatctttttgaggaaaatcatttaaagtcttcaatttaactatcagttgtaatgttattcatgatatctcacaacctaactgggatatacaagtaggtcttgttatacagaattacctctccaaaataaaagcataatgagaccttttaaccataataaagcagcaaagaaaaatcatagtcttttgtcagtacaaaggctttcataattcctcatagctctcagatctgtgtttctatcaactcaaaaagttggctgggagtcatatgacagaaagggttaaaaatactaagctgctactctagacctgctggctgaggagcaggcaggttgcccagggtttcaggatagcccgcctcacacagagtaaacgtaggggatgctgtacacccaggaataaattcctcaaccagtgcatactctcctgaggcattcttgtaagctttttccaagttgagtaataaacagaaataatagatttttgggggcctttcctgagttcagggagatctgacaacatcacgaaatgtttcggcacagtcctctgaaatttttcattagaattcttttcttctgaatcatgttaataaagtaagatttggtctgggatttgtacataagtacttactcacatgttgctcaagcccaaaaggacaagaaaaagacgctgaggcctgtcaacaggaggcagggccaggctcaggaactggaagattactggatggatgttttcaaacagagctacacacagctcccttatataacactcaattggcttttagataagtctgaaatatccttctatactttgatcttcagctgtctccgttgccttcagagtcaacagaaactggcacttggctccaaaagcctcaaatctctctcatctataagggacagggacttctattatttgtctacaatttgtcaagctgagttaattataggtgttatcattctatatgtcaaatgtagcaaaataatgcaaacctgtttacctgtttcttcctttcctgcatgtagtataccctgaccttaaattggcatgcacttgatttcaaatgaagatttttttaaacagcatcttccaactgcagtagcagttggaaaattcactttttgctgacctgggccacctaaacagaggacatgaggaacctgacttgttttattttaagaagaaaaaactatttaaagccctgatcctggctcctttgaacatttaacacttaaaacctgaattgttacactacaaactagagttccttttcctctatttaagaagaggcccttgcgaagaatttatttagttaatgaaagttaaacaattgtgtttctctcacaaaacaaaaataaacaaaacctcttgaagatggtctctgggctctctaggtctgcaagtgtccatatgagctccctcacggagagcctagagcagtacactggcagtttagaaaacaatatagccacaagcacttctccaaaaagaaaagcaactcccctcttggcccaattccaaaacgcaattgagccgggtaaggtccaagctaatctctgtaccgtctctctgccaactttctcctgcaggcattaggtttttcagcatgggctttgcaaataatctaacaattaattagtgcttttgaattcaccccataccattaatggaacactgccagacagcctttgatagggtatttctagagctaattaagcttggcaaaacagaggacacaaacttcctggcactcacaagggccaggctgagacctggcaggtgacagacagtaaagttgtccttacagataatcctggggtgatgaaaatggcaggctgcttggatcaggctctcggagtcctctataatatgccagaccctactctcaaattatataactatcaggcttttcgcatttgagctattctttcaccctgaagacattttttttcttctgagtgaagatttgatacttaaaagtttggtattgcttctagtccacaccccatcctgtcacccccgaaaagggttagtttagaaaaaaacaaaaagttgtatactaggtttttttttactatatcttaaaataaatctcatctcaaaatgtccttcttccaatcaaagagtccttgcataatccaagatttctcactcctataacctcagtcacgtgggaaatctatttttttcactatctaatgtcacacagaattccagactgctccacatgcatggacagcaacataaacacatttttgggagggctagaaaaaagctagcaggggggcaaaaagaaaaaatattgttacattcctcaggacttttctggttcaatttcaaaagcagaatgaccaccacctgagtcttgcggcgagctccagagctgtacataggttgtacgctgcctctccaaaaacagtgatgaggccagagaaagcaaatcagaaaaccttataaactactcaatggcagtgtaaacaaataaaagttagtttaaaacacaacttttcaggcacagagcttaaatattctcagtcttatccccacttataataaatgtggtgtcagggtgcttaataaacatcaattacaacttacagaaatttttcccttctaaaaaatgttaattttttaaaagctctagactggagtgtgattataagaataaagtagggccgggcgcggtggctcatgcctgtaatcccagcactttgggaggatgaggcaggcagatcacctgaggttgggagttcgagaccagcctgagcaacatggagaaaccccattcctactaaaaatacaaaattagccaggcgtggtagtgcatgcctgtaatcccagctactcgggaggctgaggcaggagaatcgcttgaacccagtaggcggaggttgcagtgagccgagatcacgccattgcactccagcctgggcaacaagagcaaaactccatctcaaaaaaaaaaaaaaaaaaagaataaagtaggaagtcaatggggaaacctgagctagaaaattagagccctgctagcagaaatgaggtatacccaacttttaacttttagtccctaactccagagccaccctcgctaacccacctaaagtcccccttttatccactcagcccatatcacctctcattaccgaagagtcccttggccacaggttccgggaccaatgaccccgccctcagtgacccaacacgaatctcctaccttggtctactaagtcacaaggcaagaaatgagacaaggcaaaagaggcacataaaaggaagaaatggtgggggcgggaagaattccttctttaacaactgttaggattatgtcaaggtgtagccccagctaataaagatgcacctggtttctgcaggtgcaccacacttacagtcagagagctaaaggcatctgtggaactcactgcctcaaaccaacttcctctccagcacatggatccctctgacccaaacaagtttaccaaaggtgttcaaggtagctgttgtaaaggcatgctaaaatcaagctcccttttatggcactaagaaattgtctaggtgtttgcagtttctgtgttacaatttgtgcattgagaaaacagatgacctatgctgtcaaatgtggtcctcagactaacggtatcagcatcttatgagcctgttaaaaatctacagtctttgacccatcaaggcctactaaaacagaatctgcattttaacaagatccctgggtgattctcatgcatataagaaagcactggcctaatatttgtttataacctcaaactccaaaagcaaaacttcctattccataaacaagatggtatattccacctctggcaaaaccactcacctctggcaaaaccactatgaatatccttattataaaatatatttaaaagtgattattttctttatagaaaaaaatctgttgtatcatgctccttgctcacatttaatatgtagtttaacttataaaaataggttgacctacaactcagaaacatttactatgtaaaactggatgcaactgtatttcttcgaaactgtaatttacaacactgtaagaagcacttctgcaaaaggtggtaagaccctcaaaactcatgatcctgaaaaccaggccccctgagaaatgaaaagaacaagacttggaaatcaggagggtaagtaagcaaggaaaagagggtttaggctattaagacgatgatttttcaaggacattcattcacaacacaaagagattttctttagatggtttggggaggttgttttgtgttttaagactcagctttttcagttctatagatgtaattatctttaatattaggctatggcacagtattccactgatgtgagaaatacatctttatccactttcctcctcaaaaggaataggttggggaaaaattacaaaagcatcattctgaatttcctaagcatatgactcccaagggtccttccttctaataaggagtcctggtcatcattttctcttgccagtatctccaaatccacctttgcccaacagcctattctcagcccagcagccagagtggtcctgttaagacatccttcagatcatatcattcttctgctcaaactctccaatggctcagtgtcattcagagtgagaaccttatgatggcctgcaatgccttgggctatacacacccgcaccgtctcccacccctcagttaactctctgacttcccattccagcaggcacctggcccacctgctattgcctgagcactgcaagcaaacttccaccacagggcctctgcacttgcttttcctgctgcctggaatgctctttccccagatatccacttagctcacctcctccaaacctttgctcaatgttcctagtgaagcccttcctaatcaccttacttcaaattgcaatccccgctaacaatccccaacctctttgctttttattcgacgaacctgctgatatatgcattttgtttgtttctggtctctctccactagagacatgcttcataaggacaaggatttttatctgttttgtttactactatctctccaacacttggaatagtgtctgaaatacaataggtactcagtaaatccttgttaaatcaatcaatcaacactttaggaaagttaactgtattagaaaaaaatgaaaaggccagcgaggtggctcacgcctgtaatcccagcactttgggaggccgaggcgggccgatcacgaggtcaggagattgagaccatcctggctaacacggtgaaaccccgtctctgctaaaaatacaaaaaattagccgggcatggtggcgggtgcctgtagtcccagctactcgggaggctgaggcaggagaatgcatgaacctgggaggcagagcttgcagtgagctgagatcgcgtcactgcactccagcctgggcaacagagcaagactccatctcaaaaaaaaaaaaaaaaaaaaaaaagaaagaaaaagaaaaaaatgaaaaaactcattatttgcactaaccccaaagtctctcccctttctgtgcctcagaagctagcaaagtacctgaatcttaggaggtacttaacgttgaccagactacaagtcttcatctaaaacatagtagttatttaaaagtataaagaaaaggcaaaataagtggttctgtcctctaattaactcaaaaggaaaagataagggcgggcaggagctatagagcattttgcttcaccatgtagtattataactttaactttcagcaatttaacaacataattgtcatgcacaggtgcatcccactggaaaagttcatcacaggaaaatgctgtagcagtccagcggggtcaatgatgaaaacaacacagcagggaggccaggcgtggtggctcacgcctgtaatcctggcactttgggaggctaaggtgggcagatcacttgaggccagaagtttgagaccagcctaggcaacacagtgagatgtcatctctataaaagatcacaaaattagccaggtgtggtgccacgtgcctgtagtcccacctacataggaggctgaggcaggaagatctcttgagcctgggaggttgaggctgcagtgagccaagactgcactactgcactccagcctgggtgacagagcaagaccctgtctcaaaaaaaaaaaaaaaaaaaaaaaaaatgcagagcaggggctgactccagaggctgaacctctgccctcctttgaggcctatgctacctgtgtatcctcatgggtggagtaggagagtaggaaggaagggaggtgttactcagatggccctggtcaatcttctggactaggacgcagttactcaggcatatgaggacaaaaggaagcaaaacaaagaacacagagcaattttatcaagaccttttccttttgccatatatggttcccctcattgccaacaaacagagtaactttaaaataattttttaaatcaacatttccctttgaaggtagtaaaattttccacattacactgtagatttttttaaagatgtttaagagctggcaagggagggcaggggaatagctgggcttcagtccccagagcacctgctgcctactccttggaaggaacgttccaagagctatggcatttttcagccctctagaattccacctgattgacagtgccctctcagaaaacaaaaatatgactagattgaagttcaggataaatgttttttaggccattctggcagagatcgttttaaagaaaatgaaagtcagtggctgccatggatgtggtgcgggatgggccaatcatgcgcctcggtgctgagcagggtcagtcctaaaggaaggcctcttgctggcacgcttcccggaacacttcccagaacactccctgctcctacatcacttccaaaatcagcgtgctcagagctcgaagctctatggggtgataaagatacctccagagttggattaattaccaaagcaaacaagctgagaaagtctaatttcctatatacacaaccgtgtgcaagggtaagcttttagcaattaaagagctgtgtaggcacatacagataaagctgtgtcttgatggaagtgttgatcactgtaaaacacaccatcactgctgtcctaaaataacccaaatcaatcagaaatccagaaagctgggtggcaattatacagcctacgataaggatgcaaagcaaagagaaacctcgattctcttgacttggctaacatcacatctagcaataatcttactcattcttggtaaacatcctcccctccactatatgcacattcagttgcccaactagctattagtaaactctccttgaaaatgataaaaagggccaggtacagtggctcacgcctgtaatcctagcactttgggaggccaaggcaggtggattgcttagctcaagagtttgagaccagcttggaaaacatggcgaaaccttgtctctacaaaaaatacaaaacttagccaggtgtggtggcatgtgcctgtagttccagctactcaagaggctgaggtgggaggatcgtttgagcccaggaggccaaggctgcagtgagctaccgtgccactgcactccagcctgggcaacagagtgagaccctgtctcagggaaaaaaaaaaagtaaaaggccttgcattaggctatccaccccacctccacacacacacaggtccatacagggcaagggaatctttgagaaatgaactcacctttctctcaactactgcctcaactcccgtgtgtgtgtatgtgtgtgtgtgcgcatgcatgtgtgtgttgtgtttgcacacgcatgcacgcacatgctgtttctgtagaaaaatctaatggagaaggtaggtggggaggtgcttcatcacacttggctgtgcacaatatcctcaaagggaatacactctaaaatgcaggctaccctatccactctgggtctttcttttatttttgagacctagtttcgctcttgttgcccaggctggagtgcagtggcgccatctcggctcaccgcaacctccgcctcccaggttcaagtggttctcctgcctcagcctctcgagtagctgggattacaggcagccaccaccatgccactctaggtcttttaatagcagttatttgctctttaaaataaagtttggcactctggtgataactggtatcacatttgacaatatcctttccttgtgtatcaaaaagcagaattaaacacaaaactggttaaaataaccagctaaaggccaggcatgatggctcacacctataatcctagcactttgggaggccgatatgggtggaccacttgagctcaagagttccaaaccagcctgggcaacatggcggaaccccatctctacagaaaaaaaacacaaaaattagccaggcatagcggcgtgcacccgtagtcccagctacttgggggtctgtggggggaaaatggcttgaacctgggaggtcgaggctgcagtgagccatgatcgcgccactgcactccagcccaggcaacagagtgagaccctgtctcaaaaaaacaaataaaataaaaataagataaaataatcagctaaaaacaataataatcacagaccaaatcaactagctgtgttctaagacctgagggttggcaaaaaaaaaaaaaaaaaaaaaaagaagaagaagaaaaaaaggggagggggctttttttcagtttgctttgaacctttgagcctatccatcttctatccttacattccctggtggtagtcccctgccagcaccctccagccttcctgcccttatgagtattacagcctttgatcactcgtttggcagacaggagataactatggcagaaccacctctgaggttcacaggccgttaactcacatccaagatttctctttcaagtacaggataaatgaataaattgaataatgaaaatgtggtatatatacacagtggaatactatacagccttaaaaaagaaggaaatcctgtcatttgcaacaacacagatgaacatggaggacattatgctcagagaaataagccaggcacagagcgacaaatatcatatatgatcaaacttatatgcggaatcttaaaaagccaaactcatggccgggagcggtggctcaggcctgtaatcccagaacttttggaggccaaggcgggcagatcacaaggtcaggagttcgagaccagcgtggccaatatggtgaaaccccatctctactaaaaataacaaaaattggccaggtgtggcggcgcatgcctgtagtcccagtcaggaggccaaggcaggagaatcactcgaacccgggaggcggaggttgcagtgagctgagatcatgctactgcactccagcctgggtgacacagtgagactccatcccaccccctcccagaaaaaaagtcaaactcatagaaacagtaaaatggtggttaccagaggctggggagtgggggtggaaggactgaggagatgttggtcaaatatacaaaatttcaattagacaggaggaataagttcaagagattgactgtacaccatggtgactatagttaataacaaggtattatagtagccactgccaccactgagcctaagatggccatgacccctgtagaggtgacccccactcacctacccctctaggactcatgccttcctcaaaaatgcctgggccatggagctggtgccagtcatgtccttcaccatgggggccaatactcagcccctaccaagtacaacatcatgaccaaccaggtgacgccctgaaactatctagtgcccttccaaggtggtaggaacatgctgacatacagagccacctccaggacccccagtgcccagcttggagctgccaaagaaactgtgaccacctcactcgacagtgaggaggcccccttcctacagccccctataaaaatgtgaaaaaaaataatatattttacacatgaaaattgttaagagagtatattttaagtgttctcaccacaaaaaatgataagtgtgtgaggttatgcatatgttaaaaagcttgatttactcaccacaatgtagacatgtataaaaacatcatgatgtacaccataaatatatacaatttttatttgtcaagaggtgctaagggtgcactataccaaaaaggtcacaggatttgttggtgcagtttgtctgcaaaagcatgtctaagttctggtccaaccaagacttgaattatctttctaaatcacttactttctctaagccctattattctcattctagaaatgaagaaaatagtgcctgcctacccccagaggctgctgtgaggatcaaatgaaatacctgttataaaaacatttttaagattacaaatacaatatggtattattagcctctactcaaggctgccagcttgtaccattccagaccaagtattaaccagctggtatctcagcttgctctcccacagacacaaagagttcagagctttctgagcaggaaaatagctcagactaaaagcatctcgattttcctgtggactctacctggaattccaggtacatccagtagagaggaaaagaaatgtgtttctcaatagaaatctgtgcacagtttgcaggcgagtttccaaaaggatacatctgggtactgaattgagacagtggaatgaagaagttagccattccaccaagagcccactggcatcaatgccagcagccctgctccagagctcacctcagcggcacccctctcacctggcacaaggggccagtgataactccagcccttccaataaaactgatttccctgaattctccatgcatgcctctttttcttattactaaaactcctggaaacatagccctgcctaatgttggcaagcctcagaggcagcagctaatatcttttaaagatgtgtagaacagttgggaggttgttttgtttttgtttttgtttttgccttttcaagtttttatttttatccattttttgtattaaaaagaaaagcacaattatcacaaattacaaaggaggaaagcagaactagaataataaatgaatcacttcagcctggaaagcagatattttcaataatagtaatgttataacacaagtatagacgagtttttaaagcaaaacttagacttaagcccatagtatcaagcacttattttttaaacttcccacttttcttacattaggtagcttacaggatctaagaggccaataaataaccttagataatttctttttttttcttttttgtttttaaccccaataaatctcttgtatttattctctctcttttttttttaacccaagtaaatcacctaagctaatttctaatcaagaggcattatggtccttacacagctcgtgttcaccaagagcacagtccaccctccatcctcaacagtgctatatgataacgaaggaacgagggaggggagggaaagcatgagttttttgttttttgagacggagtttggctctgtcgcccaggctggagtgcagtggcgcgatctcagctcactgcaagctccgcctcccgggttcacaccattcttctgcctcagcctccccagtagctgggactacaggcgtccgccaccgcgcgtggctaattttgtttttgtacttttagtagagacggggtttcaccgtgttagccaggatggtctcaatctcctgacctcgtaatctgcccgcctcggcctcccaaagtgctgggattacaggcgtgagccaccacgcccagccgaaagcatgagttttgtcagaacaacactaacactgggacatggatatcccccgacccacccggccccgactgccttcattcactctctatcacaagcagagaaggaaagaaaggttttcactgaaggcccagacaaacctatggagctggaacaagcaggctcctattattctaacttgggctcaatttacgtgctcccttgtgctctgcccctcctctggccacataaccaaaaggaggcctttgacaaccttcacccctctgctgccagacctccacaccttcccaccgatttacagctttaaggccactttggttaagtcagaatatgaataaagaaggcccactacttgagggtccttctgctctgatgacctgtgtctgtctcttctgaggccaaaggggcttaatctggttccaggatgtcacactggtagctactcacctggtatttaatcaatcaagaagaggtttattcatcccacacacagggtctcctccctagagaaggatctagtggttgatgggctggattctagagccaaactgccaggttcaagtctcaactctgccacttattagttccaggactttgtacaaattattaaccaaactgagtctcaatttccttgtttgtaaaatggaggtgatgataataataatacccatctcatagagttgtcttaaataaattagctggcagagatcaagcccttgataaatgacagcctgtgagccaagcactgctgggtctgaagctaatgaggccacatactcagcctcactgtttgaggccaccgtttgaattccaagattaaacagtgcatgcctttggctccaagggatggaagaagagagcatccaaaccacagaataaaatccacaagcctcattatgatatttaagaactttcataatctactccatccttctttccaaatagacctcctgctacatttccacaccagctctccaggtcatccatttatttaaaaaaaaaaaaaaattaagcacctaaatgccacattccgtgctaggccaggttttcccacctggtgaactcagtgcctccttcttcctagattctgcccagtcttcaagacagagttcaagatctagagcttccacatagctgtccctggctactctgacccacagggcttcccctcgtgacccctctgaggtctttgggttttacttggctttcactacacattcattatttggttatatggttatattttataagcctaaataaagtacaagcaactcaaaagaagggatgaatatggctgggcacagtggctcacgcctttaatcccagtgctttgagaggctgaggtgggaggatcacttgaggtcaagagttcaaggtcaacctggacaacacagcaagatcccatctctccaaaaataaaaaaaatagggtgggaacgaatcttacatttctttgcatgtatatccctaagtgactactactgtgctttgtactcagcagggatcagtgaataaatgatttaatgtttcaggaggacataaatggctcaaaacctattaccattctttccaaacaaatgatttccttcaaatcaatatagtagagaggcctaaaggctcaatctccagacctggactaagtaggtttatagttccacctgccatttattagctgtgtgaccttaagaaagttatttgacctctctgtgcttccatttcctcacttataaactatggattattaaagtatctatatttcttagagtatttatgaggatgaaatgagataatacatgtaaagaaatttggggcctgacacacagtaattatttgaaatattcatcattgttataactacccagatgagctaaattcagctcatccagaatgcccaaaaaaccattttgtaaagtatgctgggcctacagagaaaaatatcagatattagcatataaaaaattttttttgcagccaggcacagtggctcacacctgtaatcccagcactttgggaggccgaggcaggcggattgcctgagctcaggagttcacgaccagcctgggcaacacgatgaaaccccatctctactaaaatacaaaaaattagctgggcgtggcagcgtgtgcctgtactcccatctactcgggaggttgaggcaggagaattgcttgaacccaggagatggaggttacaatgagccaagattgtgccactgcactgtagccggggcgagtgagactctgtctcaaaaaaaaaaaaaaaaaaaaaaacaaaatttccctcttcttcattcatttgatctattatgttgtgcaaaagggaaacaaccaacaaacttctacaccaaaaaggcatccatacctctgtgctatttatcagttgcctcatgctattataaaatctgtaattcatccagcggtggtggctcacacctgtaatcccagcgttttcagaggctgaagggggtggatcacttgaggtcaggagttcgagaccagcctggccaacatgacaaaaccccatctctaccaaaaatacaaaaattagctggatatggtggtgcatgcctgtaatcccagctactcaggaggctgaggcaggagaatcgcttgaaccaggaggcagaggttgcagtgagccgagatggcaccactgcactccagcctgggtgacacacagagcgagactctgtatcaaaaaaaaaaaaaaaatctgtaactctactgtcccttccacctcagcaaagccttgagtgtgtattcaactcaaatatatatatacttgtgtgtatattttcccaaaggcttcaaataggaaaggaagatctgaagcaaaactgattcactatcaaattcatcaaggctggacagggccattgaactcactcctttcccataaagtgccttcttcagttgtgtttttcagtctgacccaggcatcaatgaaggcagaaagcccagcctcaaacccacaaggtgagactagacatcttgtcatcaaaacagcatgttttccatcaagccgcttctctccctctttctctctctctttttttttgggaggtgggggtgggggggtgcatttctactacttttcgatgagattttaagtcaattccattttaatacacaggctaaaaggcaaatagcacttcaataatgagacaaaatgaaactgctgatagacaaaaatagagaatgggcagttgaaattcataaactggcattcaaaaaacaacaacaacaaaaaaggcctagcaactttctttcaagatatttatagccaggggaagtggctcacgcctgtaatcccagcactttgggaggctgaggccaggagatcgagaccagcctggctaacatggtgaaaccttgtctctactaaaaatacaaaaaattagccaggcatggtggcacacgcctgtagtcccagctactcggaaggctgaggcaggagaatcgcttgaacccaggagacagaggttgcagtgagccgagatcacaccagtgcactccagcctgggcaacagagggagactccatctcaaaaaaaaaaaaaaaaaaagatacttgcaatgagaggaacattctactttccaatccataaaccagtttctgccagctgactctcgcttagtctacgtctgcacacaaccccagatctgagtctattggagtcttaagggagatctggtttcttcagtataacacagaggtgaagagcatagatgtaaaatctgaatgtaaaatctggctcttccactttccagctacatgacactacgcaagttacctaatctctccatatctcatttcatcatttataaaatgccaaattaattctacctccaagttgtgattaagtgagctcattaaataagaatatccttattcatttttatattctttaattgtttagcccagtgcctggatatagtgcccactcaatagatgatcattactatcactctcatctgtatgtgcaattcaacagccaaaaccaagcagctaatcacttttcgagtcaatgcttttcttgctgagacctgccagtttccagaactggtccaacaaattagttttatgtagctcattacagaatagacacaatggaaattataataaaatagagcaaattaagcttccaaatttactaagtaacccctcacagtaaacacactaagatggtggtgtgggagatccgatactcttagttaagcaacaatgttccaagtcatttgcatcttttcatctccaatctcatttggcctccaggaagctcagtgtatttctctactttttaaaaagttagtaatcccagcactttgggagaccaaggtaggcggatcacctgaggtcaggagttcaagaccagcatggccaaaatggtgaaaccctgtctctattaaaaatacaaatattatccacgtgtagtggcaggcatctgcagtcccagctacttgggaggctgaggcacgagaattgcttgaacccaagaggaggaggttgcagtgagccgagatcaggccattgcactccagcctgggtgacagagcaagactctgtctccacaaaaaaaaaaaaaaaaaaaaaaaaaaaaggttacatattgaaatatgtgaaataggcaaaactaaatacctcccaagcagcctatgtcaagagtgtcacctcaatctagaagatctatttatttgctaataaaggacaaaaatgctttcttgaaatccttattcagggacaaaaatgtaaatacaggtcaggcacagtggcacatacctgtaataccagcatgctaggaggccaagaagagaggatcacttgaggtcaggagtttgaaaccagcctgagcaacataggaaaccctatctctacaaaaaataaaacattagctgggcatggtggcacacgcctgtagtcccaactagttaggaggctgaggtgggaggatcgcttaagcccaggaggtagagcctacagtaagccatgattatgcctctgcactccagcctgggtaacagagtgaaacttcatctcaactaaagagactgggacaaaatatatccaaaaatatataacaaatatgcaatttatattatgcaacttacctgcagtggctaaacaggagctcatcagggcaaagatggcaatcacataatgggaagtcatttttatttctccaacagtgcgtctcgtccagtcacttcagcctgctcagagcacagacaatctttgcaaatcagaagtagtcttaaagtccctccttgcaattttcaaactgcctgtaaaacaaatttcaataagaaaacttaatgaagaaacttcataaacaaacagacactaaaattaaacagagaatttctgaaaagcgtaatgtaagaaatttatcttaaaagatgcaaaatagcactcaagcaaactagactgagggcagtgactatctaataaagatttttatagcaaatacttttgcaaatgacatatttgttattggctttttttttttttttttgagatagagtctctctctgtcgccaagctggagcacagtggcgcagtcttggctcactgcaacctccgcctcctgggttcaagcgattctcctgcctcagcctcccaagtagctgggattacagacatgcgccactacgcctggctaatttttgtatttttagtagagatggggtttcaccatgttggccaggctggtcttgaactcctgacctcgtgatctgcccacctcagcctcccaaagtgctgggattacaggcgtgagccaccacgcccggccctgtttttgacattttaaatctttggttttatagagaattttcagaactacagaagaaaatcaaggtgcacctgaaatataacaccaccagttaagttgtggtaccaaagtaatcaatgacacttgatacatgcaaccctagtgccagcaagaaaacaaaaccagcactgattagagactcaatctaatgttataataacagggttatcacaaggatcaaattaagttgtgctaggaatcaatctgaaaaaaataaagaaacataaaaaggcaaggttcttatttcaactgtttgccaacattttaacaggaaaaaagtcttccctgtctctcagcccatctgagactatctggttactggactcaaggatctagaaggttctttctaagcttttcctatccagagtcttcaatgagagttttgtggtggtttgcctaacttgaatattcctcacacggccctaatggtcactgatttagacactccaaagtatatttctccagccctctatccctgagcctggcacaactcacagaagttcaattaacaaacatgtactgagcatttactatgctccaggcatggttccttctcatcaagaataaaagttatgggtaaaagtgcaaagaccctccctgatctaagccctggaaaaggcagaatggtggcatttccgggagccatctcacacacctgggggttgtggccttgtcatcctcactcaggaaatatcacgcaacaggagttgcccatagctaccttcagagacaaagccaatgtgggcgcttgtagataacagtacaaaaaaaattattttaaatgagtttttaattaaatggtcttaatttattgcatcaagtgacaaagagagatatttaaaatggctctttgcaattgtaactttacctatgagaacgggggaaatagggtgactgcaggacaggggtgggagggagcagaagcttttcactgaattcccttctgggttttgtattaataccatgtgcaagtattacctatccagaaataataacagtaaagttccaatttcaaaaagaatttcttagatatgtcttgaaactaaattattatataggcaggaggccactatggttcaatcttgatatacgatagtgattaaaatcctagtatgaatagcatacggattatgataaagattaaaaatctgcctgggtgtgaatccactctgccccttaccaaatggtaatgttaggcagcttactcttcttgaatgaacatatcctgtggtaggaaatgtatggtaggctgttgtgaggattcagttagttaatatacatacacaatgcttagaacagtccctagcacgtaacaaccaaccaaataaatgttagctacaattactgtactgtatcactacttgtccattctctttgagctatttataccaataaagtggagaaattaagatatagctatttatgtaattcttagctactgtaaatccagttcaatcttttgtttactgaaaaataaacattacaacagtcaaaaggagataagctaaagagtggactcactaaaagaacaaaattaccagtcaagttgaggcataagtcatcaatgacacaacggtcttgtctcaaaagctgactaaattatagagataatttgggagccattaaactgacttattatccctctaagtcgaacatttctgtcaccataattccacatcaactctgatcatatggaaatcttctccgttaacttaaaaattcaaccaccacaaagaggatctgtctctatttttttcccttcgaaatattagattccctaaattagtgaattggttcacaagaactatagtgcctcctgcctatataataattttgataaggaaaaacctctctgaaacaatatgctatttcagcaaatgttaaagacaacttttataaagcaaatccctgtaaggagatctcagaagaagatgacttcccagaggattttatgaagcacataaactgtaagcggcacgaggcttgtgggaatatttaatgagcttgcgtcaccctgcccacagctgcagtgggtctgagggtctgtgctgcgttaatccaggggcttaagccaggtctgaacaaacctgtggaaaagaaaggcaaatggttccattaaaaatataggctgcaaattgctgacaagaatattgggcaattattaaaatgcagcaattacagatataatagagccaagctaaacagtttgatgcccaaaggcaaaccacagcaagtttacaccggatcttaaaacatctctgaggaagtcctggacaagttgaaactacacactgctgtttgtaacaaaaagggagcttttcttcttttagcttaaaagtctctccataatgtaactgttcaaaaagaaaataaactgcagaaggtttttgtctaatctccccagtgtggtgaaagattcccaaggcagaggagaagcaaaagggaagtgtgtcattctcattcagctgaactccagttttggccacaacttgtacacctcagtgccttaacacccgacttaggaatcagttccctggaatgctggatggactgaaggcttccgaaaagttgtagctttgataaaactaacgaaatacaaactcctctttcttctgtgaggttctaccacactgactgcaaacatcagggactcccaatcctgactttttgacctcaaagaatctctggactttatgaactaaatgctttctttagaaatatgggttctggctgggcacagtggctcatgcctgtaatcccagcactttgggaggccgagctgggcagaacacctgaggtcaggagttcaagaccagcctggccaacctggcgaaactccagctcaaccaaaaatacaaaagttagccaggcgtggtggtacgtgcctgtaatcccagctactcgggaggctgaggcaggagaatcacttgaacccaggagagggaaattgcaatgagccgagattatgccactgcactccagcctggacaacagagtgagactccatctcaaaaaaaaaaaaaaaaagaaaaaaagaaagaaagaaatataggttctgtctatggagtagccattcctttattcctttactttcttaataaacttgctttcacttaaaaaaaaaaaaaaagtagaaatacctaatgtaaatgatgagttaatggtttcagcaaaccaacatggcacatgtatacctaatgtatacctatgtaacaaacctgcacattgtgcacatgtaccctagaacttaaagtatttatttaaaaaaaaagtagaaatataaatagggtactctgagatcatgaaagagcaatttggaataatagtcattttccccacatttcaaagcaacatgttccatttaaaaggtaggtgaactttgatgaactgaagaacacttagtattcatcaatgaacataagaaaattctgagaacttggccgggcgcggtggctcacgcctgtaatcccagcactttgggaggccgaggcgggtggatcacgaggtcaggagatcgagaccatcttggctaacatggtgaaaccccgtttctacttaaaatacaaaaaattagccgggcgcggtggcaggcacctgtagtcccagctactcgggaggctgagacagaagaatggcgtgaacccaggaggcggagcttgcagtgagctgagatcgcgccactgcactccagcctgggtgacagagcgagactacgtctcccaaaaaaaaaaaaaaaaagaaaattcttagaacttaatgggtttaaaaaaaaagcaaacaaatgtgctgctaattctgctaatttcagagatcccctgggtttatttctgagtccattaaactgagcatactgccccacatgccctcatgacccaacagagtgcacaggtaaagaccaagattagctgaaaaaatcccatccaaatgaatcctcaaaaccatcacgttctaaaccaatattcaaaaggatctggttgggtacaatattccctaaggtgaggagagaaatcttgctctatctaagagaaaaactgtggcaaaatggatgtctggcaataggctaaaaaccagtaagaaaaaattagtagcttccccttagatggctaacatggcctggctacatccatgagttgattcagaatcagaactaaactaatccccatcttcagatagatttggcacaatgagagaaaaagtcctagatttggataagaaatcttcggaatcacatccaagcacaactgatattcaataaatattactgctatatgccaggcactgttcaagatgccagggatatagcaatgaaaaaaagacgccaaaaatcctgccctcagggagcttatatccgagtaaaaatatcatttactacttctcacaagacatttaatttcctgagtttctcctttcaacaaatctttattgcttactctgctaagcagtggccaaggagacatgttttttgcccttgtgggcttaaaagctggtgagataaacagacaataatcacaaacatgtaactacacgatataatcagagctctaaaggaaaagtatacgcaacctgaggataagcgaagattttaaaagtcaggtgatgaatgacactgcaggcagaggaagcattacaggagggaggagagctgcagagctgaaagggaaagagaagaggaataagttcaaggaggggtttaaacagggaatagcgtgatcagatgggattactaaagatttccctcacgctgtacagagaacagactgaagggaggccagactgcctggacaatcagttgagattctcacagcatgtcagacaagaaaggatggaggtttagatcagaatggagcctcagtttcctcctttgtaaagagtgtaacagacaaaacttagctacatcacagagttgttgcaagaatcaaatgagattgtgcatgtatagtattaaaactatcatttatcattagcaagctgtttctaccaaagagatttattatcctgaggtatcagattaattagtcccaacattctgtggctgccagtggcaggaaaagaaaggaggaagattactctggaaccacctgtactggtaggcacgggggaagcagtacgcacagatggtacgaggagagcagagaagcctgactccactctgcctgttctgtgccggctgccttcagaggcaaggtgggctgtccctccagagcaggcccaccctcattcctggctgggagcatgatcaacaaatctggccccagcagccttggtttccttggggccgaacttcagtccgtccttaagagcccttccatctatcccaagcacaacacacctcactcccaaggaaaatacaggaaaaagggagggtgggtgttgacacatttcacaaagttggaaaagaccatgttttattcaaactcacaaactaggatggctttttcacccacccttgcaatactctaagaaccaccttttcacatttaagatttttgcatccaaaggtttctgtaccttttcatttataagggtgtctgcttttaagctagaattaataaagaactgtatttgggggttcaaaacctggcttacccagctgtgttacattggaaaagtcatttagcccctaccacgccctcatctgtaaaatggtagcaatattttgattataatataagacagaatataggcatggtacctaaaacaatacctggcccacacagtctattttattttattctttcttttttgagatggagtctcactctgccacccaggctggagtgcagtggcacgatgtcagctcactgcaacctctgcctttgggttcaagcaattctcttgtctcagcctcccaaatagccaggattacaggcatgtgccaccacgcctggctaatttttgtatttttagtagagacagggtttcgccatgttggcccagctggtctcgagctcctgacctcaggtgatcaacccacctcagcctcacaatgtgctgggattacaggtgtgaaccactgtgctcggccccacactgtctattttaaataaataatagtcattggtatttttatggttaaaatatacctagacttccaaaaagaaaataagcaaactactagtagcaaggcaacagaaatagttgtttatagcaaattttgtattatttttgagattagactttatcatctagaatttcaaaaattccctccatcacaaaaaaatgattccaaattccatacaaggtatgggttctaaagatactcataatgtagcaaaactgtccaaatggtggtgaagccattgcctcaacatttctggtataagttacagggatctggctgcagggcccttctcgattctatttgatgattcccaattagctgcaggggttcagctgggggctgtggaacttggtctggcactgccaccaaaccaaccaagctacctagaatgaggaatcagctgtcatcaaaaaggtttaaatcataaagctgtaattattcgagcaaaattcagcatatcagaatattctcaggacaacagtcatcctccctcaggccctagcaagcacctggccattgaaaaaagcttttgatagcctggacaacatagtgaaacgctgtctctacaaaaaatttaaaagtgcaccaggtgtggtggtttagagcccaggcatgtgaaacactaagaattaaaactcttcaatggttgcccactgccgtccagataaacagcaaaacttcacatggccaccaaccatcgtctagttagtccaagctcatcttctgcacactccagccacactagtgtcaattcagtcccacaaaagggccaagtcctcaccttccaaaagtgatgttcactatatcggaactcaacatccctccatggtccctaggatggtcactttctaacatcttcaggtctcagcaaaagccttacttcttgaaggaagcctcctctgattcccttggaccaagttaaacttggacacctagaacgcagtacaacccttcaggttgtaattattatgtaattatttccttccaagtatggctttcccactgtcttaattccagcaaggcggatcacagtctacctacacttggctgacagcgggcatctaatgagggtaccacagtggactacaggtataaatactactgtgcacactacaataaaaatagtacaggccgggagtggtagctcacacctgtaatcacagcactttggtaggccaaggtgggcagatcacttgaggtcaggagttccagaccaacctggccaacatggtgaaatcacatctctacaagaaatacagaattagccaggtgtagtggcacatgcctgtaatctcagctactcgggaggctgaggcaggagaaccgcttgaactcggcaggcagaggttacagtgagctgagatcacgccactgcattccagcctaggcaacagagcgagactccgtctcaaacaaaagaaaaaagaaaaaatagtacagcaggatgataaattagaacatttctcaataacaagagttatgtataagaacctcaggcatcctcaaaggaaaaggaggcaggagtgcgaccatcagcatgttttaccagctcagaccttctgcatcctacttccctcatttctaatatgaagaaattaaacaagaaaatcttttattctatatcatactataattgtcattacatggactaataatcctgaatcccttctagaaaatgagacttcaaacacacttgtggaaatctgaaatgcataattatgtaaaggctagcaggaataacttcacaaaacagaaaagtgttatccaagaaaaatattcaacttggcaacataagaataaacagaatattaatactacattagctattttaatatataacttacgtaaacaaaaattatttaaatgcagtatcttcccaacaatgtaagcacacaaaaaacctgaattttgtcagatctaaccattttatcacaatctgccatctttatgctattcctcaaagtccaagaactctaccaatagtcctcacctcattccaaaagagacttctgattaatcccatcctactgtgaacattctgtcacttatcattttgtgtataatttgttccatgttatcttctagtcagagccaatttggaatgctagaacaggtagtatctactccgaccctttaattttacagattagcaaaccaaaaattagaaaggctcaacgactggcccagctttacacagctacttagttacaaagccaagacttgtccacatgctgctttgtaattattctgtggttgatcaagtgtctataccttattccccttcctgtcagaagctgacatctctgctttcttctgaacccacaaaatgtctgttatcatctactgaacacctatcatgtatatcacaatttcccatttaatcttctcaacaatacaaggagacagatgccctttactccattttgtagtgagaaaggtgaggcttcaagatgctaagtaaggctgggtacagtggttcacacctataatcccagcactttgggaggcagaggccaaaggctcccttgaagccaggagttcatgaccagcctgggaaacatagaaaaaataaaaataatttgaatatcaggagtttctgaaaataaataaataaataaatacaaacacaaatattagccaggcatggtggcgcatgccaatagtcctagctacttggaaggctgaggcagggggatcacttgagcccagaagttcaaggctgcaagtgagctacaatggcaccactgcactccagcctgggcaacagagtgggactctgctctgtcaccaaaaaaaaaaaaaagatgctaagcaaccccaagtcaccagcttataaatcctggcaccaggacttaaacctaggtctgtctaattccacgcccatgctcttaactactacaaacaagagatcctccagaaacagctgactttcaaaaaaaagatagggactgtgcctattactaagccactgtagacatcaaccaggccctgcatggacactcactttctggtggtgggtagtctgatgagatctggcacaagggacaaattattttgttctgaaaccagggtggcaggccttgatcagcagttttagtttacttcattcattcactcaacaaacatttattagcgcctaccctgtcctgggcactgttcagggaggtgggcacatagcagcaaattaaacacactcctgttttcacataggttaccttctaaaggtggggacagacaagacaacaaataaataatatgtcaaggcatgagaagacctaggaaaggaaaataaagcaggttaaggagagagagtgatgacaggagggatgctattttagacagggtggtcagagagggcctcccagacaaggtaacatttaagcacagaggtaagagataaagctatgacaatatctaaaggaaaaacctcccaggcagtgggaatagtgagtgcaaaggtcctgaggtaagagcatgcttggtttgtcctagaagcagactacagtacagcatagtggaaagtgcggggcccccatagcctacctgagttcaaatcccccacctgccttttctaagcaatataattttgggcaacttacttaaagctccatgcctgatctataaagtagagataatgattctacctccttcatgggattgttatgatgactaactaaattaataaataaagcacttacttcctagtatgttgttagaattcaggaaatggtagctttgattatttttaactactcactgataactcagctccattctagacaatttattttcaatgtgatacctttgaatcccagggtgaatgacactgcaggctttgtacatggccaatagcttcctcctaagcctttgcctttcttggctgggcttcctatccctgtaggaaccatgccgatgttatctcaataagagcaggaggcaaattcctctaactttactattacactaatacaaattatgtacttcattccacataatccctacccataagagtctgacacttcttcagagctgaatttattgccctgaggatttacggtattggtttcacaagatggggtcctgccaatcctgacttcccactagcatcatcagcagaagcaagcagaaatttcagggacaaccccttatcttgagaagggttaaaacttcacttcgaaagatggtaatttaattttaaagaatccgttctccaatgtcctttttgcctaaaattaagatttctcttcaaagaaattacaacatcaaagcaaaactcaagagtcatctggcctaaaagtctcaagactgagcacagcccccaagcaaggcagctctggaagggactgtgtaaccagacaaggggatgggcacagaaacaaggcaagatgtcagggctgcaaggaaattctgccctgtttccccctgccctcttccctagctcttttctttaacgttgtgtttgcttttcatctttgtagcctgctgggttaaagggcaaaccacaggcagagagaaaccgcagcaagcccatgcctgttagaggtaaaatgggagtcttcccaaaccacttgtaaggatggggggacccacaggtgctgctttgagtcagacatgaaaacgaggtcagtgttctagtccaacgagtcttaaatgaggctttttaaaaatcagattctccttccccgagattgatggttttccctttttttgacggggtggtgggagggggggatagggtttcactctgtcactcaggctggtgtgcagtggcatgatcatagctcactgcagcctcgaactccttggctcaagctattctcccacctcaactacagtccctttaagcagggactacaggtgtgccccaccacacccagctgactttttaagatttttttatggagatggggtctcactatgttatccaggctaatcttgaattctttgcctcatataatcctcctgcctcagcctcctaaagcactgggattataggggtaagccatcacacctggccaattttcccttcttttttttttttttttttttgagatggagtctcactgtttcccaggctgtagtgcagtggcactatctcagatcactgcaacctctccctcccaggtttaagcaattctcctgcctctgcctcccaagtagctgggattacaggtgcctgccaccacgcccagctaatttttgtatttttttttagtaaagatggggctttaccatgttggccaggctgctctcaaactcctgtcctcaagtgacaggagtcctcgagactcctgtcctcggcctccaaaagtgttgggattataggcctgagccaacacgcctggcccaattttccctttttaatgccctgagtgcacctataactggggctataagaaatccataaaatgggctgagcgctgtggctaacgcctgtaatcccagcactttgggaggccaaggcgggtggatcacttgagatcagaaattcaagaccaggctggccaacatggtgaaactccgtctctaccaaaaatacaaaaaaaattggctgggcctgatggcatgtgcctgtaatcccagctacttgggaggatgaggcaggagaatggcttgaacccgggaggcagaggttgcagtgagccaagattgtgccactgcactctagcctgggtgacagagtgagaccctgccacaaaaaaaaaaaaaagaaatccataaaatgcttcttattcatttaataatgtttatcaagtgcctgcttcatgccaggactgttccaggtgtgggtattcaacagagaacaaaacataaaaatccctgccctgatggagctttcattctagctaaaggagacagactataaacaagatacataattatatattatatagagaccaatgctaagaaaacaaagcagaaaagggagagacaaagtatgtgtgtggggttttggtttggtttgtctgttttgagtaaggacctaacagaagcgaattctgtagctatttggggaaaaacattccaagcaaaggaaacagcacatgcaaaggccctgagacagagcgtatctggcgtgctcagggaccaacagtcaggtgcggcagctggagcagattgagcagcctagagagcacaagagggaagtcaactgggtcaccagcataagagtggtgggctggttgggcagggctttgcagatcactgtaagaattctggcttttattctgagaaagacaagaataaacagtagagtggttttttggttttttggtcactctgtcaccagactggagtgcagtggtgcaatctcagctcactgcaacctccgtctcctgggttcaagcgattctcctgccttagcctcccgagtagctgggattacaggcgcccaccaccatgccaggctaattttttttttagtagagacggggtttcaccatgctggccaggctggtctcaaactcctgactttgtgatccgcctgcctcagcctcccaaagtgctgggattacaggcgtgagccactgcgcccagcctagagtgttttaagcaagggaatgaaggaatctgacttaggttttatcacaatcattctggctattgggtgggaactaggctgcagaggggcaagaagagaaacactgctctctggttgttctcatctttagagaaacttaaggaagattattctaagccccactgtaaccctaaactctatgattctgagttgattttctgtgtcttttctatagctataatttatatcaactgtaagcctgatctttccccaaagccataactgaagtgggctgaaatgaagaattccatttgacaatatatctataaaccaggcccatgctacacacctagaataccaagatggtaagactcaatcctgctctggggaatctgccgaaggaaaaacaacattctcacgaggcagcaagagaagcacctgccaggaggagccacatgaagccccactggaggagctggcagcagtgagagcctggaagagtaagcaggaacccccatagagaaggagggacatgggaaatacagaaggtgacactgtggaggctgtggaccacagagaagtaatatggtggcttttggactgtaacagaaaaatctacagaacaaccagatggcactgtccgataggctgttggaaatatgggtgtgaaaaaacagggagctgctgatattgaagcacagaaatatgagcaactcaatgtagactgaaaagacaagaaaaagaaaagaagaggggagaggagaggaggaaaggaaaatgcaaccttggaaaatgtcaacccatagggatcaagcattgaaaaggaagactgggctgggcactgtggctcacgtctatattcccagcattttgggaggctgaggcaggcagatcacctgaggtcaggagttcaagaccagcctggccaacatggcaaaaccttgtctctactaaaaatagaaaaattagctgggcatggtggcgcacacctgtaatcccagctactcgggcggggggggggggtgggagtgtgcagctgagggaggagaattgcttgaacccaggaggcggagactgcagtgagccaacgtcgtgccaatgcactccagcctgggcaacagagtgagactccgtctcaaaaaaaaaaaaaaaaaaagaaagaaaaagaaacaaaatggaagactgaagagacatccggaacataagaggaaaaccaggagaactcgtttcagggaaaccaagaaaaaaaatgggggaaaaaggatagtaaagcagcaaatgcaactttgcactccgtacttcacacctcttctagcacctcatgggggtgtggtgggggtgtggtgggcgtgggagccagcagcaggcagaagagtaaatgggaggtgagaagaaaagcaccaagagctaaaacacattagcctcagtgacaagactaagagttatcaaagattatgcagcatcaggaaagtcttattcaacactctgtggaggtgtaaggtgtgagaaacaggaactaagacctgccggggctgatcttctggcagtggaaaggagatttcttagttaacacctaggtctcacaggaccactaatcctgaaactagcagtaggcatcccgaaaggctagttgcttctgacaagtgctgaggacaatatattcacccacacatcatccaaatgctaggcttcgcacctccatacctttcccacactaacatccctagttttctcctccagcagaataatgctaggcagcagggactacatttcagttcaaagcatggtaaaaaaattcatataacaaaaaccatagcaccactaccaggtatgatgctgtgagcccataacctgggaccattcaggcaggaaaaggctttaccaaaaacacaagctgggtcccggaacactggacccaaaccctttcatgtcagcaaaaactgcctaaatgctcttctatttgctctctgagaaacaaaaagaagccgaaggaggaaaaggcctttaatcctaaaattattcttaatttccaatacagagcatttgagaaaaatctgaaagccaacagaaaaactagcagattctttaaaatgtgtgtctacagtcctttctcctttaccctctgcaaaaaaaaaagcaacccaactcccaaatgatcatttttcttggcttaatttcactattttttgtgatacataattggaaacagactgctttttcctggctttagagaacaggatcttcagggttataagagttgccaactacagaacctcaaccttagcaaaatttttttgcaaacctcttacctatctacctacttgaaatacatattaactccaaagaaaacacgtaaatcccctattattatgcaaaagtggattttctcccaacaaattagacactcctctccttttcctagcctacccattgaaatcctgctctgtgttcagctatgtcccattcaaacatgaccaaaagccctaaccagcatggtatctagatgggatactttttggaagcattttcttttttcttcatattttctttttttgtgtgtgtggtgggggtagggacaaggtctcactctgtcacccaggctggagtgcagtggtatgatcatgactcactgcagcctcgacctcctggctcaagccatcctcctgcctcagcctcctgagaagctgggactacaggcacacaccaccatgcctggctaatttttaactgacattttcaggaatttagtagaattggttctacaggaaagctccttatttagcccacacagtgaatgaaattaaaacctggaacgtcttagagaacaaccactctaacaatgaaataaagatgccacaaattgaaaaaagatataaatatggaaaaatgtgaaatgcaacaagtaggtcatccttcccctagctcctgtgtcaaaaacatgatacatccaatggctgtacagctattgtaacgaataatgagtatgacagcttaaaagctcaaagacaagtgtctttacaaaatgggctgttggcataagtatttttttcaggattcagatgatttatcacgaatacataacaagtagcaatctctctaaagtctcgaaaataagaaaatgaataggaatgtctattcagaaatgctttggctaaaagatagaccagcaataggaaacatgcccatttagatcagaaacttctcccacacacatagggaagaccttacgctgcaatgatgcaaaatgtatgtaatgagtcaatggtgctttccctcaaagttaaatttaatttgccagccaactgcacaaaatctaatataacaaaatgagatacttattctttatggagactcagaagagttttgttttaaagaaaaaaccataaaagagataactcacagcaacacagtgagtatcttacaaaagtactcagggtaccacatgaacacaagcctttgtgattagaatctaagtttttcacctcaaataaccttccagaatgaaaagaaaaaaaaaaaaaacacacattctgctccagcaattatcacacagttagttaattataaaatgaaatttccaaatagtctccagagtatttttgcatccaaggaccaatatcacactgtcaaaacaataaatcactaaaaatgctaacaaaacgaatactcccaaaagggacccttttcacttgccagatggaattaagtattcatcaagtttccattagcaaaatagtatgatacaaatttaaaaagaaatccagagttctactagaccctccacctggcccatttgatgttctcacctataaaaggtagtgagtcatgcttgtgaaactgcagaccttcgcccaaggcaatctgatccacaggaaagctcaaggactagtatctgtaaagatcattttctaaagatcatttttcaaggactaatcaacttaaatgtgtttttacaaatgatccatcagcaattttacacaaaaaacctgaccttcggcatataccagagaaatgaattatgtgcctggaaggacagaaaagcaggtgtttcgtcctcctgcaaacaacacccaactccaaaggcccccttcactaggagtccaatgtccagaaagtatacgcttctttataaccattttttaagtaaagatagagctaacatttcagacttaattctaaattatcttggcaacagtttaacattaaagtgggcttgcgggcatggtggctcacgcctgtaatccctgcactttgggaggctgagggggaaagatcacttgaggccagaagttcgagaccagcctggacaacatggcaaaaccctgtctctactaaaaatacaaaaattagccagatgtggtggcccccgcctgtaatcccagttacttgggaggctgaggcacaataatcgcttgaacccaggaggcagaggttgcagtgagccaagatcacaccactgcactccagcctaagcaacagagcaagactctgtctcaaaaaaaaaaataaccattaaaatctaattctaaaaatcaactttgctaggctctacatataactgaatcctcttcccaggatggaagaagatttcaacataaaagaaccaccaccacaaaaaccagacattaggctccctgccctgccccccgacaccaaaaaattatcttcagcagggcacattaggatggcctgaaggcatggttctggggctcttgttctagaccttccattttaaatatggtctctatccctcataagcagttgtcagcctattaagtcttcatctttggcctgaaaaactgaagaataaaaaatgaagaataagttccaaatgacagtagcctcatgcagaatttatatcaatgttgtttcaaaaacacattttggttgagagagcaagacatcaaaatcattattcaagtggggaggaagaatgcttggaaatttgtgctgattcttaagcaaggactttgcaagcagagaaaataaagctcaatgtcagttaacaaacaaatgtgctatttcaaaagatataaaataagaaatctagaaattttatattcctagatttatttattatatttctatatttcctggacagagcccaggaaatgaacccagatccttcttgtaaggcccttccaagctgtgttgatttatttcagcttgactagacactgaacaaattagcaacagcttgtgttttatgacatgctgcaaagaaacaatgctatcattccaagtgttactctgaagatgcagaaccagagaagttactgctatggctcttggtacacttaattttcttcctacagaaatgccctcactcaatctgctgaaggctcactattatgtgtttaaggttagcttttcatataacctagattcactcttaaattccaaattgcttatattcctagtggcaatacaagactgcttttacattaaaggcccctaaaaacatttatctaactcaagttatgcaaatttcaaaaaagttaacattttttaaatttacaattgttttaaataagtttaaaaatatggccgggcgcgatggctcacacctgtaatcccagcacgttgggaggccaagacggcggatcacgaggtcaggagattgagaccatcctagctaacacggtgaaaccctgtctctactaaaaatacaaaaattagctgggcgtggtggcgggcgcctgtagtctcagctactcgggagactgaggcaagagaatggcgtgaaccagggaggcggagcttgcagtgagccgagatcgcgccactgcactccaccctgggtgacagagcgagactccgtcccaaaaaaaataaaaataaaaataaaaatataagaaaaatgctccagtagactgatggaaatggcaataaaatcacttttaagtaactgttaagactgaaaaagaagactgtcctttagtagctaataaatctgacagccaggagcagtggctcatgcctgtaatcccaacaatttgagaagatgaggcaggaggatcacttgagcccaggagttcgagaccagccgaggcaacatagtaagactctgtctcaaaatatatacatattatatattatacaatatatagttatagattatatatatgtgagattttacatatatttacatattttatatgaataagtatataaataaaaataaaaaataaatctgacaattacaatttttatccaacagcaatgaaagcaccacaaaaagatgtttcaaaatgaactatcaagaagggaggtaattcaaaatgaccacagagcagaatcatccaggcaaaatattacagcaaagttattacttacacagtcacagtctaaactctaactgttctgtctgttaagcttaaaatgtaaagtcaggacctttcacagatttttgaagccaggaaattggtcttcacttatatactaaagaagtcagcagtgatcaccttcttaaaactcaaaggacagttgagttccctgggctcttaggctcagattctgccctcagaaaaacaagcactcacctgacttttacaagtcacaaccaagtttgcatgcaagagagaaaaattaattcttttgagtcttaaaaacaatggaacaacactttccttcaagccaacgaaaggctttctgtaagaaagccctaagcaacctgaaggcattttggcccccagtcatcagagcactgaataaggacaattaatttgccaagctccaagaccagaaaccatagcctagtagggagtaggaggttataagtgtttgttgaattactcgagtaaactagagcaaagcatagaagactaaatgagatcctaaataaatgccactctgtagtataagcgcaatgctaagatttaaaaagaagggactcaactaattttgaaagttattttaaaataggatccatgggaccctaacgtagtaaatgaaataaaggtaaatcaatactacataatatggggccgggcacagtcgctcacgcctataatcccagcactttgggaggccgaggcgggtggatcatgaggtcaggagatcaagaccatcggggctaacacagtgaagccccgtctctacgaaaaatataaaaaattagtcgggcgtggtggcatgcacctgtggtccccgctactcgggaggctgaggcaggagaatctcttgaacctgggaggcggaggttgcagtgagccaagatcactccactgcactccagcctggacgacagagcgaaactttgtctcaaaaataaataaataaataaataataaaaaaatactacataatacgcaagaaacaagaaaggaaactggcctacaaaactacagacaaaaattgaaaaccttttttttttttttttttgagacagaacctcgctgtctgccaggctggcgtgcagtggcacgatctcagctcactgaaacctccacctcctgggctcaagggatcctcccacctcagcctctggagtagctgtgattacaggtgtgcaccaccacgctcagcaaattgttgtattttctgtagagatcaggtttcgccatgttggccaggctggtctcgaactcctgacctcaagtgatccacctgcctcggcctcccaacatgctgggattacaggcgtgagccaccacacccagccaaaaactttttttaaaagtcaagtttggccaggcaccgtggctcacgcctgtaatcccagcactttgggaggctgaggtaggcggatcacaaggtcaggagatcgagaccttcctggctaacacggtgaaaccccgtctctactaaaaatacaaaaaaattagccgggcatggtggcgagtgcctgtagttacagctgctggggaggctgaggcaggagaatggcgtgaacctgggaggtggagcttgcagtgagctgagattgcaccactgcactcccgcccgggcgacagagcgagagactccatctcaaaaaataaataaataaatagataaatgtcaagtgtgattttttcaagcatattcttattgtttatgtttacaagtatgagtattcatagacacatcacacttatactagtatcaaatatgatacatctgaactactactatacttgaatattaacgtaagcctctgaggaattcacagtaatagaactgctgttatttaggattactgatcccctattgtcttgcacttagaagatgttaatgaaagatgatgacaggattgtgaacacaccaacctccctgagaacaaattcattatattcagttttctacaaaacacaaatgaggatcattacaaaaggattcacaacaaattcctctggatttccatttctcccaggtaagttgaaatattattcaaaccacacaaaattagtttacatacaaacttcactttttaaagagatgggggtctcactatgttacccaggctggtctcgaactccttggccaagtgatcctcctacctcagcctcccaaagtgttggaattacaggtgtgagccactgtgcctggcctacacaccacttaaggaaacaaattgaaaaaaaactatatgtgtgtttatctatctgtccagccaccatggagttcttgacatatattcaacatacaggccctgtcctcaaggtcattcttaatcagttcaaattaaatctagtcctccattataaactccaaaagcaacttagttattttgctagatattttgccctcccctttcaaactatatgtttaatactctaaaaacgggtttatgcgccttatagatatcaacagtgtgttatgctccccctattgactaatattcaaaataacaatgaactccccacgggttgcctttgaagtgctgggattcaaaactatgttggtgatttttatatttaaaaacatgagctgaatcaacagttgttaggcaaagctgccgtgtaacggtcagattccatcaaaacaggaaaaattaaagttgacaaatgtcaaactgaagggccaaaaaaaaaaaacgctcaagccttgaaacactaaacaatgcagaaataaagccaaaagcaaagaacagcaagaaatagagcaacatcctttaactgacacaatggcatgaaatcaatttcatgttaatagcccttaagggggtaagaattatttccctgcctcctgtgccaaccccaagctgtttcctaaggaagccaagtaatggtgatcaacaatgtctggagaattaataaaagaaattaagaataaagatccatgttggccaggcgtggtggctcacacctgtaatcccagcactttgggaggccgaggcaggtggatcacgaggtcaagaaatcgagaccatcctggccaacatggtgaaacgccgtctctactaaaaatacaaaagttagctgggcgtggtagcgcgcgcctgtagtcccagctactctggaggctgagtcaggagaaactcttgaacccgggaggtggaggttgcagtgagccgagatcgcaccactgcactgcagcctggggacagagcgagactctgtcaccaaaaaaaaaaaaaaatttccatgttaattaatacaagtcagagttctatttataattatttggggccagtttcagaggaactttaattgggcaccctcataagtatgtaaaatcgcctaaattcatcacagataccttatgtgtgtttcaagagatatgcgttcagctcaaatagaaagctgaaagatgggagaagatgcatggactatgcacacaaatctatgtacacacaaatcggcctgcacttgccgctctccgctgaggaaggaaggtagctttggagtcagaactaacagaaagttatgtatgatcttggacaagtaacttaacctctagtgtcttatctgtaaaatagggttattaatagtgcttttcccatagagatgctgtgaggattaagtgcacacagtatgggcttagaaaacgttagctgttattattatccaaaagaaacaactgagttcacactgaagtaactgtttgcactctgcattcaggaagaagaaacggtcttgacgtgtgtttttactacctgtggagacttctcccaaaccgctcacttcttcggaaggacataaaactcagaatacgcctggttccccagcacagcctgtcactcctactatcctctgccctcgccgctcctatcctgccaccgcagggctagcggcaagcagcgctaacctccgtgcggtgcttactcggtgccaagcactgttgtagcacctcacacacattaaatcattagatgctcacagcaactttacggggcaagtactactatcctcacttcacagctagggaaatggaacggttttcttcttccagcttttcgtgaggacaccaaatccactaagttctactttgccaaggtaattcatgcttgacacgtcggctcctgacactatgcgattctgcaaagcggggcaaatgccctaataagatcaagtctgcaagcagattcttctagcgacagtccaagatttccaagtttgtcctaaccaaatgaatacaagaagagagccttcaaaataaaccggggcgggggggggccgagctgcagcttgcggctcagcccgcaaggcaccctgagggcgcggccagcggggaacgcaaaccgcgtccgtgcacgagtccgggagccacagcctgggccacggcaattgactgcgaacccacaacaaaccattcccaccgaagctgtcacgcgcccggagggaagtggccgccgcgccccgcaggggtcagaaggacccgcggagaggaagagtgagggcgggcgtggagaattcctccccagcactgcgcatcgccgggggcactgcctgccccgtgcggccgctgcccacgcaccgctggccaccggtgcctgctccccggagggtaaacaccgccccaccagcgcctccctcccaaggccggaggtcctggcggctggagcgaccctggccggtaagtaggcactggcagcccgcgccgcgccgacgggcacccgcgcagcctgcagagcccacagcccgggcgggctgcagcgccgcggggctgggccggcacgtacctcggaggcggtgtgtccagcggagatccacccgcagcaagttggaggaaagcggcggcaagtttccccgcccagcgctcggcggcggcgagctccggcagctgctgcgccgcggcaaaactacgccatccggacccgctggggactctcacctcctgcagggagctccgggaatcgcgcagggaaagtggccggggcgcgagagccgccgactgccctccttcactcgctgggaagaggaaagtgccgctcggcgtccccgaaaccctcgattacccccatcaggccgacccggcgcactcgccctccctcgcacacacgcgggcggggacgggcaggacgccacagcaatcagcgcgcggggggaagggcgctcctccgccggccccaccgggggctctc

SEQ ID NO: 49 - DNA, 205937 bp, Homo sapiens; identical to SEQ ID NO: 48

SEQ ID NO: 50 - DNA, 205937 bp, Homo sapiens; identical to SEQ ID NO: 48

SEQ ID NO: 51 - DNA, 225660 bp, Homo sapiens
ttaataactgatatatatctttttattatgcacagataaaagatttaaaactgtggttatcaaaactatacatctaagcatcttcacaaaatagctgacacactgaacagagaaaagaatacaacaggggtgttcaaactggccacagggattttaagggtactcgttttaccctcatagatgatgaaaaccagcaacaaaatcaggctcattcaggaaaaaccagaagagagaagtattgtatttggaaactgataatagtcctttttagaaaaacatctgtcagtttcatgaacaacccccagataaaacaaacatgaaaaaaatcacataggactcacccaacaaaatgtgctctgttaacacaaccagcagtacaatcatcattcaaaccatgaggtagttacagtacaaaaagactggcacgcgtgtgagcaccccacacacactcacaatcatgcccactaagaacacaagcaggaaatggatttacaatcttattacaaggcaaagaaaaaaaccattttttttgtttagaaaatgctatagaaacagtttagacagaagaaatctctggctttttaaaatacagagtaacagctggtaaacaccacatggtgaaaagctatagcgtattatacagacaatctgccttggagtttggggcattttaacaacagcttcagcatcaaacaaacaacaaaatggcctctgcaaattaagggtgtagcctgcagaaataacaaaagactgcagatacaagagttcagctgaaatacaacaatacttttaaagaaacttgtagtacacgttataaaagtagagcttgtactttgtattaaaactgtaaagtgtgaagcaattagaaatactgtaatgagaagctagggagaaaataccttatttttttcatgttcattttttagaaacatttcagaaatacttaacgacattcactctccaatatgagattaggttttatcgacacagatttcttgatctgaataataattctgacaatgagacccaaacaaataaaaggtgatttttttcctctctctctcttttaaaaagatcttttggtttgcatctataaatttgtaaattaattttaaattatttataaaatcattggcaatgtagcatctctcttaaaaatatatatttaaatatattacagaaggttttaaccctgtccttctaagacatcaatcttttaatatctcctaatagctaattttctttttaacacgatggaaaagattttttaaaaaagcaaaggactgatcgaaagaattcacagtagctgaaattaaacatttcatatggagtaacttaaatttatctaaaacacttaaatatatctttatacacaaattttgtagtaaaatatagctataagtgacttaaagactctagtcttctttgaagacatctttaaacttttttatacatagaatatgctgaaacaatacattccaccgaaggttaggcaaagcgcaatattttcaaacacaggtagcgtaatctaggtcctccactctgatacccttctgttaaaaaaaaattaaaggaaaaaaattctctaaactcatgtcttcttcgtttgtatatggaaatctagaaatttttcagtagatcaatgtagatagcctggaaatctcagccctaaagtaatgttttagttaaaatgttccttattgaaaaaaaaaaatgttccttattgaatgtgtatatctatcaggtaagtcatattattactcaacgatttggtaaaaatgattgtcaatttccacatacttgtttcccatgtagacactgccctaaggttttaagcttcatcaggattacctactgaggttccattcacagacaaccaggcataacttccttattttaagggcagtgggatttgcttatgaatattttgggggtagaatctatcttgttctacttatggaattctaagttgtttgggggaaattctggaaaaagaataatttgcaatgaagctatcttcagcagtaaaataatttagcatgataattcccccctggcattctttttttttttttttttttttaacaaggaggtatcactgagcttattttagctgcaaagtggcatcatattattccatttaatgaaattcacctcaagccctttttgacatattaaatatatgggatatatttaaggcaagagaagtaaggcaatccaaatgagtgcccttttccaatctcagcactgtcttggtggaattggtgacactattcagataaccaactggagaccgacaggatttgccatgcatttgcatcttgctacagtttggtttttatgaaagggcctatttttttttaagttgacatattttgagtggaaacactcaccctaccaaatatacttaagttgcaactctaaaagcataaggacattttcaaattttctcttcttcaactgagaaaatgaatgtgccaggtgacatattatatacttgtacttgcatacacatagaaatatatcactgtgcaaattcgtccttgactttataactgaatttcacctcaaattatacattaatttgcagaacaaaatattaggaatgggcacaaatctgtggttcctgattttggtcattttcaatttctgtaggcctgtaagaaatacaaaatttgcattaagacattttgcagtggtgtatgcaagtatgggaagaaacaggaagctgataaggtcatcagcattggttttggcccagggcacaagaaaggaatgttgccttaacacttgtcagggtgcagtccctgagggcagcacccatcaagggacacatcagaccccacaggttgtggcagcaaggtcagaagtgtgcatccagacaaaggtgcaaattagacaggaggatcgcttagaaagcctcaaagcatttcttgttttacatcttggttcagatataaagaatctttggccgcatctcctcactggttctactatctggctattaaccctttaccaactccttgagtctgggtaaaactcagggccccaaattatggatgttctcacctggacaaagcagcattttaaaaactggcatgtgtttcacattgaaaacccccaagcctgtgaggggctggtggagaagaccaccattttagctttctcacatgaattctagtgtggtacagaagcccagggtcatgtttatactagccctgggtgtggggtgaatacaacgggtgatctttatactgaaattcactctgtctttacaagggaaccaaaatccagccctctgagtctggacacgaggctcagccattggtcctgcccttggcagtagctgagctgagctgggctgggctgggttgggccgggttgggctgggttgggctaggccgtgctgctgctggagcaaggcgtgctctgcgtgctgccgatgctgtgggcagcactgctgttttccgaggctggcggggaggtggggacttgctgccttcctgctgtctcccctgcagttaataaagaaaaggcagagtcagagaaagacgcatattatgtatgtgcattcctgaaaagatcatttattccgcatttgccattttaactgatatttttctcaaccagggcagaagcaactagactaggtcctagatggctggaataccttctaaaataaggttttgctatttgttgttttatttttaaagcatcatgaatgggaaaaagaagacagctgactgacaggcagctctagtggctaagacccctgagagttgatgacaaagtccctggatttcagggtccacaacctttgatgaaatcaccaccacttggtctgtgtgagctggcaactgaccagcacctgtattcaggaaacactgtccatcttctctcataaagacactgtaggatttggagggtgtgacctttcaattgtagttaagagaaccctggaagtttgggagccttgttctgaatgcacttgttaaaaacaggagtgaaatatagactttgtcctagctacagtagagagagccttgtgtgccaaacagataaattacctgagaaaccggggtgggggatagctgctattggaaaaaccttttggggaaggggtttagctgtttgcacatggggactgcagttgccagcgaatggcctctcttccccactgaggttccctgtggggtgcagtgtgagtatctcctaacactttaagcatcccacttttcattacacaccccactgcattttagctaaagccattcatcgtgccaaatgtgcagtgctttggagaggaaggaaacctcaagtcacacacatggtttgcatttaacagtgcaaaaggccctagagttagtcttctcttcggcaaaaccggcctcagtgcaaccctcaaaaaatggctctaggtagggaaaagcgatcagggctctccaataaaaaacactgcatttactttgaaaagtcagagcataaacttcataaacttcttgtaagcagcatcccctccttcaatgtgggaaaccccagagggccaggcctgtttatgaatgagcctcctctttcctgtcatgctgaaatacacatctatcagccggagataagcaacccttccagctgcttcattaaaacaaaacactcgaggaaaggccctgccctccagtgcaggaacttggccccattacttccattctctttctggggcccctcaaaagcctctgtgaaaaaagcagttctgcaaaatgtagaactggctcatgtccctgggtctggttacagcttttcctgtcacccctttcatgaaccacacagctatacacacttttgcatcaacctcaaagtatttatgtgcttgttgtaagtttggcccttgttgtacttcctctaattatcttttcttctgggattggcgggatggataggggactggggtcaatattcctgagaagcggagaagcactgcctttttttttttttttttttttttgtgagacggagtctcgctctgtcccctaggatggactgcagtggcatgatcttggctcactgcaacctccaccccccgggttcaagcaattctcctgtctcagcctcccgagtacctgggactacaggcatgtgccaccatgcctggctaattttttgtatttttagtagagacacgatttcactgtgttagccaggatggtatcgatctcctgacctcgtgatcggcccaccttggccttccatagtgctgggattacaggcgtgagccaccacgcccggctgaaacactgcttttgacttttttggaaacctatgttttggaccctccccagcactgccctctactcttcatgtgtgtgtataattaaggctggggaaattagcctccatggcaataactttctgccaaaaattcactttccccagagtaggagctttatttctagaagggaatcaaatctcttaactattctgaggtcaaaacaaaaacaacctccagagacccaaacaactctagatatactttaagaatttgactcccttacaaaccacatgttggtccatacccagctggatcctcacataatcaatcagaaggactaatgtggctatgcatgaaccacattttaaaaatattttttcctattttaataaggatacatctgaaaagcaggaggccaactccatctttttcttttttggctcacctgggctttgtttgctcagcccaacagcaggtaaaagagaaggccttgcttcatcaagcaatagggagcaagtgtgctcctccaggatctgccctgtgcttgattattcacattcaggaaaagtgccaggactatgccctgcccaggaagcctgaatatctgctttccgatgtctatttgccaaatataatttgttgccatgtcagtttattttcatccgtgcccattaaagagacctttcaacttcccgagttttgggaactcttgttctggtaatgcaaaacacttcaaaacaaaaccccaaacaaaacaaagaagcctccgcactcaagactgcaggatgcatctcaccagctggataagtcaagttaacctaatattatattgactttgatccaataatgggccaaggtgagtctctgtctgagaatctgctgggaaatattgaaagtcccctcttcagaccatcctttccagttctgtggctattttcacatgtaagatgcaaggtttctcaatataaccatgttttaaaaataactcttaccttttgacagattaagttttttcactgtcaaatggaagtgatgctacagaaaaattcaccatgaggaagaaagttgaatgtacagatgcttctacttaatgggccaacagagacccctgggttttctgagatgggtctttggctgtctgctctccactgcagtggtctctgatttcgtggagcaccaactttctctaaaacatcccttgggtgacaagtataacaaggctgctcctaaaggagatgggcagggaggacctcgtggctaagcagactaggcccaattaacacatctaagaaattcaaggagggcgccttgcttgtaaataaatatcagacttggccagcagaggaaatgtactcagtcttcctgctttcctcctaaaatatcaaaccacattgagggaacagagatttgagaggagggagagtgagtaggggagagaggaatttggtgcctgacatactctggaggaggagagtacactgaggataaggacactaaggattaattccacccatctcacagttagcctatggctgggcctagatactgccagagatgcctcaagaaatagaaaaacaaagccaggtgcagtcacttacagtgccagcttaggaggctgaagggggaggatctcctgaggccaggagttagagactgcagtgagctatgatctcacctgtgaagagcctctgcactccaacctgggcaacagagagagaccctgtctctaccagggggaagaagaaaaaaagaagcaaaaacaaacaaacaaaaaacatttcttaatggagaatgttttatttctttagcatggcatggagttgcccagatctgacttcctgctacctctttggcgtctatattacaactgtattcttatttctaagtctttcaccatggcaggtcctggggaagaaactattcaagaaagatgtgaatagcatgggaggactctgtggggaaacaagagaagagttaaaaagaaaggtgagggcaagcttggtatttaggccaaaggagactattgcaaatactctccatgaggattattacaaataggagcagacagctgttctttatctccctggagggcagaacatgaggaaatgagtttaaatggcaggactagggatttagatcagatagaaaagaacttgctgattatgaggattggttagttatagagggaatttatggaatctccttctcaggagatatttaagcacaggattgaaaaccatatacctggggacactttagatttaatattccttgatgctagaaagaaaataaagatattttcttctagatctacgtgttggatgcgattttctatcaattaatgtctcagtttcttgatctcctaactgtaattaattcacaagctcactctttaagcagagtgaacgatactacctttaatttagagaagtcttcaatcactttttatcattttcaaatttcattcctccccagcctccacacaaaagactcttcttttgcagcaaaattctccaggaggggtgagttagatgttgttagaagtcacggggaaaagactatatcaagaattaaagtttttcacaatgtcctgcctactactttctttctatattcctgcagtgtggccaacctgtttgtatatggactttggttttctgtggtatcttccctgcctttgtggcccctgaataggatgcaaaatctgataataactaagaagaagaagaaaagcaagagggaaagagaaatcaggtggaggaggaaggctgtcctccacagctatcgctacaaccctgagtcagaaactggacttgaagctctggtttgttcaatggctagacttgctaccttagtaggtatattagttgtgtttccctttagtcaacacagagataatcactacttcacagggttattagggtgagcgtacttaaaacaagaaatgcgtaataaaagctttttcaactttaaggctgctctgatgtgtaagcagaaaaaaaatctaagcgtgtaaggaacactgtttcacagagcataataaaatgctgaagttttgaattaggtgtgcccgtcccaactcatcaggcagttttcaacaaccctccatggaacacaccatgtgttcttaaagcaaaagtcaagcgcatacccaaaagtccacccaagtcaggtaagaggttttcattagaagtagctcgggaggtgccaatgtgttcagaggcctgaggtttctccaggttcccaagtgtagcccgatgaaaagagaaacagcaagcagacagactaaggtgtgataaggtaggaggcaagagaccaagtcccagggatcagacagatgcagctggaacagacggaaaccccaatgtgactgtaaagaaggcaggctccactctcttttcactcaaatgcccatatcattattttataaaaccattaaacacagaggttaagatgaatgccttcggctttcctggtgtctattggtgtgtctttttctctcaaaaaacaaagcacctcccggagcatctggccattcatacccttcccccttcttctcaccctcccctcagtttccataaaaggttaatagaaaacttaattcttcagattagaaacacttcttctttctccagtgagacttcccttgtcagttctccatttttctgacacagttcatcaggtcattgctttcctaaaggttggcatgtgtgcctgtagctgggtttctgcctgagccaatctgcttataatcagtctgtttggttattctcttcctctgaatatatgggaactccacgacagcaaggactttctgttgctcatggctattttaccagtgcctagaatagcgttggcatttaacaatagcttaaaaaatccattgaataagttgagtgaaagaacgaatacatgagtgaacaaaccaaaaaaatttagctgacactaaacagaggcaaaaagaaaaaccgaaacacatgttaattaatgtttattatctgataagcagaaggaggataaaaagattatggctacgtgacctttgaatttgtaataacagaacaggaagaaaagagtgaactctgaatcaagaaagcaagccttcagtcctggccgctgtgcctgggtaactttgagcttgtcacatcagttctctgggctcagttttctcgctacgtaaaaaggaaatgctgatgcagactagtaattttccaaggactccctttaagaaactgattaaaaaaaaaaaaaaaaaaaaaaaagcaagggtacgactttgcatagagatagtgcatttaaaggcattgacttgcattcctttcccaaatcttaccagaatgacagtaaatggacttttaaaggcataaacacatgaaaacaaagataacaaaagtaaagataacagcaataaaatatattggaagctggtgaggaaatgggtgagtagcaactgacttggcagactcaagagagccgaaacctaagccaacagtgggaaaaactgagaaacaagcaatttatgtcgccgaacccttaaaaaactcagggaatggtggcatcaggcacctctggaaacctcccttgaacatatggctataagcaagaggggttggctgaactatatgagaagcagaatagttctctacatttcctccctcgctccactgggctgagatctgcccttcctaatccaggaagaagacgggaattttactctcttaagaggaggaaactgaaggttccagaaatgatcaacaccaggcacatttgagggcaagagtaccacattcaaaagggggggattcggcaaacatatattaatacgtattttggctcacctgggcttcttttgctcagcctaaaaggagataaagccagatggccttgcctcatctagcaacagtgaaactctgaatcaagaaagtagggttccagtcctactttgtaacaaatttgtctcctgcagaatttgccatgcgcttcactatttgcattcgggaaaagcgccaggattataccctggccgggaagtctggatatttgctttccggtgtctatttgccaaatataatttgttgccatgtcagtttatttttatcagtgcccattataatggtctttcaacagccagtcctatacctttcaagcaggaggcaaaaaaacatattttatggaagcctgaagagctaaagaggaaagatccaatgatgaggtatcagggattcatcaataaaatggcccagtcagatcatcttaaagaagttcacaatcaatacatcccacccacagcttagaatttcctcattctttttttttcctcattcttaaataatcctatattaatattctcagatgatactgcacccatgaaacaagaatagaactttttttaaaagaaaagaaattcacaggaaaaaagttattagaattaaaaaagttattggaattaaaaaatttgaagccagtattaaaaactcagtaaaaaactgaaagataaagatgagacaatctcccagaaaataaagaaagcagacacatggaaaacaggaaagaaaggaaaattaaaggacaagaggttcaactttcaaataaaatgatttctaaaatgagagaaaacagaaaaaagggggtgagaaaaaaataaatcattcttaaaaatctcagtactgaaagatatgagtttctaaactgaaagggcccaattagtgaccagcataatgtataaacatacacctaactcaagagatatcattgtaaaatttcttccagaaagaaaaaacaggttatatacaaaagggatcaggaatctgcacagctctgaacttctcaacagcaatcctcagagctagaagacaatgaggagggctttcaaaagtccgaaggaaaaagtgtctataatctaacattctgtaccttgccaaactgtctaccaggtgtttctgttaaatgaggatattttcagacatgcaaggtgtgaaaaacatttgcgtcctctgtacgctttaaaccaggaagaagaaaggcaggagatacatgacacaggacatccacaactcaaaagagaagtgaagggaatgcacagaatggtagcgaagaagatcataggaagacagcagtgtccagaaatggagggaaccggttcagacaggagcaggtcagaggctccaggaaagagctgaagaaaaggaatcagtagaacattccatatgtctcaatgtattaaaaggagattgagacagctggcagggtcagcagaagaattaatgataaatacatagaaaattaagctgatgactgaggaaggagaatggcaggaacctgagaggcggagcttgcagtgagccaagattgcgccattgcactccagcccgggtgacagagcgagactccgtctcaaaacaaaaaaaagaaaaaaaagaaaagaaaattaagctaatggggtagggtggggaaagataataattaattctagggaaaattaaaagtcatgcaggatattatactacatgagttaactgtgattagcatttaggtagtcataataatgtaaacagtaaatgctgctctaaccaaaatgtcagtatatttctattaagaggatggtgggggaaggggacattttccataacaggaggtctagagcaaaggtgtaaacctgcaaagtcaaaaagcagcaatatactcaggttatttagaagtatggattaacatccaaaaggatgagctaagcgccaaaaataatgctctggggagtgagaaaagaaggtaaggacagtaggggtgtgatttttttttcataatgagtcttgtaggattatttcaacctttaaactatttgcatgtactactttgatgaagctaaaaagttttactagaaaataaaaataaaagcatttgttcctcccttcaagaaaaaaacagataagattttgcatgtgactttagggaccttcatggactagaagttagggacccctgaactaggtagggttcctaggagcatgaacattctatggttccagcaccatttcagcccccaagcacccctcctctctacagcatcttaggagagaatgtaagttttaggaatggagttttccaaacagaattaatccagccttaagggaatatctcttattgtgcccagagttgtcatatgataaagtgggaacccagtctttgtagagtaacacacattccaggtatgtaagtagatatccacaatccaaatttgtgacttggttttgtgctccgtgctgcacatggaatggaaagcgtaaacaaaggaaaagttattcaaattaaggattgtttttcacacagaggcagatgctatctgaacccccaaatacagcatatacgatctgtgagttccacagcttcaatcactgttgaaattgaacggactgagtcagtatttgtatcctggctctccccattgcccactgcattataatcttccttattaatctaaattgctgctagctgacccaggtaacaaactgaaggggttctggaaaagaactatcatgtggtcctgaagtgagtcttcttcatgcttgtatgatgctggtattcctcaagagcaatctataaaatgaaccagaggctacagtttttaataaaaagtaattttgaagctgtctcataagtcatgccaatggattttaagcccaaatgacagtgtctataaaccttttaccttctgaatcagtgtaattcattttgctggaaagcatcacaggagggaggtctttggtttcatttttcttaaatttacttacaaacctatttctacattaacagtacttgaaaggccctcctgaagtctctggcttgggggaaaaaggatcagtaacaacagacttccaaattcaatgaggatgaatacatgccataccaccaagttttgctttttatcaggtttgtgtgcttggctgtgggtaacagtctggattattggggggatttcagtggggcatgttccagtagtgagtattatctggttgccctatattctgcctggacctggcttcctggcccaagattagctatgagagtgcagctgtgtgaccaaggccagtcagtggctgagcaggcacatggtaaacatctgtgggtgacccagtcttcttggaggactttcaaactcactcccaacagccaacacaggctgccaacagccctagaacctctcagccaggcaggaggttggaaaagttgcaaagaactgttagcttgagatctgaacatgtcggtattcctgcgacaaaattacttactttaaaatgctgctctgctaaattctgtctttctggtccttttataaactgttcatgagggagaatcctcctaaactgattcacagatggttatataatactccagaatcatgacactggagtcttatttattttgagacaacttctctctctgtcgcccaggctggagtgcagtggcaccatcacagctcacttcagcctcaacctcccaggttcaagcgatccccacctcagccagctgggacaagagatgcacaccaccacgccatgctagtttttgtgtttttttgtagagacatggtttcactatgttgcccaggctggtcttgaactcctgggctcaagtgatcctcccgcccctgcctcccaaaatgctaggattatgagaagtcattttttaatctttcacgtaaacatactttactcaaagtatcctgactaggaacaagcatttgaggactcaaagtctctctattcaagtcttctacatttttgccaagaggttgccttttgggtgaatgtcccatgctaggcatgaaagagtccattcctctccttctggcgtaatctaaaatacctcaggcaggagatgtagtatttaaagtgaaaattctgatttgaatctgacacttttaactatcagaggatcactgtgtcatgcttttattctcaacagcttgacgttttgtctagcaatcaagagggtaaagatatgactctccaaaatatccttcagtacttccttcctctttaaatcagccatcctttcagcttggcccaaggggaagccaaagatcatggcattcattggtttaatggacaattaatgaaattataaacagagaagctgggcctgccacttgcctctgacggatcaatctagcacagtttatctaggttcacagtataaaactacaaggatccaagaacaaacaagaacaagaccgattttatacattctagttctccagaatgccgcaaaatgcatgtcactcctgcccatagttgaaaggaaactaagaaagaatcaatagcaggacaatccatttgttctttctccattgcactaaagactccctttgctggcctgcattctgtattggggtcagaacaggttctctcatcaggctagtatgtttcaaccttgggattggtagggaggagcacatctgaattttgaagattgagggataatagcttgaaaatgaagtgctctgtttcatcactttttttttttttttcagttcatggaaatctatttagaaaatttaactttatagaaaaacatgaaaattttatgttttatcaaagaagacatagcatgggttaaaaaaaggttgagaaaatctggtttaagtcattgattaaggactctgatggacagtgctcaataccttggcaggtgtggtaataaaatcttggctttctttttcacttcctctcatgtatatgcctatccttaagtctttggttttgacggaatggtttgtatttctgtacgttgtctgcattaaccttaaactctaacaacaaagtagctttattagcggctaaatttcaccaacatcacaatcgcaattagcacagtttaaaccttccttttctttccactgtttatggcaaattatacttttgtgaaacccaatttataccaaatatgtaaatgtaaaaatagtaggaatgaactttctctttcattcgttatttcatccaacaaaacactgagtgtctattgtgtggcaggaacacaagctgttcaccaactcttactcaacagtcacactaacctgtgtgagaatagatgtaccacaaggcccccgtcaggagtgctccgatcacaaaggctgcaaacgcaatgcccatcacggttagggtgtccagaccatggaaaattgctataaaggagagaaaccgatacacacaactttttggttagtctgcatcatgcattgcaattttatatttgtttcacaagcactgtcataaaggttgagcactaataaaatcggagaatgcaatgaagattccaataaaatacactgtattttgtaacttgcaaatttttttcaaaggttaaatgaaattatcaggtttccaaagtattctcagtttgcaatttattttgatcaacaaactaactaaaaaatcagatttgcaaactcagtaaaatcttgtctgtcatctcattgtctcactctaaggacctactatttgaatggagggtagcttgaaaattcacaggttaagatgctttggaaaataaagtgaacttccatgatcaaaatctggcttactgctgcttattcactgaacatctccaaaaatgacacactgcacagaaaacacacaccttagaatactttatacacatatttttgtgaacatttacaagtatgaaagataacagaaagaaaggagaatatagaataaaaataaactattcctgtggattataacatttcaccgatctcctcatattaaactcttaatcttaacagcttcatattgtatcatttaaaacaacctactttttaacacttttccaaccatgatctttctataaggggaacggaaatacttcccagtggggagtgatgtcagttttatggtcagcaaaacatataaatagaaccaattgtttctccatttggcaaaggtttttatatttgaaattaattccaggccccagaaatagaacatttcctttcatttaagagaactaccttctttgagtcacttataaaaagttaaaattggtttccaagggggaggagttttaggtagaatacaatttctaaggtctctgggttttgaatataagtgggaaatacaggatctccccactattatcatattatttctactttctgctccagtcagaagcaactccagtgatctctgtataaattaaatccctgcctttcaactcacttcagtgtaaagaaagctattttttttttacattgaagactgccatacactcctgtgacctttgggcagcccagcactccaaaggctcggggaaagtatgctgtggtggaacaagtctggaaggatccgaactcccaagttctggtccccactcttctagacctgtgctctttggtgtgttcatttaccttctgaaaaatgcggatagctttagtcacctgctgaagtcaggtggaggaagaggtgggaagagctccctggaggtgaagttgaaccgagccatcaacctatttaatctagtccttaaaactgatattagaagatgatttgcctttttatacccacagatgcaaaaattgaacatgattacaagtttttaatgaaactattctaaatctccaaagatagatatgtgtccatatgtgcctctgtttgagttcatattgttccataatttaaaaaaaataatccacttaagacaatggtttatgaagtgctttgtgaaaggaactttccagactgattgttaaatgtagtgaatcagccacggagactaatcctgggaatcttaggaaaggaaaaaaagcacagattcacaaattctcctcacaagacaacattatctagaagagctctgggtggacagctgggaagtccaggttgaagtcctgcctcaatgccaatgaggcaggaatatttctgggtcagcattttcttctgcataaaataatgaaattggcctagacaatttccaagtccttattctgcagcaattggtgttgctttctctttcattcttacatgctcttcctggggcccccagcccttgcactacggattgtcttgaaagtatagcaatgagttcccttagcattacgcctctgagcagataaatattgttgataagacttaaagcaaaccacttccatggctgtatgtgaattcttgcaggttagagcagacataagcatgcaagtcattaacttgtctctctaaataagttactaccttcccattcaagccatacatgccaatggatcaacaaattaatattttaaagtggtaaaggtgaaagggaaaaagaaagcagggataaacaaaggacagaggaaaggaaaaaatatgagcaaaaaggggaaaggggaagggggaagggggaatgagagcagaagtctccttatcaaaactcaaagtttggcaaatgttcactaaccaactcattcttaggaaagcccaggaggttttatttcgaaatagttgcataaagacttacgtggagaaattggatttggttccttcatgcttggacctttttctgaaacaaaaacataaatcacaatgtattctatggagaaccaagatttaagcaaagggtcatcaaagtctcagcagaaactgacacttttccatttggtaataaatactgtgagaaagctctgtcaatgatcctctttagatatcaaaactataatgagttacccagaaattttaagcattgcattttgttgacaatcagttgcataggctctccaatttgaagaaaatttgaaggcaaacacctaaacttagggaatttgggtccgacaatttgtgtgtgtgtttgtgtatatctttttatttacttacaaaaaaattcaatacctttaagtaccatgcttttccagtgtagtctaatattattctgctttcaaaatattctttttttttttttttttttgagggtctcactttgttgctcaggctggagggcagtggcgccctcagctcactgcagcctccgcctcccaggcaatccttccattttagcctcccgagtagctggaactacaagcatgtgccaccacaccagctaatttttatatttcttgtaaagacaggatttcaccacattgccctggctggtctctaactcatgggctcaagcaatccatccatctgcctcgacctcccaaaggccgagggactataggcgcgagccactgcgcccagccttcaaaatattcttttaatttaatatacacattttctaaaagtatctttgttctcctagccttagtgctattatcctatagtttaactccccttcattgctcatcaggattatcacagaggcccccttatctccaccactaccctccccccaattatttcctcctccacatttgcccccagagtgaatattctagagcccagagctgatcatgttataaccctgactaaaccccttgatgactctccttcctttatagggaaaaaaatccacactctttaacatggcacacaaagttctccctcccttctctatcctctctctccagcctcctttcctgatggagtccttcacccatggtgggctccccatacttagtaatttaagcttcccaaattctctatgctgctctttgtcatcatgctttgcaagccatcccaagacaccctcctccccagacctgctttgttggcattttctctgggggacctttgctgagtctcccactgttccatctccatcccagcagagctagtctctcccacccttgctcattccatccctcctctgttacacttgggccacaatacctcctagttctctctctctttttctctttcttttgctttttttttttttttttttttttgctgtgagggcaaggtctagttctcagtcatctgtatatccccaagggctcagactggcatagaataggtcttccagaaatgtttggtgaaggatgattaaaatgttaatgtactttttgcaaatggaggccacagaggaaaccagcaatcagactatgaagacgttcatatgcagtttgcaccagtgccatgaagaaggcagaaaaaaattttgtatcactgttttggaaatgagcagcctgagactctgatatcgtgtgactagagcccaaggtcacagctggaaagcatcagggcagaagttgaatcagaattccagagttctgcctagcaggctaaatgactggtgagcgtagctctgtccctagctggggaagcactgatgaagtaactatttgtgcacagctactcattatcctcagcagtgaggctgagaccagcggttgagatattatggtccaccacctatttttgtatggcccatgagctaagaatgaattttatattttgaaatgattttttaaaaatcaaaaaaggatatttcatgacgtgaaaattatatgaaattcaaattgactccataaatgaagttttatatggatgcagctatgcttatttacatactgtctatggctgctttcatgctgtaacagcagcgttgagttgttgagacagggattgtatgagccacaaataaaaaataatcactatctggtcccttacagaaaaagtgtgctgagtcctgctacagaccttgaccctactctttggagtttaaaagtgatacatgtttagcacctctcttttcatctccattttcattcaccacagaaggaacacacaccttatgtctgaattcacagggaagcaaaaagaacttgggaaaatgtgacccaaacaagcagcatctgaattgatgtctataaaaataaagaagctagacaggataaaagaaaacagaattgtaaattctcaggattaaccatctccgatgggtgggtcaacattctggccacatgagttatcaatgtctggctctaggggaaggaatgctactggatgaatcagagccaccacaattgaatggtgccccctggagttgtgcaacatagtggccctggaatgaggatatatgcaaaagtatacttaaatacaattactaagaaaataaaaatgattgtatgtttttaagaaaatctaattcagtatgcagaacacacactaattacgctaactacagaatgcactaccctgggagctgggtcccatcagcctcattggcaccaataacaacaatgatgccttacatttgtacatttgtatggtgttttgcaatagacaaaaagccttcggccttcacttatattgtctcattttaaactcccaagaactctatgaaggaagagtatctacccacaaacttctcctttcaagacgtagtatttgattccctgaactaagttcaaaggcatttaaaggttgctacaagatgcatcatgtaagaaatatacacacttctgggaataattccatccaatcaaccacccatggttaaactttctcactcagaatccccaagcggttgaaaaattatgactctctcctaaggagacctcccatgtaagagtttaagttttatagtaaggcctgtgtgatggatggcattgttttaaaattcttaatggatttctgttatgatctaatcctttacccccaccccaaataggagccttctcacagagctaaacagaaacagttgttgttcatttcccctgggtgaagtctcttcgtgatttctgagcacaaacaataacaagcagaagctgcagaactgaggttaaagaattctatcctcgaacttttctcttcccgaatccctaagaacccctgagtataactaaaatggcttgatctccaccggaaccctaccatcgagttggcatgctgagaggaaaagagtggactcaacaatatttacttttggtttaaggataagattaagattataagaaaggaatcttagctattgctgtaaagagaactgtaacaataaagatttctttacagaaaggacaaactataatcaatgttctgaattaaatcttttcatatacgctgagcaaattttggtctacctctagaaccaaaattcccctcttcagattgttcagcatggttttcataaacgggatatttctggggttatgcatgagtaactgaccacagcttttggcctttagtgctcaatttggtactaggcaccataggacggagtgggcccacagtgaaacaagacgtccaactggtacccacatctattggcatttggcaaagagaagaatggggagaggaagattcctcctggagactcaggaggtctttgtgcaggccccatttaagacagagtttttactaacttaacgtcactgtaactgaaccctttttctggattctttcaatatttatgatattcattgcaattacttgttcacttatctgtatcctgccactagaccagtgtgtctcacgtggtgggtgatttttattccaggggacatttggaaacgtctagagacattttgaatggttacaactgggctggtggtgggagggtgttgctactagcatgtagtgggtagagaccagggacactgcttaacatcctgtaacacacaggcagccccccaactacaaagggtattccagcccaaacactgattgtactgagattgagaaactttgcactaggctgtaaaggccttaaagacaagataatttgtccactatacacctaccatatttttttgaataaataaccacaaatatcacgtatattttattcttgagtactttccccagcaatgcaaccttcacaccattttcagagtagccttcctaaatgacctaatcgccgggcgcggtggctcacacctgtaatcccagcactttgggaggccgagacgggcggatcacaaggtcaggagatcaagaccatcctggctaacactgtgaaaccccgtctctactaaaaatacaaaaaataaaataaaataaaataaaaataaatgacctaatcatcagtttcctgcttgagatcttctgatggttcttaacttttagaggtacatactggaatatgtatggatgaaattaaattaaatgtctgggtttccttcaaaacaatccagtggatgacagaaagtgataaaacaagattcaccataaattggcaattgttgagacttattctatttttgtatatatttgaaatttttcaaaataaaaaggttttaaaatgtaaaatactggccgggagcggtggctcaggcctgtaatcccagcactttgggaagccgatgcaggcagatcacctgaggtcaggagtttgagacaagcctggccaacatggtgaaaccctgtatctattaaaaatacaaaaattagctgggcgtggtggcaggcacctataatcccagctacttaggaggctgaggcaggagaatcacttgaacccaggaggcggaggttgcagtgagccgagattgcgccactgcactccagcctgggtgacagaatgaaactccttctcaaaattaaataaataaataatgtaaaatacacgatgttaaaaaaaaaaatatgatatccctccttcccttcttggatagagaatgaatgccctggtctgtcaattaagcatttctaccatctttccactcagtttcccctcacctcgacctcagctcgaggacaaaacctggctggtcctttagagtatttttattctggaaagatcaaatgtgttccaaaaagtaatgcctctcttggatcaacttccaactgacgttcacaactttcccttcctcaaccctcccttcccaaaaaacctctagtttgctgagaggttgagaggaaggggaggaaattaacatttactgagtatccaagatatgcaggcatttttattttttaaagttaggtggtgaaaatacggagaaaattcagtatctcaaacatttaacttgctaagaattaaacacatctataggtatgtaaatcacggcaaattttggaatgatatttattgctcctgatgacatccacatccatgctcttctgtgtatgtgcactgtttcagagaaatggttactcctctctttcacaatttaaaaaaaatcatcaccgacgtggtgtaatcatttttactgtataagcccaagtgttctcaaatgctgtaaaaagcggtcacagaatccaaggcaaacagcactaatatgcctatacttcaaaatttcagaaaatagggtaggatggcaccacctcaactattttaaatgttttgtcataaaccataatatgcataaactatttatgttctctgggctttctgagttactactgaaaatcacagaacttctcctgaactttaatactctgctaaacaggttacacatttcccaacatcttaatcctttgggtgaacagacatttttcctaaaatccttcatcttccttttagttcataatcattagggtatttggggtgttaccttgaatactaatgtgatatggtatgaaaagggagaagagggccaggtgcagtggctcatgcctataatcccagcactttgggaggccgaggtggatggatcatctcaggtcaggagttcaagaccagcctgtgcaacatggtgaaaccccatctctactaaaaatacaagaattagctgggtgtggtggcaggtgcctgtaatcctagctactcgggaggctgaggcaggagaagcgcttgaacccaggaggtggaggttgcagtgagccgagattgcgccactgcactccagtctgggtgacagagtgagactttgtctcaaaaaaaaaaaaaaaagaaagaaagaaagaaagaaaagggagaagtggggcaggaagaggggtgtgaagacatagatgcacatgattctagttttcagtaaaaactagaatcaacctccatctggaataaggcatagggtttaagagcacaggctctggaatcacagtgcctgaatttgaatcccagatccaccatttatatgttgtgtgcccttggccaagttatcactatacagaggtgctatgaggataaaatataataatccacataaagcatttagcacagagccttgcacaaagtaaatgctcaacaaatgttagatcatcatcctcatctccatcactatcatcaccatcagctttaaactttcatctattgttaaaaatttaaatggtaaaagaacgctaacccaacactgattcccaagggacttagagatcaaaagtggcaaagatgtgctcaggaaggttccattaaaaacagtggcccagaggaggaatccagaaacatttttatagtcttgattgcctactttcctgtccacagaagaaacactaaagtatgtcaatgctattggcagtggtggccacagagcagctctctgcccagctgtgaagttgccaaccagagcctttatctgctgtcccagaaaatccaagtgttgaaaaataagatgaaccaaatgaccagagagagctggagttttggcatggccttcaaagagcacctgtgtagtaaaagcacagtgaagcgtcccattggttaggaaatttttacccaaaaagtcacagattctacaataaagagacataaagctgtctgacaggaaggacattcgtgacctgttattattcaaataaaccaatgcaattaggcaaatggtcacagtctcttttctttttttttttttttttgagacagagttttgctctgtcccccaggctggagtacagtggcgcgatcttggctcactgcaacctctgcttcccaggtttaggcaattctctgcctcagcctaaagagtagctgggattacaggcgtgtgccatgacgcctggctaatttttttggttttttttttaggtagagacagggtttcaccatgttggccaggctggtcttgaactcctgaccttgtgatccactcgcctcggcctcccaaagtgctgggattacaggcgtgagccactgcgcccagcccacagtctcttttcaaatgactattccaattcaccttgaggcagaaagcacagactccagtggtctgcattgaggataaatgatttagagtcaaaagaaaataaacttaaaaggtgagaggagtcacacacagctgaaacctgccagaaaacttaccccagtaagcgcaaagttagaaagcaaatttgcatacagcccctgggaagctggcctacagtttaaccgcctcaatttatttaacaaacctaagtaataaactttcttcacccacatgcttctcaactaaaatctagtctcaattagcaaatctcataaaattgctttgatatttggtaaaactttcctcttgaacttttatacaagaaaacattgaactttcagtacaattatactaagtttaaataaaagtaattacctaatttgcaagagaaattacttagaaaaatgtcaccaggctcaaaagaagaatggatgaattgctggaagttatactgcggcaatattaatgcctaattattgtctggcatgggaaaaagcaagccgctgccttcaattactagcagaattacctctctcaaaatagttacgagtaacagatggaatccgaggtagctgctcttattgttaaattatcagagacatttgaaccagagcaactctaccttgaatagggctgggtaaaatgaggccgaggcctattgtgctgcattcccaggagtttaggcattctcagtcacaggatgggagagaaggtcacaagatacaggtcataaagaccccgctgataaagcaggatgcagtaaagaagccagccgaaactggccaaaaaccaccaaaaccaagatggcaatgacagtgacctctggttgtcctcactgctcattatacactaagtataatacattagcatgctaaaagacactctcaccagcaccatgacagttgacaaatgtcatagcaaagcctagaggttaccctatatggtctaaaaaggggaggaaccctagttccgggaattgcctgcccctttctaggacagctcatgaattacccaccccttgtttagcatatgatcaacaaataaccataaaaatagcaaccagcagcctctggggctgctctgtctatggagtagccattcttttgtttctttacgtctctaataaacttgctttcactttactctgtggactcatccccaaattctttcttgggtgaaatctaagaaccctctattggggtctgaattgggactcctttctggtaacaaaatcactttcatagtacaaaatggagccagctgctgcccaattgtgattactctgcaacacaatttatattcttatttctttctcctgaacccaataaaaaggaactatttggaccatccatttatataaagactgggtctattataactttcaaatggttgaaaaccaatcaataaaagtaaaacaaacaacaacaaaaatgttgccgagaacatctcatgtacacttcacaacaactttaggacggccagaaaaatgaattaaagattattttgcttcttcaaacagcatagttgagtattacaactgaaaggaccttttggaagtcacccagtccaaacctctcctttccagatagagaaaatgaaacccaaagagctggtggtaggggggttctccaatgtcccacagccagttagcagagaaagctaaaagcagtgccttaggctcccagctccaatccagtgtgcctgccacctatactcttctgccattttgagggagcacattcattcataggaagggggcagatgccaccaccagatacacaattggaatggcacagctgttttcacagaggttagtcaaccaataagacactagacagtacctgcatgcctctgttctggtaggttctgcccactgtccaggggtcacccctgctgcctagtcttgccaaatcccaatccaacatgctcagatcaggaatgccatcccagggccacaccaaaccctagatctggtgtcagcaccacccagcaggccttccagctaataccctgaaactggagccagacagtgtgctggcttttgtcaaggcccttggtgcccaggctcctctgtgcccctcagagtggcgagaggcagcctgtagctctaatcctgaaatatctaaccccgcttggaatccactttcactctcccagccttctctcagtttgacacccttagatatcaatgttactagatggtgacaactgtaattgcctagatatcccatgtgacatttggttccacccctcagatgctgacagctgcctggtgtgtccttgcttgtttataacccttggagctgtgatgcgggtccttgtcagatgctcttctcaccgcccacagggcctcatatccactcctaacatttgttagggcccagttctgcctctctactgctctggctggccagacccatgccaggtctggctctgccctgcctgtcctctcaggtactgatgccacaccccttagggcacagccttccttttctcacagaagatacagcttgctgaatgttcctgcttgtggagaaagaggcatgcttggctccaagcaacaaatgtgattgtgcaaaattctgaaaactgaattttaagatgcatttgggcagtggttctcatctgttacacctaagatgaataatgttcacatattctcaaaggcatttgcaattttgataaagcaatacaataggttatagccagcataaactttagcagtagatcacagaaagatgaactgtggattgtgtgcaattcccgggacatgggactaactagaacccttttttgcatactcaaggaagcatatttgaatgcaagggagagtgaccttatgacaggaacaacctagacctgattctttttacagaggaaatcattttcaaatagattacttacaactaagccataatggctgtaagagaaccagctaaagaaaagactcttcgggcaaaaaatggtcttctaaagtaactaactggccctttagttatcttgtgaataaagctggactttgatttacactattgggtcttcttaacaagcagagctcaggccccatgctctgatcgtgcctcccaaagcacacctttagattctgcttcatggtggatcacagcaaggggcttagtgaacgtcttcttattctgcatcatggcccagattatcgaggcgtccagcgaggtgcaggcttcgtcaggaggcacacactgcagacaggcagaacaaagcacagaatcaggggccactcaaaagtgccttcaccagctctacctgcacagctgtcctgtggccttttatcagacagcacacagctgttcactacagaaaagcaagaaggtgggtgtttttcagagaacaccaaataacctgggagatatgacagcaggcccagtggatttttggttgtacctgaagatgcaaatatcactggatagcttctcaatattgtcctccccctccccttcttctcacaaaactaaacattttagtgttagtttgaaaaacagaaaaactatatgcctagtgttggtcctcaccaagctgggcttcatatacacggttcatgtttgtgattggtgattgtgggaaatttcccataaagacgctcctcaacttatgatgaggttacatcttgacaaacccactgtaaactgaaaatatcactaagttgaaaatgtgtttaatacacctaaagtaccgaacaacacagcttagtccagcctactttaaacatgctcagaacacttacgttaacctacagctggaaaaatcatgtaacacaaagcttatttcataacaaagtgttgaatagctcacataatttattgaatacttagattgaaaaacagaatggttgtatggggactgtctatactgcattatgaaggtgacagattttacatttttctccaataagataatcatgttgctgagtttgtttcatttttaatcctggtataggctcatgtaaaactaaactttccagggtcatctgcttttaatgtttcaaaatgcagatcctgggggctgtgcccaggttgtggaggccatgagattagccgcttcaaacctattaatgagcatgctcaggcccactacatctgttttgaaaaaatatgatcacactccgcactttttctttaaaataactttgttttcttgtctatatttatcaataggtatagttcttttttatttttcttgagacagggtcttgctgtgttacccaggctggagtacagtggtacaatcatggctcactgcagccttggcctcatgggctcaagtcatactcctgcctcagcctccccagtagctgggactacaggtgtgcaccactacacccagctaatatatatatagtagtgacaggggtctcactatgctgaccaggctggtctcgaactcccagcaagctgccaagctcagcctcccaaagtgctaggatgacaggcatgagcccacgcccagcctaataggtataactctaaagtaaatgacagcttctatggtaagaagacatattaatacagccatcattttaagtctatagcaggcatcccaaaaagctaatcaagttccatcttttccaaacacaaaagagcaaagactttaggccttgctgtcattgctgctctgagcaacatgccagtcagacacttcttataagacaaccctcactgccctactcttaccccctcaaaaagagaaaagcctttaacaagagccctcttgtaaagaaaaacaacaaattttctgtggagaggcatgatgactgaaaagagttgcattttgctttcctgttttagtttactgttactttcctattgagctcttcagttaagcaagagtctatgattccgcatttaactcagtggagtgtgaccctgggcaagacactctgctctccgggtctcggtttcatcagcaaagggcagggttggtctcaacaatctctgagatctcttcctagaagattctttggcgctctctattgtcacagaaagcactcagaaaataatagaaatgtgaaaatattacctataagcagcaaacagaaagacagtggtaacagctcatccaagcctctgccagataaagggctgtcattgtacatactgtcctatttgctcctctacccaggagggaagccaggtatgattataacagtatatgaggaaatacaggctctaaggggtccagagactggcttaaagtcccattggtggcagcagagcttccttctcagtcccaggctctttccatgttatcttaccttgggggtaaagggcgacttgaggtttagggttatatcccatcatgtcatcccctgaggcttagaactctctttacgattaattttcccagattaacacacatgaagctgggctgttccaggccaggtcagagagaagtaacagccaaagccacagcaaagatccctggtaactgctaggtctcccctccaagacctctaacccttaaacgttacccttctgcccacaggaagcagctggtcccacagccacacatgaagctcctcatggctctctaccactgtccactaagccccaaccctgatggtgaatgcctacaaggctaaggcatcaccgccgcaaaagcaaacctaggaatatagtctaaatcactgtatatgtgctccccaatgattatgatcatatctgctctattttcgtatgcaaacaaaattctcttgggtgttatcagagaaaaggatgcccaggggactataatgatgcaaggaattcagatcaattgtaatctatttggaaatggtggtttttcctcctacctccatacctaagacttaaaatctgtgagttaaatgagaaaattccatacatacattattaataacactgcttgattcttagccttttagacattgatatatgactgcgaaaggactggaaatcagtttactctgtgtgagatagccacagaataaatgcacatatgaaattatacataattatggcagatcacagaaacaaaactatggcagaagatacctttcatatacaagaccaacctagtgggtatcatagttaaccttgcagatctcccctatcaaatgcattccaccaaggtcaaatggttctgctttttgttatggcaatagaacattcaatctggagagtgacaggaggcaaatatgatgaactgatatgaaactgagaaaagctaaaatatttgttagtttcccctagaagtctccctgagacaagtcaaccttatatttcacacagaaaaggttaaaaaacaatgacaatgccagtcccagcaggacctggaaaaattaattctcacaatgaacttgtcctttcggcttgctgtgtttttggcctgcaaactatctgaaaagcaaagataaagccagaaatctccctccatggaaaagcgtcttgatttatcactcgtaaggtactactaagtagcacgcatggaaaaaagaaactcatgctgtcaggatttattatctaagactccataaaactcacagttccctgctaatagtgactttaatatttcagttgggcagttccaaaacaaaaaacctcaacctgcaagaccttgggattaaacttttctgcctcacctaaaaatgccaaaataaccatccgaatggatgaaggcccacaaaccttaggcaacttctgggggtgcttctccatcttcgtacacagcgtcagctcacactgtagaaagagcagtgaggtgttgaagacaggcttgaagacaaagctgaatcgcttcttatccatgtcagcttgcgggataggaaagtgcactctcttgggactgtagaatttcacagattcatctttaggacaaatattctcaataatggtgtaatgagacatcctatcagggttcgaatatggagagataaagcacgtttggatggcaaatcccagttcttgttcagccttagtaacagatacctatgaaagaacagaaagatgaattaggaaatgagttagcatctcactttcactttaggcacaaggaccatatgccaagacagcccttcagatgacacgctgctttatcttcataacatagttatagccttctttctaattacaaaagtaacacacacacattgaaagaaaaagatattttccacttcaatttgatatagatgatgacagtgaattatttctttcaaatattagtccattagattcaaatacaagatgagtaagtctcttccacctcccaatgagtcctctgagagctaaaaataaaaacatattttgcatttaaagtggattttccgaagtaaataaaacaccagtaggcaaagtccctaatgttttaatagtacaacacttataagctaagctctttttaaagactgaccaaaaaatagagttcagcggcaaaatctatttaacctaggcaggaagactgagcttctaaattgcaaaaagtcagagtaagcctgatgagagtcctgcttcatcggcgagaaggcagagctggctccggcgctgggtgtcagtgacggtgcaacctggaggccatcatgggcctggtaaagtgtcccagctgctcacagatccaaatcagccttgccaagtactcccccttcgctccataagcccaggggtagtttaggggaaatctaatctggaaacgtttccgactcatttatacttccccctttgaaaacacttgtatgggctacgtccaaattttgttaaggttcttttccttagaaacaggaagtaatgtttagccaagtgtaaacagaattcaaacctcaactatcctgaacttagctaaaatccccagaccagaggagattctccatttggtgacacgtggatcactgcatgaactgcccctccctgctatgcctcattctttgactaaatttaggatcaaaataaacttaaacacttgtagaaacagctagtccttacccatagaccaacagccgcagaatcatttcaaaagacatggagatagaaacagactttccacgctgagatacccaggggaaacccctgacatcacatggggctttgaatccgcagcactgttgtgaaagattcctacgtggtggttaactgcaggacactcaacagtgaaaatgctaatgaagaggattctgataatgtcactgtggtgacattctgtaaatactaacacttcagtatttttgcaatacttctgaaaaacaagatattctatcttggaaaggtggcaaattacatatgtgctattactaaaaactgccgtttaacatgaactcagaaaccacatgccaaaatgtgtaacagagggactgcaaatctcttctctaatctcaaaagaaagtatgtagcggcagaatgtctaaggtatcccaaaaagggatacctttgtagcagagggaaaaaatatatattattttttaatatattttatgtatatatagtttatatatataaattatcagcaaatcttttactaaaaaggattttacttttagaccagaagtgagtaggagaaggactacgggctttgtagtgagacgagctcataaaaattacatgctctcctgctcacgtgctgggcaccgagactcagtttactcacctacagaatgagaacacgaatacccacaagatatcataattgtgaaaactagcaaagtaaaagttacatgcaaacaacacagttcccagagtgtcaataaatgctacctattagtaatagtagtattctagatttaaaattttgggttattaacaactgggtttgtaaattccccaagacaaatgaaccaaaagaaaactgccattatgtgaccaacagtcacctggagatgaccaatgaacaggtggcaacactgttaacttggattatgaaagggactgtatggtgtagagggaatagaggataaactatgagaaatataggtgatatatgaaaaggtataaatgggaaaacaagaatggaaaaaaaaaactaccaataacacacttcaagtaagccagcatttgaaggatgggggaaaaaacccaaaatatccagggtaaggtacaggaggaagattgaccactgattagcataaatcagcaaagccaggcatagatttggaaaagaacaatctgcaattatgcagcacccctgaaatccacagcgcaatagggtgctgttgaccaactgcccatgtgaactgtacagccagaaaagcaagagaaaaacagccatcttggcttaggaaaagcatgtagaaggcagtatattttccccaatggagaaagaaggtgtgctcaaagaaagagaactctcagaatgggggaggggcagaatccatatgatcaaggaaaacaacatctagcgccagcgggctctgtcccagagtcagtgcgaatgtgagagttatgtgtctttccaaaacagaaacacgtgcaccaaagtcacttttaacatatggaagtaccccactttgaccctttaagcttctcacccctcccactatgaagctgagcttgcagctgagcaccaaaaccagctcattagatgaggaccttcccataagaccaacagatgatatgcccacttgaaacactaaggttgaaacatgaaaggttgtacccagggcacaagaaacagcagacatcctggtgccataaggacatttatcttttctagaatccactctctgaacctggatgtttgcattgataagacgttatgttttctcccctttcaaatggcactttggagataagtgatagtcgtatccagcgaagatcagtcagagctctggagtcacacggcctatgagcactgaatctgaactccactagtaccagctgtgtggcctcagacaaatttgtgcctcaattttctcatccataaaatgaagatattattagcctcccttataggatggctctaaagagttaactaactgctgcaatacttacaactctgtttggcacataataaatctgcagcaaatgttagatgttgttatttcattattaccgccactgcctaatattgtgtagtcactccagattccagatttaggttgcacatgattattaacattatatataggaaatagtttaaataagtttatacagatactcagatcatgatctagaaaaaaaaatgtcatgagttataatagcacatagcatttcacttaaaagtgagtgcaatttaaaagataacaagtcagtttcagtggcggcatggacccacagggatttggctgccctgctgggggctaaggggactgtgcagggaaaaaaaaagaaataaaagataacatatgaggtggttttgaaatattccatggttaactctaacactgcaactactgaactactgttccaaaagcaaaggacagggctttaccagtagaattcacacttgccaatttttttttttgttaacattcatctacaaaatactgtcttcacttagcataatgtattaaatcttgaaatttcctgctttggtcagaagtcagtctggaagcgttctctgagccaatccctcatcagacctgttgaaggtctgtgaggtaggacaggaagaggtctgtacagggtattttagctgatgtctaaggaactatagcccagcactaacctaaaaggtcaaggctaactttcaggtctcacctcaacataaacgtgtccattctctggcacagagaagacgccctgggagggcaccaaaaagaggtcagtgttgtatagctccatgttgaaggtgatgtttccgtggggctgttcctggaagctgctggggttcctcacctgctgaaggctgcaattaaactggaaataacaacccacaggaagattaatgacagtcatatgaaggatgaaggccctgtagcttcatgagctttggcttttaacatctgattttattttcagatagtccctaactaaagccaacaaaatagacagcattttccacaaaccccctactgataacaaacacataccaccacgatttcaggtcgggtgaacagggaagcatctccttcatccatatctcccggaaatccattatcacctgactccagatcttcataaccatctggccaaccactactgtccccaagggctggaacctgtatcacaatctaaaaggcaaagaaagcacagccaatgttataaaaacaccaaaccatgtgtgtttggttctgcctcacacaaacactcatgtaatcattctgatgcaaattgaaaatctgactttaagacaaaataataaaataacatccaggctttttcgaattatatcttcaaagtgatgaagaataaggagaaacccaatgcaggttcaagttaaaagctaaactaatatttgtatcttctcttgtgaaaaataaatatttatgttgtaaccatattgaataattacaaatgatttcaaatggtgggaaaacactagatactagaatggagttgaatggagttgtcaagagacttgcctataccgtgagaaggggcttccccttaagagtctttatattataaactctaagaactactagcagttggcgaatacaagaagctttggttatatatatcctttaagagttgtagaaagtttggttggagtcagcagcgaaggacctaatgtttggttatatatatcctttaagagttgtagaaagtttggttggagtcagcagcgaaggacctaatgtttactatggagcacatctcttcattgccgctcttgtacccctctaacttttgctcatttcttccctaagaaatctttctctatggtgtatggatgtggaaaagaatacgttttattccaggaatcttttttttccacctttttcgctatccacctgcagatatattcccggaatctatcttgacataggttgaaattatgattcctggattatttctaaataggatgagaaaattcacccaagggtcatgacgccataaatgaaatcctaatttcttttgcttcacatgcttggattctgaacatgatgcaaaatagaaatatatagtaagtctgaaaattactacaaacaattataattggtgagaacagctaaaacagtctccaaagggagtaggatgggaagaaaattaaaaaaaaaaaacaaactgcctttctctctgtaccaggtcctccaaagaaagtactgacgccaattaaaggaagcatctaggatattgctaaactcaaagatcataataaagaaaagaaaaatatgtgagaaaaaaaggaactttaagggatcattacatgcctttctctcctgaagcaactgacttttttttttttttattttttcttaacagacatattactgtagccacttttggtgttaacttggaccccagttttaaaatgccataatcaagtatttcagtaatatatgacattcattatatctgtagacactggataactgaacgaaaattcatgctgcaattatcaggaggtcaaaggttaataaattaattatttgagtaacaaaaggagattagcagggcctagcctggtgtctaggaaagattagtggacaagaggtcaggaagttggattcagtcgtcctggctctgccattagcccatccctggagtttaaaaaagcaagtctttttaacttcttggagttcagtttcctcacctgtgaaatgaagaagctgaataagctcatcttagggttatttgctgctccaacagtctaatattctctgaggaacaatatgcttgggttcatgggagagtcacttcccacaggaaccacgctgaccagagcacctgattgctagcctctcttctctggatggggtcgaactagcagccacagctcagccaccccatgtcaaagctggatatggcactaagaagacaccccccctcccaccccaacccaccctgtgtcaaaggtggacacagggatctctgagccttatttttaccattaaaagtaaaacccaaaatgcaaaatcagcactttaaagttcttttggaacttcacattttaaattcttttaatattcactgcctagtctctgcacccaagagaatgggtttaatctgaaaagattttgaccaactgagaagaaagatttctggaaaatgcagcttagctattgcaacggtttatcattgggggaaatctgtggaatctttctccaagtaacttcaaaagtaggagagtttcttcaatgtatggtctttcttagaggtggagagagacttaataattccttaaaggtcctttttgagttttaaattctctttttggatttttattcatgaaggagggagaagttctcctacttctggacgagactcaaatgaggccagagagaccacacatctggttaacccggctgtgcagaggtgctgctcgttcatatagcccagggccttaaaattttatccttataagggccagttgagcttgggcactgagagaagtcataatcaccttgacagtgcagcctttgtcatcaggagacggaaacggggggtgagaaaacaggccttccaattcccaaagactcaccaataaaacaaataaaaccaaagagctcagggtcaaagtacatccattttgttgagaactgacacttggctttcttcaggcctggggtgaaaaccctcttcatcttcaaagaaatgttaagactaactttaagggagcacacagccaggctctggcaaagggcaaagctttgttctggaaaacactcacggagttatagtagaccacaccatcaagggctgaccaccggggccgagtaccgcagccattcagaggagactccaaaacaaagtgtgtgccattcatcttggccttgcaggtaggatccaacagggtgacgtccatccccgagtagccactggcctaaaacaacaaccaccaaagacatggttggaggcccacaggcagttctgttgtataattgacacaattgacaattgcctggtcttccaaggacaggcgatgagaggcctgcatcgtgccccttccccaagtatctcttcccagctgcccacctctcaacagctcaagggtagtatctgttggccttggaaattcaatagcaaaatattgacacacaaggatctggaacccccaccccctgtcactgagaacaacaggaaccaggtgagaatcacagccaaggggaagtaggcccatccaactgagaaaacagtatcaagcctccggagttcaaaaatgaaagagatagggagaaattacagatgcagactagggccagatgggaaaggaggtagcctctcttccctcctgtaatcagctgcaccgacctgaaaagaatctttttctacagccacgatcatcttctcattgtcacatttgacagacagggcaatatccacgctcccttgcacctcttctggctctctgagaccaggaaacagttgtatgctgggaatgacagggtcctttggccgagggagcccatcttctccctcttcattccagactctcctggaaatatctgggaaaggaaacggaaggcctccattttggccttcccctccccggatgggcgggttctgcagggcaggcagggcaccagggtccagcaggatccgtagctcaggaggaatagtgtggacttcctcatctcccatctcctctgctggtgaaagaagaaggcaaaacatcagcagtgtttgatgccaggccacaaccaacatcattacaggcagaacaggaggaattagcatagaatgggcaggtgtaaaatgacttttaataagcagtgcataaaggtcattagaagtctagaagcctgaattctagtcctggtgttctctctaactagctcagtggctttaggcaagcggcttgcttctctgtgcctcaaatttgcttttccaattttttaaattaagtggttggaaatgatcagtggttcttaactttggctacacatgaaaatcacttgggagctttaaaaaatattcctacgcccaggttgtaccccaaacaatttaaactcagactctctggggtggtacccaatcattaatatgttttagtctctccatgtgtaactgcaatgtgcacctaagactgagaaccaatggaacagacagtttctaaggctgtccaagctagaaaaatctgtgatttaagttacatgatgcaatattattccattgaaatgccactaaaatactttccttgaatcaagagagtcttttgaataatttctctaatgatgtcttgaaacaatattggtatgttaaaattacttcaccaccttctttttgacagctaaattttaacaggtatctgggcaccttggccttttggaacatattcccttgaaagataagaaatagctgcatagatacatttattccttcaaagggagagacgtatttccatacaatcaatactcaatattttgtcgtatttctaacaactaaaaaaataataatttccccagtattctttatatctactatctaaggccaactgatgtacacttgaggtcaaatccatctcagtggaagctggaagtgaagatgatagttggacattatctctcctttaataatattctttggaaaggacgctagagctgtaagggtccaaaataagtcatagctttgtagggtttttaatttgtactttcacgaaaaccttcacaacaaccctgtaaggtctgtcctattattttccccttattactgaagaaaaatctgtggctcagaggtgaagcaacttctccccaaacagtgactaaatggtagagctggggcttgaacctgtactcctaatccttattctattggcatttcactcagtggtggtaccatgagctgaggaacaggtctagggatcacaaaactagggtttcaagtcatgctagctagaagactccagaaaacctcaagaatttgttgaccctctgctttccaccccattcagctggggtagtaactcctgccatcctctgggtatgaacactcaagtatgagtcctcgtgactattttcctaaaagatacagccttttaccatgaacttctttcctgcagtcttaactcttctgtattctcagccataagtggtcattaggtgtctcggagagaagaacctaatgtaatcacactaaagataacctataacaaagttctctgaatatgcattcaactctatgtcactgaaaatctgtattacagtttcctcaaaatctctgtctaggtaattttaagccttctgataaaaagtagtcaaattattaaaatgtacaagagaaaaacagcaacatataagctgaaatgacagttcctcactggaaaagcttcatttggggggtattttttacataacttaaaaaacttctaacttaccattattttcaagccgaagatgaaatctattagccacaggagccattgtgtatgaagttattggactatagccattgtccaaagcccacttcaccagattcccttgggttgaaggaatgtcatctcttattgatttggtcattgtcatagatctttcactctcttttccaaagccaatactgttaggagcctgaagatatagcaaaaaaatcactcatgagtctaaaattaaacagtactttagataataaaaattaaatatcttaaataagtagattctatattgtatatgagggaattatttattcttttgacccctgttttccttgggctaagaacgatgatgtgaaaaacctttaatagccgactaaaagacatctacgtatgctgcttgatcatactatttgtattgcctatgctgataaaaaaaatcatccaatgacatgtaagtagttacatactaagtatgcctagtctataactgtacagttagtctaatgtttaaattattaacacacacagtacatatgtataataaactttcccttttttttacttaaaatgacatataaagtatacaaacagacatgttatattgccctcaaattcccatgcttccacttcctattcccctagatttcaatgaaagatagcacaatcacttacagccacttaacaatggagatatgtcctgagaaatgcatcattaggtgatttagtcattgtgtgagcatcatagagtgcacttacacaaacctacatggtagagcctactacacacctaggctatatggtacagcctactgctcctaggctacaaacctgcacagcatgttactgcactgaatactgtaggcagtagtaacatgatggtcagtatttgtgcatctaaacatagaaaaggtacagtaaaaatatggtattacaatctgataagaccactgtcgtatatgtggtccctcactgactgaaccatattatatgctcaagactgtacttcagtgtggagactatcccatctatataaactattaaattccacatggtaaaacaaccaatgtttatatttcatctaaaatgtatgatcaattagtaattctataactgtattcatttgccaattctactaactgaatatacttgtatcttctattctaaatattaattaattaatttaggttactctccccttaagtatcactgttttatccagtaatacaagtaggtcttaagattagctttcagggatgggtgcaatacttcacacctataatactagcatttggggaggctgaggcggaaggactgcttgagcccaagagtttgagacgagcttgggtaacacaggaagatcccatctctacaaaaattttaaaattagccaggcatggtggcatttgcctgcagtcccagctactcaggaggctgaggtgggaggatcacctgagcccgtgagttagaggttgcagtaagctatagtcatgccactgcactctagcctgggtgacagagggagaccctgccttaaaaaaaaaaaaaaaaaaaaaaaaaaaagactagctttcactggataatcaattacaaaattaaaatgacagaaatatttttgggaaaggatataaatggactctactcaaccaggttattcaacaaggacatggaaggtaaatttatacatcagttgctgactcctgtggcagtgctcttctcagagggtgagagagctaaatgctgcagaggggaccccaaagggaaggtaccatattttcaacaactgcaccaacagggctggaaagcccttccagcatgcagattacaccattttcgtgctgtataaaaatcactttaatttccatgcccagtgattttctcctgcatgcatgcagcatttttcctaaattcctcatttgtttcccattctgtttgcccctaacatgactaaatattaatcctttcccactgtaaaaccctaaaagattcacaggctctaagttctcttggcctatgtggttgtgggatattggctgaagccacatatatttcaactcaaatcttaaaggatctcattcagtatatttttctattacctaaagtgcttatgtgtgggaatactgccagactcaccagtcacaaattctatatgcaaaggaaccagacagaactttaaccaacttctgcggccatttgtaaactcagtttaatagattcagaatattttagctcttactccaattcagaaaaaaactccttagggtaaagaagggctagggaggaaagaaacaaagaggaaggaaggaaggaaagagctaaaatgagatcatgaaagatccaatttattcttagaactttttatgcattcagtcaacagtagtttcttaggtacagcttcttccagccttttagagctacatgtcattttgattggctggaatcacaacaattggcctaaacaacactgcttgccctcatctgccctagtctctttcatgttgttggacagctgagaaaatatcgtatttccagaacactatcatcataactgccacctgtccttttgcaccaatgtggaatgagctgtttgcacctttccagattaaatctaggagctgtcaatacatctcattttgattatgtctgggaacttaaaagactcaacatctatctacacatttgtaaagcagcaaggcttgggacaatggcagacaagttggttcccagctttgagcaaattctcacactgtacttctggaagtccctaggctttttccagctttagtggagctacgccaaatgcaggtgtacaaggaggtctccaaaaaccaccaccatctttcccagccatatcttcatgaaagataaggagttaagtctaagtgcctccacactcccccatatttacatctggactgatggtataggggagggaggactaaggaagggaatggccagagagcgtagtgcatatgcccactgagatttttaaaaatgtattctctaagaacaagctgcccatcatcaaccctgaagtcctgaggccacatgaaataatataagaggaaacctctaacaggtttcctccatctatttttttatgttttagaggttcttcctaccataaaagtgattatgcatggtccacacaggacctgagaaaagagccagagctggacaaggcaatgtagacacctccaatgttcccattcttgcccactgcctggctctttgcacctcttttgaccattttgccatctggaggacacattctgcccatgccccacccccgacacacacatgcataagacatccatatttaatggtgctcttctttaaattactccatcagactccttacaattcccttagtagacatctttctttcttttcaccttgtatagagaagtgccctaattgttcctatagacactctgaaagagttatttatggaaggaagatgaaccccctttttatggcaggcactctgctaggcatatattatcttatttctcttccaaaatataaggagataggcattaccattcctgttagagaaggagaacctaagactcacagaagcaacacatgtagctgagaacttacatgcgcaggccctgtgtccagtgctttaggtgaaatatcctataggcccttaacaagtatttggcaaataaatgaacaaacaaatgaactcagctaatgaaccacaaactcaaggtgagtactatcatcatacccatttcacaggtgaccaaacagactccgtgttcatcagtcagactgcacaacatctactaggagtagtaattggaaatgggatttaaatctagccctgtctggcacaaagtcaagattctttcaatttcactatgctgtctctaaaggaaatactagaaacaaggtttctataaaccattgccccctttctaaatagtaatttaaacttttgtgggagcaggtacctttccctcacagcacagtcagaattcacatctgaaacagggaattagaaaatcacaaagcataaactggttgggagaataaaaaagaacatcatgaaacattacctaattgtttagtaatgttgtcatgcattgtccaaaattggcctggaacaagcgtacagccaaggagaggaacataaacagatcttgcactgggatgagcaatctcatttctagcctttctgattcatatgagagatggggacattcaaagtgaactccaggactgccatggaccaggcacacatactcagggaaagagccatcgaagggtcaaggctgaaagaatatttacacaagaactccagcagggaattaaaatgtaccgtatgtttttgcctttcaaagcatgattccctttcctgtttttgttattctgaaattaaaaacatttggccggtgtgccaggcagcaaaagcagcagacagcctaggtcaccaacacccctcatgccatgccagagaaggcaatcaaaacatctctgacttcagatcatggctaggctttgggcttgacaacaaattaatgtatcaccattacatatgatggctcactgggatcctagcaaagttataaaaaaaaaaaaaacccacgggaaccagaaacgattactttaaaattaaaatatgtgtgctagtggttttgcctgctgcctctggtgagtgcttttacatgacgttgccaagggaactgttggctttgctcactgtggtatcacatggaaggtgccatgaatgaatgaataataccaaaaccaagggcatccctctcccaaaatactgaaaacataaaacccacttcagcttactcagtgcaggaactaaaagagagattggccaaaaaaaaaaaaaaaaaaaaaaaaaatttgagcccatagaagagatactaaagagataattatcttcttaaaaaatagggaggaggatttttctttaactttcaatataattcagtcaaatagttattgcctaagcatatttgagataagatttactttaccaagtttcaacattcaacttttgaggaaaccagctgctgtttgcccatcatgccaatgggctaagccttgtgcgtacatctctattaaatagagggccttgggaacaagctggagtagacttgtccagcatcatttcactgacttcgcacttactgtgattcttctatcagtgtttcacacttaggagttggaagcaagcaaaaagacatgccaatatttcgtatttaactcaaaaagaaaagtcaatgatgtgagctggggtcagcctaatagtccatactttctctaagtacctaactccaaaataaaagctgatattcggtactatgacactgaggtccttgtgggatgctcaatatgaaggcttaattgtgttcattactttacacttactattagtggaaagcatactaatgtatttcaggaatttcacaaatgagggagctggggttcagagaggttaggggacttgccaaaggtcacagtgggattacctggactcagacctgggtccgtcttaatccaaggccatgtttgaacaaccgcacctattttataggagcatgctattttgcaaagtgaaaaataattgacagagcttagagagtccaaagaggcaggaactttaaaaataacacttataaagtacagcttaaattgttgtcatttatctaaacaaaacaaaagacatgctccaccaacttacaataattttcaggcttcccttaacatcaaaagatttgatcacccagttgacagactttttgcacttcaagatcaggatgagatttttgaccacttcaagatcctcttgagaaggtcttatatcaattgttatatccacctggaaagcactgtgaatggaagacaaaggcaaagttaagacctacatgccagaaagttgcaactatctcccctcttccaagtcttcatgtttctagtgtctggccagttgattaaaaagctggagttgatcccaggccaatgacatgtgcaaaacagattgttactgcacacataacaaaattgttttacataacaatagaaacatatgcttgctgataattagtcactaaagtttttctcttctttgatggaaaagaggtggttacttaatgcagccactgtttgaagtggacttgaacgaaccagaagagtttacttttgaagcagtattgttgctttttcaaccttcaacaccttcgatgtacaggattcccatttggctaatatgctcaaattccttcaaaactgaagtaggtggcagtttggtgagttgggggcggggtgttgggataagggaagcatggtggtaaaaaaaaaaattaggaaacttcagagtaaaataagagacaaaaggctaaagaatttcttgatttatataaggtttgcttaagtcattaacaattgctacagaatcgtatctgcatttactttcccaaacttctggatataaggttattaaaataaagaaaacagatggtcaaccaagtgattactggaaaattgatgaacacaacccaaacttctaagaattcgtaaaaaagagaattttttactaaacaataacatccctgtcattctgaatttaagggaacagtctttctttccatctcagctttacacacttgtaaagcataaaatgcatggtatactccaatgaagcctcaggcctgacgtcgaagcacattcaccagactgctcctattcccattcccttttcactttctacaaaattcttcaagtggccagagtggaatcttatcaaaacgatctgtagcttacacgctttgaaagtcaaaccccgattagcattttcacctcgaaatccctctacaatatacatttaaattttcaagtcactagtccagatgcaaaggaaggagggtgaaatgcaggctcatgtgggaaaagaacctactttttctcctttttctttaattccctaattattcttgatagggagggtcgaatttccaatccaggggtaggaagctgagagggagaacaagcgcacaagggagaggcaagttctatcgaatggctttttggtatgtcaccatgaagggccactccagcatacacacacacacacacacacacacacacacacacacacacacaccaagcacacaagggagaggcaagcgctatcgaatggctctttcgtatgtcaccatggagggccactccagcatacacacacacacacacacacacacacacacacacacacacacacaccaagcacacaagggagaggcaagttctatcgaatggctctttggtatggcaccatgaagagccactccaccacacacgtgcatgcgcatacacacacacacacacacacacacacacagatttaacgcaaacagctctgagtgcctaagcgctctaaggacaccacaaacagagctttattaaaaacagaaggttactaagatgataattatattaatagggcatattttgtaattttcctatcagggataaccttagtcagaggtgataaagatgaaggaagagtgactgtgtcctgtaattaacacccagaagtttggaacaggcttcaggaattcatctgaaatatctgggatctagggacagatgcagaatataaaatataccactggtgcctttactctgttcttcaaagcttctgtgaaacacatctgatgaagcacacctgaagcatcaatggctaccttccctcctgcgtgaagcatcaatggctcccttccctcctgcgtaggggagggtgtaggacgggctacacctctccctgcctcaagtcaaggaagatctttactttcatctcttgtcacactcacacacttagactcacttacctgtaggggttagagttgggggtgattagctcgatgatgtgtacttcctcattctggggctggctggacatcacacacccttctgctgctttgggttgaaggtactcagcaaggtaattgagtgagagaaaattcttccctatgttgcactttggagggaacacttgatctgaaagaggcacaggacaatctgtcaaaccactgaggtactcggtaaccagattcaaaggaaggagggtgacagtgaaactgagcaaatggcagacacagggaaccacgagctcaaaggatggttcttcgtctgtgaagtccgcaaccactgccctgaaatgcatcctgttatggtcaccagtgaccgcctattgactagcccccaactaggggcctcttttggctaaatcttctccttgcatgttctctgtgatacttcctgtcctcgtctgtttcctctgacctatctttcacatctcttccactggttcctcctctgctcagaatctgtatagaccccaacccagagaatctgattcagaacacccaggcggggcctagggagctttcttttttgaaaagctcgtagtagattccaatataaaccaaggctaagaacttctcagctccttcctcaatcccctttctatctcattctttttctaggtgatctcaatcactcccatggtttcaacctgtacctagatcatgactccttttctgagcagttgacttatactgtcatctgtctaccaagcatctcctatctaaaaatccaatacttatgtatttcatggtcagcgtatttaacattcaatccattctatccccaaatgcactcctccttggatatttgttatttcaactatcaggagaagcaaccacctaattaatcctccgacaccccatgtagaattaatctttccctcatatgtattcctcacagcactttatactctgaagatgaaaggtaggaatttgggggaaataaagaaggcagactttcactctttctcacaatctgaacacagacaactcaagtttatatggcactttacagtttacaaagtgctttcgcaaacattatctcactgtgctgagagttgctcaccacctccacccgggaaagtgatgcaagtaccagaatctgaagacactcccacaacggcacatgccatttacacagcacggcggctgatgggatttccatccacgggcttaaatatttcaacagaacttgaaagaaactgctggcagtgtgacagctgggaccagtgtcaaggaagttctaggtgtagcatgcttttttcagaagggataattaatcagaggcctggcactactataaaacagacttctgccttttccattttgaggacaggatgccagggttcaagtccacatggaagtctcactttggagtaaggaatccaaccagggggtcccaagactgggttgatactgtccctccccctccccacttgtgcaacctcccttgtgctgaggtccgcagcacacactggggcatcatggctctggccaccacagcacccccagcaccaccccagaacaaaggggaccaaagcctctgtttgtcggctcgttgcgagagagcattgggtttgcactctgcagtctcctctaattcccctccccctcagagagaaaagctcaaggctccactgactcaggctgctagagcagcctccctccacatctgctgagggttttgccagatgagcaaatgaggtatgcacaccgtgcagctgcagccctgcggatgcctcccccacatcacaggatggaaaatgatattggaacggcaaggttgaaatttaattaagaaagagcgtctatgggccagggacaggacagtctggaactcaagagactagggccctcctgggattgtggccggcatatccagttcataggtgtgcctggcttgtatctggcacatagtgggcatatggtataggtttcctgaattaacaaacaatgatgtgagatttgagacaaataacaaaatattcactcatgtgaagccactaggaaaggtctaattgttcaaaagttgatgttattaagggctctagtcccagaagccattgtcactaagttgaataagctgaccacttttgttgtgtgtggtttctcccccgctccccaatgactttccgaatgcctggcatcaaaacttataccgagtgccaagtagaaaggaaaccacaaaggggaattcccgggtagaaacctggcaagtttgggggcagggggagtcacatgcttatttgtattttagggaaagattgacaaatgactttgagacacagaaggatatactctgagagcaggaatgaacctggggggtaatgcaaacacctcattttcctgctgtggaaactgaggctctggtggtaagtcaatgttgcttgaagcctcgcagcaagaccagctgggataagagcaaaactcttaaattctttcattctgggtatatagatgagagcagttcccaaacgtcagcaagcatcagatctcctaaagggctgattgaaacactgactgctgggtcccacccccagagttcctgattcagttggtctgggttgggcctgagaactggcatttccatcaagtccccaagtgatgcggatgctgctggggcaaaaaccacactctgagaactgctcgggttagagcaaccaggcctcatggcctgcgatcgctgggtacaagaaaggtagagccaggtcggattctgggaagtgggggatgaagcttgctcagtgcagtctgagccgtggtgataaacatatcactttatggtccactgacctcaccaaggaacctcctttccctactgctcctctctccacggcatggcccggtgactcatactcaactggtggctggagtcaagtttcaggggttccgaaggtgttaccaaggagttaacagtttttactgcaccagacacaaggtcctttaagttggcttcccctacccagtgtgcacaggctgaaccagttaagtgacaacccgtggctctcagggtaagtgactactgtgcttagaaagaagctcatgcactgccgagagaacacagtccaacattctaaatgttattataacaaattttcttattctaacaaattccaaggggtaatcaacattctttcatgctactagaattctgcttcagaaacgcggcccgctggccagggcttagagtctttattaaaagaaatttttcattttgtctcaatgggatttgacctctgttattagctacctatcatgagagtacagaaacaaacttagactttttgagcccagccctcctctaagtccccttctctctgcctcaactaaacaaggatgttcatccaggtggaccacttccctttttgagttatgcttatttggctaggacttaaagtacagctcaggcaacaagcgttaaactcaagagtcaggaagcctgggtttgtgttctggctttgtcacttgttagtaacttggatgtgagcaggttcacttagccctccactaagccctctgtaaaacggtggaaatgacatcttcctcctggggttactgtggggttaagtgggatgcacgtgaaggcccctgaaatggcttctgcacgtagcatcctctccgacgtccacgtccacctttcctgcctctgtctctcacacactttaaagcagcccagatccaaataagagttgggatcaagtgttcactaacccacccttccctgtcttgtctatgaggaggtgacagctgctgtagaatttaacagaaagcagctggatgctgaagaccttaaacgcagtgttcacacaatcagccagctataacaaggacccattcacaagagttatttcctagtaacttatgggggttccaaatatactcaactgaaaataatgatttttaaaaaaaggtctggccaggtgcggtggctcatgcctgtaatcccagcactttgagagaacaagggaggaggatctcttaaccagcagttcaaaaccagcctgggcaacacagcaagacctgtgtctacaaaaaattgtaaaaattagccaggtatgatggcatatgcctgtagtcccagcttcttgggagactgaagcaggagaatcacttgagccctgcaggttgaggctgcagtgagcactgatcgcaccactgcactccagcctgggcaacagagcaagaccctgttgaaggaaggaagggagggagagagggagggagggagggagggaggaaaagaatgaaagaatgaaagaatgagaaagaaagagaaggttttttgtttttgtttttgttttaaaaaaggctttcaaaactgggtttctggatatttctatccctttgcaatgcaaggaaatttaaataggcaatctcttatcaagaccctacacttcttttctccaataatttgtccttgtaatagtcatttgtactaaaaatatatttaaatacttttcctttgctattgtccaaaatgtaacctatgtctcagcaccacaaactgacacaggcttcaaacgtttgcagaacacaggtaagaggaagccacctgctgacccattcattctgccagctcttccactccatcagtcatcacctccttcccacaccctcagcttctcacctccacttactttttttgacttctgtgcatgggtgtcttctaaatcccacacaacaaccttctcctctctccccctgctcctccctgtgtttcacttggccataaccaggcctgcttccccaggaggaaaaaagaagggagggaatatggggggcggtggagaggcctggggccaaatgacccctcaggtcccttccaggtccaacattctgtaattctgtgattccttgccctaaccacctggtttcagaaaagaaaacaattgcctgtcataaatcagtcattaactgaagccacataaaatttaccttcccccactttaatataaatgtttcttgctatcttgagttcggtgaatgaagtaactgctccatactcttttcgggcccaatttaacagatgttcatttccatgggggaagttcctttcttctgtttctgctgtcaaggagaagtttgctgatgaaaactggaccacagaaccctcagacacctagaggaaagagaattgcgtatttaacatggtgcagtcaccggagctgaatcataattagagaaagtacttctcaaatcgaagtgcttgtaaatcgaacctcttccctttgttatacaagcagatcagcgtttttaagcagcggattcaaggaataatcccaagcctagtcctcccagacaaaggcaaaactaccaatgcaggatgtccctctgaactctgaaagaaccttgtgaggacggactgcattgcacattgagtaatcgtaagaattatcactgctatttccaagaaatctaaatcgaagaccaatcttacaatgaatgtatttcaagtcaagtgggaagccttgatgaatgttctcgtgggcttataaaaagcttcaggatcaagacaagtgatcccaaagtcctgctagcaactgatcacgactttcaggtcttccacagttgcagcatctgccaacagagtcatcacaatagggaaacagcgagagtcctcttggtttatgttcacctcagcactgagataaaaatggccaaaggttgccagcctttctatcacattgctctatttcataagagtgagatgaatgtttgtaacagtttattgtgtaagacccccaaattcccatagataatgaagtcaagaggctgttaaactgatctaataaaactttcaggatgacgtatgcaagtacctcattcttgctgaatgtatttagaccactgctgacctagcatatcatggtatatgtgtaattaacacatccaaaggaggaaaatcatcatcttgttgctgtgctataatcaaatttagttgctggtgaaaatatgtatgccatttttgttggctagcatttataaaataactgattttttcaatgtcagagtgaaacctcaaaatgtgggcaagaaggctcacaaattctcaggtcatagaactataaatgtcttgtattaaatttcacatgaaccatttattcataacgaaaagcatgcagtttctgaagtaagactaagaagcaagtcgagggcagggattttattagtggttctatcacagcagcatttttaacacacacaaaattatattttcccagctactgtgctaggcattaatattttctatacaattatataaacgtatcttctaaaaacgctggcaaaaaaaagtacttcaattaattgattccatgacctactaatgttgcaagctgaaaactagaatcacctgaaaagtttctagatatcctgatgcccgggccacacagatggtacagagctacatgttccactctggttttgtttataactggcatcaggacattcagaaatgatcgtgactacacttgacagcactgatacgtagtaagtgtgcagtcagtggtagctgtgtagaactacacagggctctgtggaagccctgaattaatcactaataaactcggtgtaaaccaaagctactcacaacagctaccactgactgcacacttactacgtatcagtgctgtcaagtgtagtcacgatcatttctgaatgtcctgatgccagttataaacaaaaccagaggggaacatgtagctctaaccttgttttgacgtcgcctgaataagaaaaaaatcctaggtcattttcctgccaaaaaataaccatgcccacctaagtgtaacttctctgaggcttagctactcatcaacactgaacttccaacaatgtttatctaattttttgacttttgcactgtagtaaaatcttcctttcacttgtactaaaaaggcatttttatcaaggctgtcaccaaaacccacaacagtccagaggcctttgtcccactgccagcacagttctgaatgtttagacgagaaaccctggatgttctgcttcttgtttctcattcatgttgtggccataaactacagcaaccctatatacattatacacagagtacgtttttcagagcggaaagcgggatgtcacactggtgcattccagaggcaagaaagcaaacagcacaaatacagaagatatcaacggcaactccgaattgtgtcctgaagtaattaaagagcgatgccgtgatgaagctggtgatggggctgattcgtggaggaggaacaactccctctgctccctccaggcattgttgtcctcacgggccagcagcaataagcttcatacactcagggctgaggaatttggaactggagttaactgccactcctcaggcacattccaataagaagaaagcaaagctgcagtgaggtgtccctgactgcaggtcagtggaaattttcagcttcagcaaggagtgagctagcactcccctcctgactgccagctctcctgaccctgacaaggctacagctgagttttagaaggtgttgttttagaaggtattgttcagatgttatttccatctgatttgcggaactgtgaggcaggctacggtgacctctacagcagaaaagcggaaacctcagagagtctaatggcctacccaaggccagagagtcatgcaccaggcccagaccagaacttaagacttctgactcctggtcacagctggcctctgcttgcacccttccagaaagaagacctcactagctcccaagacagcagatttctgttctgttagattcattttttatacactagtctgagccatgcctactagaacaaagaattccttcgtctttcttccatgagacaagacttcaggtgtttaaaggtgtcatctgacctcaatcacatgtttgctttttcagggcaacacccctagcttcttcagttctgccccagataccctggttgtcagagcgtcaacaggatagtctctgaaagacggtgtcgggacaagattcaaggtctccaggtatggtctgagaagcatactgtgatggttcattttatgtgtcaacttgactgggccacaggtgcccagatatttggccaaacattattctgggtattttggtgaggatgcatttggatgagatttaaatgttagtacattgagtagggcagatttctctccctgacatgtatgggttcatccaatcagttgaaggcctgaatagaacaaaaagctgactctctcacaagtaagaattctacctgatggctttcaaactggaacatcagctcttcccggtgctacagcagcctacaggccttcgaactggaactggggcactggctctgcagattttggacttcttagcctctataattgcatgagacaattcctataataaatctctttctccatatatgtgaacactgcatgaagcatccacattagctttggcatcagctgaaccctgctatgatctcatatttactaattgatatagtttgcatatttgtccccacctaaatctcatgttgaatggtaacccccaacgtttcacatggggcctggtgggaggtgtttggatcatgggggcagatccccccatgaatggcttaggccatccccttggtaataagtgaactctcgtcttgagttcacgtgagatctgctcatttaaaagtgtgtggcacctcccccgacacacgttctctctcttgctcctgcttttgccatgtgtaagtgcctgcacctgcttcatcttcctccataagtaaaagcatcctgaggtctccccagaggcagatgttggtgctatgcttcctgtacagcttgcagaaccatgagccaattaaacctcttttcttataaattgcccagtctcaagtatttctttttagcaatgcaagaacagcctaataaactaatctatgctttaaacatagagccaacaaagatttatggagtgcctgcctactccattgttctccatgctggagacacagtggagagacacagtggagaatatgacagaaaaaattccctgcccttatggagattaaagtctaataagacagccagaggagcacaataaggtcactgagaagttaaagacctaaaggagacgaaagaacaaaccacacaaacatcagggcaaggagcattcacagttgagacgcagcaagtgtaaggtctgacatggtgaaggaagaccaaggaggtcagtgtggctggacacagggctgagaggaggttggtaggacacagggctgaggcaaggttggtaggacacaggtcccagaggagaccagtaggcccaacaggaccttgtagaccgttgtaaggactattgaaacatctaccaaatgttttcgcaggatggctctggctgctatgttgagtctaaggggagacaaaaagcaggagatcattagtagacttccggaataattcaggtgagaaacagtggtcactcacaccaggaaggatggtagagatgatggtacctaaccccccaaggtcttttcaccagttcgaggcttttctatcctatccttatacccataattctcccaaaataaatgcaaagtcttatagttattcttcagacccatatttcaagtctgaagagaccatgtaaaaatccttattttattagctataaataattaaattttatagcacaccttctgcactttcatctaaatccctgagaggttgaccaagacaaggctgaagtctgtgactcatacgtacactcccacactaacctgagcacattagcagtccttgctggggttccaggttgttcagccaactaccaagggacctcacagaaccttcctcatctttgtaagggcatcatgctacaacccaccaagaaccctgctgcattagtccattctcacactgctataaaaaaatacctgggactgggtaatttacaaagaaaagaggtttaattggctcatggttccacaggctgtacaggaagcatggctgggaggcctcaggaaacttacaatcatggtggaaggtgaagaggaagcaggcgtgacttatatggcaggagcaggaggaagagagggagtgggtaggtgctacatacttttaaataaccagatctcgtggtaaatcactcactatgacgagaacagcacaaaagaggaaatcttcccatccccatgatctaatcacctcctactaccaggccccacttccaacactggggattacaatttattttattttatttattattttttgagatggagtcttgctcttgtcacccaggctgaagtgcaatggtgcgatctcggctcactgcaacctccacctcccaggttcaagagattattctgccttagcctcccgagtagctgggattacaggcgtgtgccaccacatccggctaatttttgtattattagtaaagacgggtttcaccatgttggcaaggctggtctcaaactcctgacctcaggtgatccacccacctcggcctcccaaagtgctgggattacaggtgtaagccaccacacccagctgggattacaatttttttttttttttagatggagtctcgctctgtcgcccaggctggagtgcaatggcatgatcttggctcattgcaacctccacctcacgggttcaattgattctcctgcctcagcctcccaagtagctgggattacaggcgtccaccatcaggcccggctaatttttgtatttttagtagagacagggtttcaccaggttgtccaggctggtcttgaactcctgacctcaggtgatccacctgcctcagccttccaaagtgctgggattataggcctgagccactgtgcccggtcacaggattactatttaacatgagatttgggcagggacatagacccaaatcatatcatttgctgaaatgaagacaagatatttccaggtcattcctctagtctaccagtccatgctccagacactgcattaattttcatggcatagcacccttatcagagtctggcttgtagaagaacataggatataaagagaatagcaaaacacataagaaatgtagggaaaataattttgtctaatatgagaaagggttgcaatcatcactgcaaggaagataactgcaagagtgtataggagaaaaacaacctatttttctctatgctcacaccactctcaatagtttacttctgacatcgcatgtctgggtgtttttcccacaccaactaattctccaactcagaacaccaattgatgctgtgtatttcgatgtaattctgataccatctacctggagataggtcagaccgcacagattaagggctcagtcccacaagactgcccctcttcagatgcttctgatagtggggctataaatcataggttcccatgaccctgaggttcaattattttctagaatggctcacagaactcaaggaaatacttttaagtttattcatttatgataaaggatacaactcaagaacagcagccagatggaagagatgcacagggcaaggtacggggaaggggtgaggagcttctgtgccctctcggagagcgccactcccccacgccccggcacctccacatgctcaccaaccagcagctctccaaaccctaccccacagatcagggatttctagggagccttcattccacaggcatgactgataaaaccattggtcatgtatgattaagtcaatctccagcccttctcccctccttcagaggggtgggctgaaagttctaacctctaatcacatggttggttcccttggcaaccagcccccatccagaggctatccaggagccccagccaccagtcatctcaccagcatacaaaaaggtacttaacacttcagagatgatgagggttggaggagctgtgtgccagaggaggagactatttattccatgccccatcttccaccttatccctggaggcttgccacaacactgtcccattttgggtccttataatctcaaccaaactgttgcagtaactttctaccctcccagccgctattcctgttccttctacccctcctccacactgtcacctgggtaatccttctaaaaagtaaacacatgataaagcggaatggcacctaagcatcttaacatggcgcatgactgaagtgcctctgcccgccctcatctcatgccaccctcccacatacccaagaactactcacagttgtagaacacatcatgctgccacacactcctgggtctttttacaccctgcaccctgcctgaacccgtctatcctaccttgctcccatggcaaaccgttctgtgtcctcccaggagtatcacctgctctgtgaagcctcccaggctccctactctcctcacaatgagctgcacacaagtgactgtacagacctttagtccatccctctctcacatggactgcaactatttatcagcatacctgccaccctcatttgacaaagagcaacacctcgagggccaagaaaaaaccttgttcattctgaatcccttgggcctggcatagtgctgggcatgaagcaaggacccaataattgcttgttgaatgaaagctcaatgttgttacctacaggaaaagatacaccataattgattcattcccattacccaaactcattgcttcccttactgcccaggaaatgagcttttggccaagctttaaagctaatgatttgatttttcacctaataactccacctaaaaaccaattattaaagcatatttagtaattccatgtcttccccacaacccaatgaactttcctcctgcttgctaattaaaacccaatcctctaacattccctgacatgacaaatgtcttcctgtgggaatgaacagagcactgggctccaagggtcccaattcctagtaaacgtttgttgaaggggaaccatgaagcactttacagtcaaacaaatcctgggatgctgaggtgcaccctggactctcctgaatgctcctccctacttgaaccatgcacaacatttgtatttgaaattcaggttatgctaccagacttttttaaagagcagaacattactctatctgccaattgctgggagttttattataagaacttacggctaggcaaccacagccaagtttattattttttctggatcaggttcaacaacctcatccaaaactacatgaaaaaagccaaagaggcaaccagccctttgtttccacacctgtctttaagctttaactcttaaagtcctcagcggatccacggaagcctcaaggttgatctcccaagcctgagtgaagtgtacaagtcccagctaatgagcacagacaccattttcctggcactgaggttctttgctttagcacttagcacatcagctgactcaccacctggcaggttgcattgtagcctctctctgggcctccccaacgttggtttagtcttcagtggtgaggagaggaacttgctgtggatagtgccacacatccccatcctcctgcctccttgacccctaccccaaaaagaatgctcccagatgaagtcttgaggaaacttcaggccaccctagatcaaaagtggatattaagtctcatcttaagtttcacctcaacctccttcaagtctattcaaatgttaccttctcaatgggcccatttaaatttacaaccccaccacccagccccactctaggaattctgattttcccaaactcactttacattttatttctacagtacttgtcaccttctaaaatgccatataatatgcttattgcccaactccttccactagaaggttccttcagaggctgggatcttagtgtgcattgtccatgggtataccccaagtgttgggtacaaaaaagatacttgttaagtatttgtttgataaataaaacaaatcttgatgtccaattaactggcagtgcctgcctaaggttctgtgctgagaaggattctgaggtcatattcaggagcagtggagaaatgggaacaaatgccatgagcaaccacgtgtctgccagggggttagcgaaggcatcattgctctacagctgttatccaatgtagtgtccactggccacatggcaccatcaagtacctgaacctgaaatgttgctggttaaattgacctgtgttatataaatgtaaaatgcataccacttagcacaagaaaaatccctatctcattaatttttattgactgattacaagtttaagtgatattattttggatctactgggttaaacaaagtgtcattaatattaattttacttactttttttttttttttttgagacggagtttcgctcatcacccaggctggagtgtagtggcacgatctcagctcactgcagtctctgcctcccaggttcaagcgattctcctgcctcagcctcccgagtagctgggattacaggcacctgccaccatgcccggttaattttttgtatttttagtagatatggggtttcaccatgttgggcaggctggtctcgaactcctgacctcaggtgatctgcccaccccggcctcccaaagtgctgggattacaggcacgaggagccatgcccagccactcagccttcttttactttttaaatgcaccaatagaagacttaaaattacatatattgttggcattatatttctattggacagtgcttctctagagcctcctccaatttgaccctaagaaaggaacatgtttatgaactgatcatgtccatccatctgcttcttggtctggtctcaacataaatcaatgtcaagaaaacatctcaagcccaacgcttcccaaagtctgatcctcagacagaagtacgttaaaatgcagactccagggtggtgggaggtagaaatgtaggaaactacattataatcctccctctaccactcatgattctgacgcatacttgaggaacattgttctaggccatagatatgaatattatttaaactccaataatctttataaagctcgaatgagattgtttgaagaacgagcaagaatctctcctctgcactgatgataaaaagccaagagggagagtgtaaagccaagtcatggatggagtcatctccttgcacatctcaaaaggaagaaatgggccttgtgaaataagagaaaccatagctccccaatgataatgaaaaagcctgttgagatctcagaggaaatctgttccaggaatctcaaacgcacgcgtacacacacacacacacatcccctacaactcagctgtggtccatttggaacttgagttatcagctgggtgagtgcctgctattcaggttacaggcccttggggctgctctaactcgcacatccaactgcacacatgtccgtgactttggcattggtggaagttcaacacttacacaatgaaaatagactcctccccctcttctgtcctgccctactcccagctttcagtattcctcttcccttttcctgactcctgcacaaacaaatctctttttggagttgcctgcttaggaaaatagaaagagcaaaacaaggaaaacaaagaaagcaaagaaaaacacactgatatttcagaaacacctgccatgccaagaacttgctggctcagttccagggggaaaagacacacggtaaaggagaataggtattcctcaagaatctcagttgaggtttaagtgggatctacagattggccctagaactcatcacagcccccacacagaaaggcattacaaagattatgcttttatgtattttggacacacaaagtccagcaaaaacaaacatactggaacagcactgaaatatttaccttccaaatgaagactgaaccctgcattttaaaagaggaaaatcacacgttctccctacccaattcctgggaggaccccacttgcctatttcctctgaagccatgtgatgtgaaatgcaatccgaaacatgttttctattaacatatatcatgactcaatgccttttaaaaaagcttcatttcaaagaaataataacttccatgcctgtgaacctaggttcataatttgcaaagctacatattcatgagccatgtgatgatggtatctgccaatcatgcattcatgaaacacaaatccatgcagccatttaaaaattcttgggtgattttatttagtaccccaaaccagattactttcttccaataaaatgacttaaaacatatttgactattactttttctcaaaacattcatgatgatcatcctgttcttaatttttgctgaaatataaaaaaaacctaaatgactgaaaccgccccatgttcttaacaccctgcatgtttacacacgtccaagaggaaagctctgagatgctgccctccaaacacaaacatgcacaaacttgaacatgagccagtacaaaagcaatactctcatctcccatggaaacgttatcagaacaacagtacatgtgagtgtgtatatacacaaagagaagcaaaagatgtctttccatctaaaaaacaaactaagtccccacaagttaccaaactgatgaagcacaagctgctttctaatatagttttccaaagtagagtcccaggccacacaggaatcctgtccagctttacaaaaaattcttcagactcctaactttacccttcctcatctgccaatgttagcctgatggaagagcttacccccaaattcaaagtgcatttcaatctaaatgatgtttttcacgaaaaaaaataaaatgttggtatcattactattacttgccatattcctttatctaattttgtcctccaaatgtgctcctggagaaccccacaggagggaagactctctttttttttcttctaagttacatccaatcagccaagtcaagttcaagagcaaaaactgatttttacaaatgcctggctccaaacatgttcctagaattctctttatagagttttttttttcatcaaggctgataatctcaactccattttacagagaaggaaattgaagctgacagaagctaaaggatctacccaaggcacacagctggcagacaacagggttgacaatagaaccaaagacctggtttctcactctagagctctttctattccatcgctgtggaagagtcagctaccaggctcagaaatcagtagtgtagggtagacacgcacatccctcagcctcatgttaataaaacactaggaaatatgatattaatcacaaaagctcaggctgcacacttcctaagtgcatgtcacatggattctgaatcctcatatctgatagtggaaacaactggggctctgagcaattagataaagtgccagattacacacctttagcaagaaatgagtgcagattcaaactgtctgctggactccaaaaatgatgctctttccactgtgggaaggtggacactctgcctggaaaggtcatctcccgttggtgagggaactgactggctcacaggtcagcaaagacctgggtgtcttagggcaagctttctaccaagtctgggtaggcaaatacagaggaacattctccaggcttagaggagagtgaaaaggaaaagcagtgaggcaaagcagggggctcccacccttcactgctgcttgcagagattctcctggtgggttatttccctctctgtcccctcttccccagcaatctcaggagctgtgctggtcagagtggagaggaacggaatggaagggacagacagaaatagaaatgaaacagttaaagcaacgaaataattacttggctagaagtcaagttagagtaaacaacaacaaattgctcaaggatcttaaaaatttctgtgatggtcagttttatatgtcaacgtatctaggccatcttccccagctatgcaatcaaacactcatctacacgttactgtgaggtattttgtagacgcaattaaactccataatcaggtggcactaaggaagggagattgtatcagataatctgggtgggcctgattcaatccattgaaagccattaagagcacacccaaggcttccctgaggaagaaaaaattccacctgtggacagcggcttccgctcatgcctgagctgcccttcctgaaggcctccctgcggactttgattgccctgcctgtccccacaatggcataagccaattctttgtaataaatctcttcatatatatatccccgactggttctgtttctctagataaatgctgactgatagctcctgggaatggctggtgcaagccctaggagaaacagagctgcatattctggcccaggaaccacagacctaacaacagtttgggaaaaaaagttctaaagggtatttccttggagggcaagaatggaggtgaggcctctagcccgaaataactgtggttggagcctccttgagcttcctaaaattagctctgaagcaaaggcagagccctcttaagcaggccacacccattttgcagtctacattgaagtctctgaagatgatcaaggtggtctcctaggtcaaagcaaagaaggttgaactgcacatatttagcatcaattaacaaacggtccccacagggttcaggatagatgtagatattagggcatcctggtggagctgatccagaaacgctccaactgggaccccagagggaaagctcttgggaaaggggtcaagaaacagttttaaaatctttattcaagtgaaatactgatatgatctagatcccagtactgaaataagtcatgcataaaacactttgctgaaacaagaagtttgctcacctgatgcgatgccctgatttggctctataggttcaattctgaagccctgttcttggaacagtcatgagtggctccagactggaggccagagttagagataaaatcatagtcatgccctcgagtcagcagtgtgactgttcccaatgaggtccccatttaccattctggaaagtattattattattattattattattattattgctaacatttactgagtacttactaagcactgtccctgggttagagcccccgtttactagctatgggaccaggtacatgttaacctctttgtctcagtttcctcatcttaaaacaaagacaacaaaagcacctacttcacaggcttattatgaagactaagctcatacatgtaagtactcagaagagtacctcacacacggcacacactagaagtgcttgttaaacatacacatatgtgtgtatgtatcctcacattgggccatgagatttgtctgacagatgctgaggttgacaggccacgagtcattcctcactatggcaggaccatagccttcttatacaaactgcaagaaaaggatataaaaaccctgttttaatggattggggcaggcttggctccaaacagcagctctgaacatcactctgccatctgtatcacccagaaccaatagaatctcaagaacaggctctctgtgataaagatggaaaggccagagatcaaatggactgtgagacttttgctagaggtggcagacggaagaccccctgacttccaggtatacactgtgtcattcaccacctcagtgggacaaggcagaggcaaaccaatggtgactccctagcacagtggcattaaggacccacagttgcaacaaagaccctgggtcatctaaggatacagtgttaggaacaaaaggcaaaagcagatcttgagaaaagcaaattctatcctagacacagaaattagaaggctaaagggactccttcctcccctgcgaaatcagaagtagcttccaagctagagttagataatgtggactcgaggtgcaagaaccaatttgcctcaaataaacccaacaacctgtgtccaggaaggagttggaccatcctggagttgctttctgagatggagagtgtaggtcacctgtggagaacccttaccaaaggcatcactgtctataatttatgagcggaacaaggcacagccacagccttcaagtcagcctcccagagtctcctggtagacagttggggtttctttcccctcctattacatggaaataaaatattctgcaaccttccttaacaaaacagtcactttttctaccgaacagctctctggaggctggccaccacgtcaacaaagggcaccagagatgtgacatttgatacaattgcccaacacttgggaagggcagatgcatctgattaccagattagccttagacaataaagccttaaaagacgttatgggactccacacgaagaaacaccaaccttgcctcctcagtgaaagtgagtttatttgacctcaatttgttgaatgaaagcaaagccttcacagggctgcaacccatgcctgcacacagacatgacgcaagtccagccagagccaggaaaagtctacacttgcgtgaaccctcctggacagtaggtcttcctcaggaaaaatacacccaggcaaatctcccaggggccacgggccattcactcactcacaacattcaccagccttaacctagcaagttagaataaatcccagggagtctttcaaaaaccccttctggaccaggtttaccagttgaaactgggctctttccaatgttctaattgccatagtgacatttaggaagagctcaatggccacaatagggccaaaaactcctattcctaggaaacaggaatgacttgtttgaactagggtagttgactgaccctagttcatgagaggatcaagacccatataattaaggcccttaaggacaagccacaaaaccaacagatgagcagactccggaataaaaatgcatggtacacaaccacttggaatatcccacaggacacaatgagtcattccacaagagacatttaaaaaaagaagaagaaccaccagcaatcttgaaacatttagttatttaatctcccttcaagagagaatttatctggggaaagacctcactgcaaaacacaaactggtatatccgggtccctggaatacaggggtaatgcttctggccgagccaagagctgtgtttgtgtctgcaaccttgacccatttgccacatgctgttctccagagccaacctcatgcaggaagctgccttgattgcatttggaagaagagaattctcattttctccaatttctactattctcatcttctccaattttcactattatttagcgtaatagtacttagcacactaaactgcaattcccaatttttcaatcagctctcccacacaatgggaagctccctgacgacaggcaattcaccccagttttccctagatcctccacagctagcacagttcacagtcaggcactaaaaactgtgtgttggatgaatgaacaagcacatacataaaccatcatacccggtatgctaattctgtgtttttttctaaacatgggggtgggggaactgccaaagaagggaaagaaggaaattagcaaagaaaaaaattatttccagatttttaaatgtaacacaatagaatacagaattttttttaaaaaaagttcccttctccacaagcaaacttgaatgtctgagttattcttagggcgtttttggacagacactacaaccctcagttacacatcacttggcttcatgaaaaggtaacagctggacatgcacggtggtatgggctgtgcgtgtcccttcctagtgctgcactgagcacacatctggggctatttagcaactgattggaaatttagccttctgatttccagttaaatactaggcacaggaaaacaaatagcacttgtttttcactgagtcttgtcagtcatccaaactccagtgcagaccagagaactgcctgtggtttggtggcagaggcccaaaatatttggacctttttttttttaatgcctctagtttaagtaaaaggaataaactagatgttggcagctccagcttcttcacccatccctccccgcttcttgaaaatacaaaactggttttaaatttattaatttacatttttcattaggattaagttttgatttgtttttaatccaaagctaatagcatagagtttagtttctgtcatttattgcaactgccctgccttgatatttacttggatttgctgaagaggcaatgctcaatttgccagtttctgttccaaattaaattgggatataacatctagcagtcgtactatcaaagaatcacagagtttaaaagctgggaggaactttagagatgagctagtacgatcccctcattttagaaatgaggaaacgaggtctgagtagttaagtgattttttttcccgatgatgtatataactagttagtggcagagccaagactagtactcaggcctcctaacacccaggccagggtgttaactggaaacaaaaacctgaattacctccgagtagagctgcccaataaagtacaggacacccagttaaagttgaatttcaggtaaacaatgaatactttttcagtatatgttatgtcccatatactacatgggcacactaacaaaatgatttgttatttatctgaaattcaactttaattgggcatcctctatttttatatgccagctccagcaattgtacctcaaagaccaaaatccccttctatgccccatcccccactcaaacatacacacattcacatacatttgctctctgattttaatgataaatggctagaaaaaaatagatcacagcacagtaatatcgagagtgaatgaggttggaagaagctgcttatttcttgaaacttctaatcttagatacccttttttccttatgagcatgcaaagtgactaagcctgacataagtaagctggccaaggcctctggactaggtattttaggttattaaaagccaggcactagggtctcatcttgaaaacgtctgcttgtcctagggctccaagtctacagaccttgcaggagagaatgctcaagtttggaatacaaataaagcaagattaaaaaaaaaaaattagaggccgggcatagtggctcacacctgtaatcccagtactttgggaggccaaggcaggtggacggcttcagcccaagagtttaagaccagcctgggcaacaaagtgaaaccccatctttacaaaaaaaaaagtcaaaaattagctgggtgtgggggtacatgcctgtaatcccagctactcgggaggctgaggtgagaggatggtttgagcccaggcagcagaggttacagtgagccgagatcatgccactgaactctagcttgggctacagagccagaccctctctcaaaaaaaaaaagaaaaaaagaaaaaaaaatcaggtacatggaataaagtaaaaagatacatttaaaaacctagtccctgcccagcactgtggctcgcgcctataaacccagcactttgggaggccaaagtgggtgcatcacttgagaccaggagtttgagattagcctggacaatatggcaaaaccctatctctacaaaaaataccaaaaaaaatcagctggtcatgttggcatgcacctgtagtcccagctactcgggaggctgaggcaggaggatcgcttgagcccagaaggttgaggctacagtgaggcatgtttgcaccactgcactccagcctgagtaagggagtgagactctgtcctcaaaaaaaaaaaaaaaaaaaaaaaaaaaagtgctgcagcaagtttttactagttttatgaaatacagtccacataccataatattcagccttttaaactgtacaattcagtgtttctgtgtgtattcacaaggtgtggtatattcaccactatgtaattatagaacatttttgtcacctcccaaaagaaatctcgtatcattagtagtcattccccattttcccctcccatcagcccctggcaattactaatctactttctgtttctatagatttgcccattctggacattttatataaattggaatcatacaacttgtgacaattagcatctggcttctttcacttagtataatgttttcaagacccatctatgttgtggtatgtatcagaacttcaatcctttttatggctaatattccattatatggatatagcactgttttcatccactcatctgttggtagacatttgggttgtttccactttttggttactgtgaataatgatgctttggacatttgtggacaagttcttggggacatgtgttttgctcagttttccacagaaccattttacattcccaccagcaatgtatgcgtgttccaatttccctacagctttcacaacccttgttatcgccttttttattaaagccatcctagtgtgaagtggcatctcactgtggttttcattagcatgtccctaatgactcatgatattgagcatcttttcatgtgttttttggccatttgtgtcttttctctagaaaccgtgtatttaaattgtagtatgtccttaaagacaacttcatactgtggctctcattttagcaaattcaggttgaaggttcaggcatcatcacccagttaagttatcttactttttttttcagtgtagaaatgaatgcataaataaaaacaggcttatgtgatccttctaagagattatttgcagtttcaacatggcacactgagagggtaagatgatttttatttctgattgttctctgggccacccatacaccctgcaaaaggaaaactataagattattacaacttcatcacgtgtgtgtgtgactcacactcaaagattcactacttgaaactcagcctgaaagcatcactcttcatcccactcatatttcctaggtaaccagaataaccagataaaggagctgcacctgcagagaaaaccaaatcccactttctccctgcctgacacgttcccttcttgcctgtgctgtgagggggtgagaaggactgaaatgatttgacagaaaaagacagatgcctttattactagtattaaagtatgttttcagtcaccctcaagggtggctgcgatgtcctgggtaacataaggccctcctaactaattatgaaagttttccttttttaatttgggcagtcataacaacacagacatgtccatttaaataaaaaggtcaccctgataaatgagtagatgctattacttgaacttttctcattgccctatttaaaaaaaaacagttaaaagttctgtaactctacgtacacagtagacagctctgagacagaaatgcaaaccatccagcagcatatcaggaaacaggcaaggatacatgcatcgtggactgagagtcaagagacccattcgctttccacagctcctttaggctccctgggtaacctcggagaagacagtgatgaaaacggtgaagcctgaatttccagagatcccgtgggccctctgaagtgtttgatgaacactttatataaaataatttagttatcttatccccaaactttaactcttaactatacaaatggataaagagaacacactactggatttctattgatcaccagaccctctgtggcaaaggctatcaaggagatgaggagaaactaaaattcatttcaggccacagagaggaagggaaaagcctgcccaaggagagtggcccagcttgtgcaaggacttgcatcactcgttgtctgctgatgtgagaacgtgaatgaacaacagatgttccatcgtctcttccaggccaagaagaaatgtgcagacgggaaaaaaaccgttttccctaaaggaagcctgctggacaacaaagcagagttcaggtgtcctggaatttaaatccttgacttctcctgatgctgcctcccacgtgttggtaattttaggctcattacttgatctgcaatctccttacatgggattgatccaaatggggctgacgttcaattgtttactaaagcggccaccttctttcattgttagtgtctaaactgatgaccaagaagcagtttttacagattttaagcaaaattaaagcaaattaataactaagagtaagacactttccgtcaaaacccatgaactggcagactgaagaaagaatccaggcagcgataagtacaactatgacatacgtagcccacactttcatctggacctatagcccagagaaacagaaccccttttgatctggggccagccaaactagatatttcataaatacagatgcaaattcaacacccgtcccacatgctctttactgtgactagaaataaataagagcagcaacagcaggtgatgtctataaacattttatatgtgatctcacttactcaagataacagccctatgatgcagggcctgagaaaaatccggcttagagaaattaatttgcccaaggtcactgcttggatctaaaccaggacatgcactgcctttgctcataatgcctccataacctgcccactgtggtagccactagcctcacatagctactaagcacctgaaatgtggctaagcaggactgaagaactgtaatttaagtagccacgcacagctatttcctatagtattggacagtatagctctacagtatgagggctaaatgtgcatatgactttatgatcagagccattagtattactatcacaagtaactttaattagaggagactgacagtgattatgagtacgaaggcagacagtttagcataacagcttgtagaatgggtcccatctaggtttgagtaccaactctgcaagtaactagccatgtgatttggcccactacttaacttctctaaatcttagttcttcatctataagaaaggatctacactatggtactgtagaaggctatcgtgagaattaaagtattagagcatttagtgacctgaaatatcctaagtgctaaataaatgtgctagtaataacaactaaataattactgatttttgatttttggcctttttaatatagaataagagttgcaattcccagaaaaggctacaataaagttattgtaatgcccaccttgtaaatgtaccttttgagtttaaatgttttcttttgaaattaatttaaatttacagcaaagttgctagtacaaaggactctactatacccttttaactagattcatcagtttttaaaaccttgccacatttgctttattcttctctatacaacatgtttttttcctgaatgatctgaccttttagcccttaatcttaaagagtattaagtatgtttcctaaggatattctcttacataaaaacaacataattatcaaattcaaggaatataacattgatataatattttaatctataggctcaattataatttatttatataaaatacaatccactgtccccctaatgtcttttatagcagctgccccactccctacccaacaggatccagctcaggatcacatgtgtcttgtctttttgtctcctctaatctggaatggctccccagcctttctctgtctttcatgactgatacttttgaagattataggccagttatcttatagaatgtcgttcaatttggttttgtcagcgtttcttcatgattagattcaggttatatgcatttctggcaaaaataccacaaaagtgatgctgtgttctctctcatttataggcacacagcgtccatctgccccacattgctgatatgaattttaatcacctggttaaggtatcatgggatatccccaaggtatatagtcactattttttatgtgtaattaataagtaatttgtatgaaagatattttaagaatatctaaatatactacttcctgaactccctccatctctgctagatttagcatctgttgataattcttgcctggtcaacttttattatgatggttgcaaaatgatcattttctaactcctttgctccttctagattttctagttggcattttactataaagatgagcttttccttttctcccttttattcatttatgtacttattataataattgtattgactatggattcttacattattcaacaagaacctttgagtttttagaagtactcttcaaacacaggggaaagaaactacagatctggattgagagacattaactgggcaaagtttattcatgaggcaagaggaaaactattaactggggactccacttgttttggatgcttgtgggcaagagaggtttaaggcctcaggcaccgcagttaggacattagcctgcagctctcgtaatagacaatgtgagttacaactaccaagttgcagtgctgctcatcatcagacatgatatcacaccaaaaaaattccatccaaacaacccatcgatttctccacaactagcacacttgaatgttctggcaaactcaaagggacatgatttacaaatagtaggtaatatttggatctttcgacaagagctgagttccagcttgtttttttaataaaatacaaatgacttcattttggagctcactgtgtcactttctcaacaaacagatcctcatatcaggaattaggcctgtgttatatacaaatagtatgggtccgtgcatattcattttgtggtcagggaccacacacccggtagccagttacaatatttacagggctcctgatgccacaaggggggtttcagagctgaaaccaaagctcaggccacacagagtatgacgacaggtcctgctctaatgtgcgcactagaccccagcctctgcccacagaagatgggcaggtgtgtctgctttctgtgaatgcttatctatgtcatcatccaaatatcactaagtgcatcctccaaatttaacactctttggactctggcattatttcagtgaaagtaagcctttatgaaaagtttggcaaagtttaaggaccattatgtccttgtgctaaggatcagtttgggggaggtttaagcacttaccaaaaacagtctggagaccccagtggcaagtctctctgtcttcagatgccacaccagggggtgtggggagttgagcaggaacacaacagacttgtggtggatgtggactgaggagatgggattcaggtgaagtgtgacctaggaagcaacagaaagagggcagaaatcttagccctggctttccatgaaaatcactcagagcagcctctggaatactttttttgcaactcactatcaacagaaacaagctataatgtagctcagattctatgaataagatacattaagttgaaccagatgatattgccaatatttgaccattttttactacaaaatggctatttcatattagtcaaccacactaatctcaaccaaagcatgatttagctccctgccaaagaacaaataaacagaacacattttttctttctaaaagtcagcaaaggtggaacaaaagttaccttcccttaggcctgctttaagctttaggtcaaatgactaaggtgaaacttggaaaacaaaatccccttggggtggggtcatccctctggatctccagagaaatgactttcttctcctccaggtaagctccaacctctataaagtgaaatgggttctgccaaagaaaagtgccgaaagctgagaaaaagcggctgccaagggaggctgccagggctttcattgtctcagcttttagcttgaagggcttttccaaagaaatgaagcacagaggacacacagaataaagagtgattgtatacagcccctgtcaaaaaaaaaaaaaaaaaaaaaacagggaagaaaaccatgggatggatacaaaaactgtaaccaattttgacagcagatcaaggactattgcaggtcatcactgttgtcattaacatcaccaaaaagcacctgtgaatggagctgcaaaccatggactcaacaaagtcctcttggcacacatgagcccagggcaacatgaacataggagaacaaagggatatataaggaaatattgactagatactttcatacagtctgtctcatactggctttccatacagagcggggaggcaagacccaagaatcacatatttaaacagagtgaactcatcaaacataaccataaagtaataagggagggacaggacaaaaaaggacttaggctagaaagacacagactgaatgatgcactgggaataatagtacatctcagctagaatcctcatgaggatgacatggtctagatccacgatctgtgtctatacaaccatcagggatacagcactaaatgctggactatttcacattttcccaatggctgccagcccactgtgatctcaacatacttctacctttttttgtagggaccacttatgaccaatgtcacttatcatagtatgctctcaggtcattgataaataaaacagtaaactttcattatctttcaaaacccaggctttagcacatggtaagcactcagcaaatgtcaaaataatgttttaattctctgcttttcaatgccacaaaaatattctatgaataacttgcatcatcttgttcactagcttgagaatgcatgtcttaatttccaaaatggactgtaggccaggagcttgagaccagcctggccaacatggaaaaaccccgtctctactaaaaatacaaaaataaattagccgggcatagtagcaggcacctgatactcaggtggctgagacacaagaatcgcttgaacccaggaagtggaggttgcagtgagcccagatcgtgccactgcactccagcctgggctacagagtgagactctgtttcaaaaacaagcaaacaaaaaactgtgcttaacatagacacgataatacacttgatcttagccaaaaggccgggaagtaaacacacacaataaatattgacttatcacagcaaattcatatatttatatgttacctaaaggggaaaaaaaggttcaaaggaatttagctggctaatttgcaaaaaaatacaaaaataagcaatactccaactgtcatgagctatttctgcacacagctaggatcatttttatatctggcataagcatagcactaaatcaaagtactagatgaacagtgatgtcaagtacagctacagcaaagtaatgtgctccttggttgtaaagactctacctcacagcacactttggagatgctgtccgcatctagaaataaacagattgatagccactgagaagaagagatgctatagaaatagcagaagcaaagattcaaactgtactgaacaaagagacacacacacactatggagaatgaaggagggatgaaatcatcatttgttccagtgtacctgaaaactgcaaagcaacactctttcactaatagcatgtatcagtaaaaggtttctctatttatttattcaagactatttactgagtaccataatgatgcaaagactagtaatgtatatctgcaggggctgcatcaacccttcttctgaagattttctttgcagtcctcaggcatacaattcttcttagagctcatagatatgcagaagtttcggtcaaaatatatactacaaaatactagtaagtatgtatttcaaatgaacaagaattttttataaaagctcatgaaatgagaagaaaaagatctatgagacagatattggtgctcaggtccaaaattttccagatggtcaaaagtgctgaggcctggctcatacaatcaagggaagatttctaggagccacagctctctgagctttcctggaaacagctccctcttcaatatgtggcagtgtctggccaagatgaatctctgactctggcacacagggtccaggcagagccccaaaagccatttggcaaagaagaattcacactacaattgggaaattcaaagaaaaatacccaatagtttctttaaaagatcatttggcagggacaatgagtcctgcaagtgcctgctcacctaatccctcagcaacctgtcttttctatgcttcccccgcttgagtaaatcttgctgaagggaagataaaggacaaccaaaacagctaacaaaagaaccatggtataaaagcttccagaaatgtagagagaacacacagcaatatctcaaagaattcctggctaagttgctcaatttctcccaggcttgggggaaaaaaaaaaagacaaaagaaaagaaaaagaaaatcctccttaggatcaattatagctcagggtagactacagttacaaatataagaatatcctgaagctttttgtggttacactctccagtgctcatggtctaaaggccgagctgaggcagactacagcaaataaatatcccatgaagaaatgatacaaagagtatccagaaatctccagcttggaaatccaaacagtagtttaaagagttgaccatcaatcctatgtcaaatttacacataaaaatacaggttaacagctttgtctatgggctgataagtaataaggaattgaacactgggaccatgcaagctgtgaaggctggtagaaccaaaggggatgcagctcaaaggagcagcaatgaccagtctcgaaaccactggcttctttgtaaatctttgggagtcatggaacatttgagaactgaatgcatgtgtgcaccctctccttaccaaaccaaaccaaacaaaaaacatccatatcacacaaacttttgcagacaatgtcagggaattacattcattgcagggcccatgaactccccgttaggcacccattaacccagattaagaaccccatcgtaaaagagtaagaaagttctaagagcaacaatggtaacaaaatggatccatctaattaaactacaaattacaccgctggtcttaagatgtcatcctttcagcagaagaacttaatagatgaagactcagaactaaaaaaactttcacatgcagtttctcgtgaaacccgtactttgaccacaaactggtccatgaagcctaatccaagagttcctgttctaaccatgctggtttcaaacagtgctggatattcggtattcctgatggtgtgagaaaatgcaagcaaatctgatctgccacatcccttatgtaacaccatccctcatacattgctgattcttcccctaaatggaaaagagttaattggtctaacctgttctacaacatctattcatactaggtcttctgcagttacctgtgcaatgcaacaaacatacaattttataaagaaattcaaagcagatcttctgagtgtttttctggggaatctgaacacaactttgcccaaagtcaaggacaactctaaggagcacaaagcctctgagtggaaacactacctccctatctctcacttgggaagaacgtctttgctcacattatcagcagaaaataacaaggacaatcttttctggaccttgttatagtgaaggcttctgggttctccaaaggttatctttgataagcaaaaactatctattgtctcaaactctgtagattactttatgaaaatgaattacaggaagagggggaaaccctacttgctttatggaaagattccttatgaaaattgttttgaatttcccaagattcataatatagatgcaaggcatttctaccatagagatttcagaatatgaattagttagaccccctacttctggggttcattaaaacgaacgaaaaagcaaagtgagcaaggcaactgatatgctagtctaacagctgtccaattttgctaacgtgtcagtgaggtccatttcaacatttctgattcttagaacagcccctgtgggctgttcatgaagcaatgaagtcatccaaaacactaccagggaaactcttattatctaaaaccagaccaaataattctctgaaatggatgattcaataatcagtttacactaagataagaaaagaactccaacagcgtgcctacaaccaagacccataaaatcacatgctggtctgtatatagccatcatctgtcccctcttcaggggtaaggagacatcccacttggcaacaatgttagtagtaactgaaaacatcctgaatctgggtctcccagcacccacactttgcacccacaaatggaaaggcacaaacctatttcaggacactagggtcccactgaactcaaatttcactgacatttgggcaatatgacttttaggaactcaaacctgaccccagatggatctaaaatgtgcaactgactgctaggggtgggaacagtatttacttagttgctgctgcagtatttaaagtatattctgatctaaggaacccctacagctgatattttattcaccattgcttgtccttcaccatttgggaattggcataaaaagattccctcaaaatatttttagagaactgggtgtggagctttaaaatttttcctttttatttttatatttctctgaatttctagaagaatattaatcagttggtgctgaattcaagaaatcttgacatacacacacattcccccccacacacacccagggtccccatcctgacctggggcactcaactaaccattctccttggtcaaatggtatcaagctctttcccaatggttttgtcttgaaaccacttaaagtgctgagaggggcactgtcagtctatttcaaaactaatctcccttccccccaacaaggacatgattcaggattccctgagagcctctgaaaatcatctaatataaccacaaaagagacaaaaaaaaaaaaaaaaaaaaaacctaaaatgaaagtctgaaacgggatgcagaaataagctctgctccatattttgtatgccctggaaaaatactgggaactaaatttgggttgggggttgaggggcaagagctcatataaacagaggagtatttatgaaactacaggtcatgaccttctaaaggggtcctgggagccgttgcaaggagattccagagacccaggcccttccttcccagagcagccacagctcccccggctgcggagaagagaggcaggcaaagcggagaccctgatgtgtgggtggttcgggtggaggaacgctgctagtgccctcagcaggccactactgatgcaagtctgaggacacagacaggcacttttctatcattctttggcattaagataggttgtgtgaatggggtactgtgtacatcactaacacaccgcagccttgcaggattctggcctaaagtgcaccacagtgctccggatggacttgtgggtccagctcacaatgccatctccagtaaaatctttccccctccctcagacagagccagagctctctcagacagcactggtgtttctacctctgcctctgcctggcactataatgaactgcttagatcaagcttgtccaacccacggccacatgctgcccaggatggctttgaatgaggcccaacacaaattcgtaaactttctcaaaacattatgagatttcttttgcaatttttttttctttttcgttcatgagttttcattagcattcatgtactttatgtgtggcccgagacaattcttccaatgtggcccagggaagccaaaagatcggacgccctggtttggatgtttgtcccccctgtcacagtataaattcctcaggtcattcttcaagggcagaaactgagtcacactcatttctgcatccttaggcctagcacagggcaggacatctagtaggcagtccacaagttctctgaaagaaggaataaaagaaggaacgaacaaaagttattaatgaaatgtgactaggataataattacagagtcatattgacctgtttttctggccagaacaagggggttggggtgtatatagtaaacagaacattaacacacagtcaagataagcagattccagctactgaaacaaatgacggagatgcttcctggaaggtatgctggacagcatgccaaggccactcccaggctttgtaggacaagccaccctgatcatcatcctctctgtgtgtaagacagcgtagaatggcacttgggccatccatgggaaccataaaaggcaaagaaaagaaaatagaaaatgtttgttatcttaaacagttacgcaaataaaaacacataaaatgtaaaaaacctttggagcgtgttttcttccttagggatagataacaaagataaaatattttgagcaaatattccactatcttttagaggcatagaattttacacgggtttgcatgtaggcaattaagtgtgttagaatgattagaaattaaaattttagacaaactgaagaaactcaatatttgcaaattgattaaaatggagggaaagtttgctttttatatatatatattccctgtcacatttaataaatacatccattcagatcactttttgtttttaacactaatatgtaaccaaagccccatataactatgtgctatacaaacgtatttcctctcaagttctcctttttttgagacaagatctcactctgtcgcccaggctggagtgcagttgcacaatcagagctcaccgtaaccttcaactcctcaagtaatctcctgtcttggcctcccaagtagctatggccacaggcataaaccaccataaccagctaagtttgttttctttttttttttttttttttgtagagacagggtcttgctatgttgtccaagctgatctcaaatcctggtctcaagcaatcctcccacctcagcctctcaaaatgctgggattacaggtgtgagccacacagtacctagcctaatttctacattttataatgggcttcaaattagctttgctacatacctgtttagtaagccagtatgctcacatgtatatgtctttaccaacaacagaatgttagaatggcctgtgcatcagtactgtgatgtatcaaactgcataataaagagaatcactagagtgatcattagaagctgatttacaaaataagcatagcaggaactcaattcccacaaaatctgagtactggagtaatcattccacctgctacgtgcagtcagagattgaagctgtcctcactgggttaacaagaattccggacagaaaatataattaagcattaacatgctgctctttgacctagtttcttgtaaccaagtcacatagcactagattctcaccatttgcatccccattgctcctatagatagataggatgtctgatgttagaatcctaagggttttgtttgagagttgcatgagcagatcctgaattccaacgggacagctgacaccaaccagtttaaagactcccacaaaggaaccaccaaatcagcatgagaacacagtttcttcatccccctgtcccacgactttaccctgcactcttcgacccatcaacaatctccatatttcagcccacccaaaacccttaaaaactccaaccccaaactcctgtgggagatggatttgagttttcccccagttcagcagctgtacaattaaacctctgtctctgctgcaacctggtatctcagtgtattgacttgccacgcacgttggacaatgaacctattatggctgtaagatctcaataaggatttctgtttaagcagcatcttaaagttagttaatttgtaatagcaaaaacaaacaaacaaaaccccacaaaatgcagttgtagtcaggtagcgatttaagatgctctcagcagcaaaggatggcatttggattcccctgggctaaagtacaatcttagaaagtatattaacctgaagctggtaaggaattctttaggagtacagtgttaccttgctagcagaaatcagaaatccagagaggagtaattactaagacatgaacattcaaaaacaccgcacttggattattgttaaaaatcatggtggcagcagtagtaataaccatcatcatcatcatctcctaaggaaagacaataggtagatccatggctcctgttgagatttgctgctctcatcaaaaggaagtgctctgcgtaatatctaattactcccatcttaaaggtaaagaaattggtgttcttgccaaagtcatatggctagaaaatgacagtgctggaagtagaatgaatgtctctccctgtctgtctgtctgtctctccccctacctacccacccccatctttaatcttgggtgttagtcttgggacatagaggagaatgggaagctgctctatagcagtaagaggcaggaactattttactcctggaaactatatacaaactcagcaaagtaacttctcaattctttctggaaggagggataaatgcattaattactgttttgtattttcacattggatcacagaaaaaaaaaaaaaaagccatgctctttaagatgactttgtgttggccgggtgcagtgactcatgcctgtaatcccagcactttgggaggccaaggcaggaggatcacctgaggtcgggagttcaagaccagcctggccaacatggagaaaccccgtctctattaaaaatacaaaattagccgggtgtggtggcgcatgcctgtaattccagctactcaggaggctgaggcaggagaatcccttaaacccaggaggcggaagttgagttgagccgagatcatgccattgcactccagcctgggcaacaagagcgaaactccatctcaaaaaaaaaaaaaaaatagaagactttgtgtccagaggatattactgacctatgtcctgttgacccatctcttacagcatccagaatctgctgccttgtattaactttgtacatataaactatctcagagcatggggtgggacttgtatttttatcaccttagaaccttgtccagtatctagcacttacaggaattacattaatatttggtaacgaatgaatgactgaatgaagaaattgataggttttggatctgtgtccccacccaaatctcatgttgaactgtaatccccaatgttggaggtggggcctaatgggaggtgactgcattataggggtagtttctcgtgaatggtttagcaccatccccctagtgctgttctcatgagagagttctcacaagatctggctgtttaaaaatgtgtagcaccttgcccttcactctctcttcctcctgctccatccatgtaagatgtgtctgctttcccttcgccttctgccacgattgaaagtttcctgaggcctccccagaagctgctatgtttcctgtactgcctggagaattgtgagccaattaaacctcttttctttataaattacccagtctcgggtatttctttatggcaatgtgagaatggactaatacatgaatcaacacacacattttaaagcataatttcatctcttccaagatctacattttcttctaagttggccacatctcccgtaacccaatcctttgggtcactctgccttcctttctaaattacaggcagtttgacctggtggttaagaacagtgactcagagccaggcattaggttggaatctcagctctccacctacccaccctagggcctcgaggatgttaagactctactcacatcagtttcatcaattgtaacatggggataataattgtatctattctatcagatgtcaaagggttaaatctgtcatttgtcgaaagcacttagaacagtgactggcatctggtaagcactctctaagtgttagctattattacttctacccactaaaaccacagctgctattctccattcccttggttcctatggaaggaagctcttgtctataccatcctccattgaggcttcaagtcaaaacgggtttcctcatagtcctctaaacatcaagctgctggcatccttggactcggcccacattctcctcctaaaccaacttctctctgggcacacacgggccctgttaaccttcccctttgcccccactctctttcttccccacctggccaccccacttcctgagtcacgctcccaaagcttactcacagcactatcatgaccaacaacatctccaaggctcacttcactctagccagacttggagatacttcaaaggccccacatgattggagagaaggataagggagctgtgtttttgttttttttgtttttttttttaatacaacacatcctgaaggggatgccctgtttccatgtgtgtattttactctgacacaaaccgatcactctcaggcttgaacaagctcggtgaagacctccaccagatacaaaaccaaaaaggccgagacagctgcaaaggtttctatttccctagagatgggagtttcatggaaggctaaggatcaccacagcaaccagactacaaaaacagtcgtgggcttcagcaccgtaactctggtaaagcaatttgtgctctgtgaaaggctggggcacagaagttgaagaatgatcaaagtaaacactgctcctcaggcaccattttgttgtgctgatttcaagacactgagtctcagcatcaaagttctgttatgaaagatgcgcatcaagtgccaaagatttgctaggctggactgcctgccctggtgcaaaggtctggagagaaactcatagcacattttccaaaacaaccatttcaaatttgctctaagagcagaccagggtaaaaatgtatgccattatatcaagttaccctgcccatgctagaacaactgttgatcccaaccctggattaaaaaaaaaaaaaagagtgggtgatttttctcataaaaccctaaatagactttatcccatgctgaacttacatagactgattcctacagatttaagaaaaaattacctaaactttattaaacaccaattgaaaaaaatcacctgttctagtctctgatctgccaccctaaatctatactgcagtttacataataaataagaaactacagcatactatttctacactctatagaagcagcaaatatagagtatagtaactaaaacagaaatctcttcatggatttataagaggcttcaatatttattagtatgattaatttaattattaactatgttaactatagcttgaatatataggaacttgttctttttaaagaaactcaaattggtctacctgagtaatcttacaatatcctcaaaaattaggttaaaaaatatacaattcccattagcaaatttatagaaaaatccttcagacctctgttatgttggcagtacacaatgcattcctaaaaaacacttagtggtagtgagaaatctgtaacttaaactgccccaaacaggaacactgagaaatacaacaacaaccatgtgatgtgtacacatacttaccacaccccttttctctaggatgtgtcccatgtatagtgcgctgctttctgaatcttttgtggggaaggggtccacttacacaatttctggagtttcagcagaggctcactcagtaagtcagcagggactctgcaatccacaaaatttattgttccataggcccctctagcccagcagtttgcaatgcataagaggtaattagtaatatctaacacctaaatgcttcacagacaggaatgaatggcttggcttacgggcttgctcagtcttttctagctgcaccctcctccttttatctctaggttaataagcgtgaagttactaaactaacagggaaaagaggttctcatgttatgttttgcgcatttactattcattcctcagaaactgaatggctactatgtgtaaagcactttactcagtcaatccttcccaaagtgtggagataataagaatgttttaagatatactttatgtatatatatttttacaggaattaaaaacatgatttcatgtttaggaagttgaggatgaagctaaagtcattttttaagtgagtagatttaagaaaaaatattatgggccggacacggtggctcacgtctgtaatcccagcactttggaaggccgaggtggatggatcctgaggtcaggaggtcaagaccatcttggctaacacggtgaaaccccgtctctactaaaaaatacaaaaaaattagccgggcgtggtggcgggcacctgtagtcccagctactcaggaggctgaggcaggagaatggcatgaacatgggaggcggagcttgcagtgagccgagatcgtgccactgcactccagcctgggtgacagagcaagactctgtctcaaaaaaaaaaaaaaaaaaggtaaataatgcaaataatatatgaatactacacaaactgtgaagactaatagcacatataaacttatatttgggaagcaccactaagtaatgaaaggacttcaaatgtgagtcagacacaatacctgccctcaagaagctcacagtttgatgggggcagagggacaggcagatacaaacacatctgtgggcagcaggaagggggcacttcagctgggccagagggtgaatggggaaaggtggatctaaggggtccagacaaggagaagggcagtggaggcagcatgagtgggtgtgaagaatacttaattcagacggagctaaggaaatacaaaaaagaataaagaagaatgtcgttgaaagggtactggagccagatcacaatgagccttgaaagccaagcttaaccagttaatgaaagacgatcatttgcttttcagagacatagaccctgatttgcttcctgatagataatgagtacattaacttctggcttagtaagtgtcacttagttaaccacattactgcactgattcactaaatgaacttccattacctgacttacttgcccaaaagaaaacatatcattcataaatctaataacaattttaaatcccatttttgtttaggatctaaagggtacctttagattgttgctgaattaccaaggaatatcttgcatggtgagaaaaatcaaactctagccctcaaccctaaatctcctagacttgaggagtttgttccttggctttgtccccaggtcatagtccctcaataaacacttgttgagtttggggtataaccataaactatcaatgaattaagcaactgagctaggagccttgagcatttctataaggaacaacttatagggcctggtaattctggtcctggttacattattttatgtaaaagtctgtaagttctatccataattctctactgtgtaagaaatgagctgaattaagcctcttatctatccctctactttatcatctctaaggtgaaaacaagttaccattgtagaatggtgtacaatgtctttctgagatgccctcttaaatcttggcaagacctaccaatacaatattagcatcttcagtacacatttcagacaattttaggtcagaatctctctcattcttttcaaagaagaaagtaagtaaattgttggcatgaaattttagaacaaaaataggattgtctgatttctagaaaataatcatttgttgtttgccctcaaggagaaaaaaagttaattgtctgagaaacagaggaaattaactttcactataaaccacaaaccccggtgctccccaattttgccttcctcctaatgtaagatcctgacatatcattcattttaaaaagggggttaggcacagtagctcaggcctgtaatcccagcactctgggaggctgaggcggacagatcacttgaggacaagagtttgagaccagcctggccaacatagtgaaactttgtctctaaaaataataaaaataaataaataaatgatttttttttttttggcttaagtatcttactttgggcttcagtctccccataaatgaaaaggttagactctatctctatggccacctataaatctagagcctatggttctttcagcaactaatagagtcagtaaaagtcttcaggacagatctctaggccaggcacagtggctcatgagcattatcccagcaatttgggaggccaaggcgggcagatcacctgaagtcaggagttcaagaccagcctggccaatatggtgaaaccccgtctctactaaaaaatacaaaaattagttaggcttggtggcaggcgcctgtaatctcagctaatcaggaggctgaggcagggagaattgcatgaatgcaggaggcagaggttgcggtgagccgagatcgcgccactgcactccagtctgggcaacagagcaagactccatctcaaaaaacaaaagatctctagaaatgaatgtatctcaataaatgagttgatgtgactgaattatcaatttcataaatgccatgtcacactaaaatgatctgtgtactcaattaaaaggaacaattttaaaaagtttagtttagcctgccaaagtgaatactagagaacaaaatagaagtgctttctcctttcaacaagtgaaaatgtcttgaaatgctggcttgaaaaattaaataatgtttgttttagagagtttctttgctttccttaactttaattctgggtcagtgtgcccacttagtcttttacatttggcagaagcaaaacaaataatgaaatactcaaagctaatcctaagggtaaaccatgatttacagtgcattttaaaataggaagtgttgacatggtagtagtctaaaaacaagttaatatacttggtcttgctaatttcttttagatatacttttctttttttttttgagagtctcactctgtcacccaggctggaatgcagtggcacgatctcggctcactgcaacctctgcttcccaggtgcaagtgattctcccgcctcaacctcccaaatagctgggagtacagacgtgcgccaccagccaggctaatttttgtatttttagtagagatggggtttcactatgttctcaagctggtcccaaactcctggcctcaagtgatccacccacctcggcctcccaaagtgctaggattataggcgtaagccactgcgcccggcctagatatacttttcaatgagagagttgtataattgatactgaaagatgagcaggttttttttattgaaatataagtttccaataaatcaaaatatgatttaaaaaaaagagtaaatgcaaacaacagtatcccactgtcaggttctcaaatgccgttttgatgggataaatcctcctcagtaaggacaatggcattttttggttaaaccctacatcactagtctgagaacaagtctcggtcatcacaatcgactcatgcggtgattgggaattctttcagggcaacaggcaatgtgttaaatatgcactgttgagtacactgtgcaaagttatgaaattctctctttccctcctgacatttttttttccaagtacttcactggctactccagaagcaaaggaatagagaaaagagtgaaatcagaactagtgagtggacttggttactgtaagatcactggtaaaagtctgaaagaaacaaaaggataaaaccaaaaatgaaatttatatataataaaatcattgacttctagtgagaaaggagattttacagacattctactccaaatgtttgttatagataaggaaattgaagcccaaagaggtcatgagttgcccaagttctgtagctggttatggcatggttgggactagagcccaaatatccactctagtaatctagtttctacttcccttgccagtggaactattcgcatttctccttatagaaccaattctccgttgttagcaaacacggactccccaagtcttcagaatttagggtcagctcttttaatcactagataagaacacagaaatgtaaagaaatgccaagaaacaacttcttactccgcagggccccacgtgatccaaccctcaatgaccaatcgcacctcccaccactctcccccttgctaactccactccagccatactggcccctctctcatctccaacaagctgcttccaagctgagggcctgggccctttatttggcctcttcttcacccagatctcggcatagttcacgccttttcaccattcaggtctcagttcaagcacgcttcctctaagaagcccttcctaaccaccctaacaaccaactcttcctgtcacttgaatacccaggtagctccacaacttggtgctgggaaatcctttcatttacatttttataaaattgaagggaaaagacacaaagcctgttggcatctatcccaagaatatctcctgggcacttctaagtaaaggccactgccagcaaaacaaaaataaccaactttcaacctactcaagacatgcaagaattcaagaccaaatcagaatgcatcccagagttcacctgattctgccagcaggagccctgcagtgctgaatttctgggcatgtgaatgatacattgttgtactgaaacattcattttccaagattcctttccaaattcaactccatggtctttcttttgtctgttttgctaaagggcaaaatactaacctgtttccaagctattcagcaatattttggcacaggtaatccagtaagagaattgtttgtatagaacagagctgatgttaataacagggtgccctaacctgcccctctttctaagctcttcacctatagatgacagcccagctattcacatttaactcttacctgatggctgtttcattgcagctcaaagacttacctgcatatgattaagtcaacacgcaacactgggtgcaacatctaagcccacatttaagcaaagtaaagagcttgagatcatctaaatgggagcgggagcaagggagaactcactatccactgtgtttttgttacctttggcaaattctcaagggtagggggtcaggactgccagtgcctggcactgtgcctgacacattacaaacaggtgcttaataaataatgatttcattattgaataaatgcctaagccttgggaaagcccaccttgcccagagccactcagagtgcatgtcaactccatctataggaagtgtgttgtgaattcaaggttaggttctaccaattatttcccagctcatgaccttgggtagaatacttaacctctcttagcctcaatttccacacctgtaaaacagagctaacagaatctcccttccaggggtgttgaaaaaaacaaataaaatgccaggttttgtaattctctggaaagaagcctaccagcgtttgactttggctctgatcagtgtagtgccattacctcctgcctacaggtccctggattttcaagcagggtgacaaattggtggcagctgcatacatgaccctccaaacacttggcttcctcatgaggaactaatggttgttctgtcatttgtctgcttttccttcacctttgggatttggagctcattaaagacgagggccgaaaggtagcacaaacatcaacatctttgctagttgttcctgttcaggcaccactaacctggacaagctcaggttttgctccccaaatctcaccgtagttctggagacttctgaatctaacaaacaaaggtcctgggaagaccacattcattccacacctgaccccaacaccacatctactctgaggttaccccaaatctctgaacaaaaactcaatcacctgtgctcgctgcctttcctccctggcaggtaccttccaaaaaaataggaacataggaagtgccaaagcaaggaactgcttccaaggcagctgacatcactggattgtgaggtaaagctagaggtttctcccaatctgtagtggggaaatctggggacaaacatttatcttcagaggcctgtctacactgccccttccagtgtcacaggctgtcacaattcacctggctttgaagacctgtggtgttcagctgaagaccattctcccagcatcaacaccaacaggcaaaaccatcagatgaagctttcacagctgccaaggtacttgctgtcctcaacatatttcatactcaactcggctctattttatttaccagtctcctcccctagtcttggaaaattctcctttcagccctctgccaaaccacatccccatttcaaacctttccaatttctcacctccaaaaagcagcaccaggcaagcacacctggctccaattattccagcaatgccttcccccagccccagccccaaccccagctctagccccagccctagccccagccccacatccccctaacatgcctgattacttagcacttaacgtgtttatctcagcccagctgtagttgattacatctatttggttaagtttctatctcgtgtatttagggcgatgagatgtttctacgtctccgtactttctgttacaggtgttgctctttgtccctggatgcacggtgaccgtgagctccgagggctgcctgtctcctcactcctgcaatgctttgcaccggtgcccagttcacaaaggcagctgcagctgactgtccaactgcctggttctaatttatgtggagagaggcctccactcaacaaactgaaataattagttcttctaatcttctgcatttcaataaataaaagaaagacagggaaagattcacatgtactctgtcctgacgaaacagtagagctctttggaaaatcatgaaatttttactgtgcaaggcagtaagatataagcaatgaaactcaaaagcattttcccaagtattcagagaccagatctgcccccagatctgtaaatcctacttaatctaggttaaaaaaaaaaaaaaaacacacataagaagacatgagacacccttagtttacatttcagctcttaggtggttccttattcactgaatgctgagggtttctttaaggatattttgtagtttaacaactccagaaatgcttttgactctaattctcaattggtattttgaaatattaattttctcaatgtctttatattgacagaaaataaaaaaagaaactgagatccaaatgggtctacacatttgccctcaagtttaaacaaaaaagatcacaacagagggaagaccaaaaaagagggaagtcttttattaagactcacaatccagtgctgtcttctataccttgaagccttggtttaagaaacattactttatgcccaagccatacataccaatatcaataactagatcttcaaaaaatataattaatgagaaacttccatatatagaatttctagacttaacctatttgctaaactgctacatcaacatacttatttattcatgcaaatgtttatttcacaaatgtttcttgactgcttactatgtagtgggcactgttctaattcctggcaataccaactaaagataaaacatctatactgatgatatactagcagaagagatagacagtgaacatatttaaaaataaatatcaggtggtaatataagttacattttaaagtaaaacagtaaaagagagtgtgtctgttgtggggtgctatgactattttaaatggggtggtcaatgaaggcctctcagtggaggtaatggcaaagcagggactgggtgaaggcagccacatgagtaactgggagaagtacttcaggcaaaacaaagagcccatgccaaggacaggaggcaagatgtcagggcccactgcagcacagtgagcaatggtgagagtgctgggagaagggggaaaagatcattcagggctctggtggggattgcgcattttcattgaaatgtaaaaaaccatggcaggaagctgaactggtgaacttcgtgactggacggaagtctttcaaaagatcatgctggctgccacttagagaatagatcttaattgctaacaatgatagcagctgacatttatggagtgctgatgatattccacgcactgttctaagcaccagtcatgctttaattatttaatcgtcacagcaactctatgaagtagatactatgattatgcccacatgaggaaaatgaagcataaagaagttaactgacttgcccaaagccccacagctcatgagcagtgtagccaggcttccaacactggcgctctaccccagatcttgcactcctaagagggatgggccagaggcccactgcctctcaagtaaaaatgtgatggtgggtcagaccgaaggtggtggtcagaagtgggcagattcagaatatggtcttagggtagaacaaataggattggatatgacatctgagcaaacacaggaagtcatggataataatgccaaggactgtggccctggcaactgtgtggtagcgtcctttacagagctggggaacacaggagtaaacaaactggagacaggagggagcatggaactcaaactaatgtgagtgtgtgctcatttcccatactgctgtaacaaattaccataaactgggtggcttagaacaacagaaggctattctctcacagttctggaggccagaagtccaaaatcagcattgctaggccaaaaccaaggtgtcagcagagccacatgccctccagaggctccaggagagaacctgttcccagcctctttcaggttctcgtggctgctggcattctttggcttgtgggttccagaccaccaatctctgcctgcatggtcacacagtcttcccttttgtctgtgtcatcaaatccctgtcttataaggatacatgtgactgtatttaggggccaccagataatccaggataatcctccatctcacaattcttaatttaatcacacctgctaaggctttttctatataaaggcaacattcccaggtttaggggttagaacgtggatatatctttgggggccattatttagcctatcacagtcaggaataccacaaataaaaacaataaaacgtacaggtgtggataaacagtgagcaaagcttttcccttttacatgagaatttgatcttctgttaactctctcaattctgtaaccctggtaatctggtaagacaatatgtcaattataacacaaggcagcttgctattgggactggaaaattttaagacatctgataagaagtgacatctgggggcttccctgagagcagtgattcttgtaaatggggcatatttatgagacagagtaccatgaaaactattcctacatagttgcctactagttcccgcaagggtctaaggctttttttttttttttttttttttctgacatggagtttcactcttgttgcccaggctggagtgcaatggcatgatattggctcactgcaacctctgcctcccgggctcaagcgattctcctgcctcagcctcccaagtagctgagaatacaggcatgcgtcaccatgcctggctaattttgtatttttagtagagacgggtttcaccattttggttaggctggtctcgaactcctgacctcaggtaacccacccgcctcagcctcccaaagtgctgggattacaggtgtgagccactgcacccggccttcctaaggcttttaaactagagaactacacacacacacacacacacacacacacacacacacacacacacacacagagatctcatctcctggcatttgagccatcagctggagagctctggatggctatgtgaactgatgaactgatgtgtgaacagtcacaaggcacacaacaaggaggaatgccttgctgccatgccgtaagctgtggtccttgtcctatacccttttaagtataatgaagccacccatggcctatgatagtctcatgggtctgaatgtttatttggacccaagaagactccttgcctgagtttgttgccacatgtaataatatcgtttcagttcattatttccatttcttcctccaccacagttactcagcagcaaaaaggagtagagcatttgtttcatctgttcatgctcttgtgtggcctcactcaaacagcaaaatggctaaaaagggcaaagggaaaggaaaagctagagaacaaaaattagtaaattcacaaaaactgagctaactgttccctcagggagaagtgagtactgcctacaaggaacatgctgcgctgcctgtgctatgccttccagaggcctctccagcagaatgaaatgtaaaatccctaacccacagttctgctggaaatgtgcaagtgggctcattactcagagccaagataaaggataaatctttatgagtaccgtaagtatgagtcataaaaaataggaaacatatgtaggacgtatacacagtaatagcaccaagccagagaaagtgtttaggaaatgtatttaagaacacatgacaaaacaggacgaaaaattgcccttgtacattgctctaaaacacatttaaaaaaaaaacctcacagcaagtcaagggcccatatcactttgctgatctctaataaacatagatcatttccatatttggaaataggctggcctttttattttaaatgcaaataggagagctgaatcaagaaaaagtaacttggagtaggctttgaaagattttatgatttgggaaatttgaagagcttccaaataaaatactgggaattagatcttaacagcattaaaaatgaacacaaaagattcttttagaaaaataattgttcacaatggtaatattaccatttcatttagattctcactatcttaacaaccactggaaaaatgagtggaatcttcaaaccttatgaaagcaggaatcaaaaataaactgcaacacatgggctgacaacataccgagagcaatgaagggcctgcgtgaaagccctcacggggatgctgggctcagcaggaagaactcgcagcaaggaagaagcagagccccctggccaaaagcaccaagtgacaatctaggggatgagggcgttcagaatagaagggagggtgatcggcccccagaagtcttttggggccagatgactgaggcaaaatgtatcatcattggaaattaagctcttcagttgcctttgattttggaagatgcccgaatttaagacagcttggcaaggctaggagacacctacatgcccatgtgcccaacacggaatcatgtgtgtcccaacggacctttggctcccttggaccagggctttctcctttaccttcagaaactgctgcctcccaaggaaagcactgcttgcacatcgactgacctgaggttgagaggaggagcagaggaatgtggaaaggattgtttttaccttcattaagtgttaaatttacctaagactcccagagagtcaatgctcttcaggaactattctgaggcagaaatttcaatataacttccacctcatgaaaaaatccaactgtaggtcattaaaagaccccaggggcatggcgagggctgagaggtacgacagctcactttcgaccttttgtgctcaggcctctcagcagttgctatacctctctgcccctctcccccaaggcacctcggtatgtgctcacatcactggtagtgaggccacacctcactctgggagggggactcaccttttaagaagacatcgatgcagcttccacgtaaacgggtccacaggcatgcagtccctaacctgtggcaagcccagtgctaggcacagagaaccgacagccacatcaccgacttgctggagcaaattcaaaatggatcagatgtgtgtacacatgtatcaacaaatagaagttaagccataatgggcacaaggggacacttcagctccgggcaagagttaggctatggtagtgaccttggatcctaaagctgggctctgtccttgcttcacagtgagaatcagtaacacctcatctcattagctctcttatcttcaaaagtatccaagtcatacctgtaatttgcccctcatcctccaagagttgtacaaatttcaggttcagctgaaggactctgtggttcaggtggaaaaaaaaagccataaatacaaagcattattgtagggtgctttggactagaaccctgtctaatatctgggccttgatatttcagcctttcagacaaggccaaggagctcagagacaaggactccttcaatcagccagcagtgccactgaggtgccccggcgggctggacaggaaagcatggagaacatggctgcaatggaagccaaagcagcaggtcttccaaacacagactcagatgcctgtgtctttaagaccagaccctcataaatggattgcttctgctggacaccacgctctaaataaacagactcttctggccgacacacaacttcctgtaggattctggtgggtaaagcttgaaaaggctgccaaatccaatgaccagcaacttttgagctgacttagaaaacaagctacaaagacttgagtccagagtaaacaaaggaaaaagccatattaaacagggaacaaattactatatcggcagggatattttaagtactcactgagcaagaaaacaaaatcaaaaaaatcaagttataaggtatttaataatacacggtagagtaaaatgccctctttcagttagaggaatcaaagttaattaattccagcaatattaagaattggctggagtcaccccctacatcatgaggacagatcattctcaatggcccaacttcaaacctggctcagatcaaatgagcaacccaagggagctgcatagagttgaaaaccatttatagctttttacccagctgacggaaaggactaactagtttactagcagatgactaaaacccctcagagtaaagaagaatgtaacaaagatttagaaatgggctagggaaaagactgaacaaagatctgcagtttagagtaaaaaataagattaattaaaagagatttaattaaaaaagtaaatcaaagcagtcatacaaaatggaggacacctgcttagctccaatgttgaggggcctagggaccaaacactaagtccactaatagaatgcaaagcaaataaagatgcactatgcaaaaggaaagtcatttaagaagactttcagttatactctaaataacatccttggtgccatgcaataacccaatttgcataatgcaaaaaaagacccaagacctagttcctgcccgaaagcagtccactcaccagctgagtgtgcagaattaacacacacgattcagcagcaagtaatacaataaaacatataattccatactgtgggaaggcacaggttgtggtagggggaagaagattcagagcgatgtttagaaaagaaagaaatggaggagggtaaagcaatcaggcaagggtttggtgaagagctaagacctaagcatgggcttccaaagtggcaagaattgagagactgaagaaagaagtccaggtggaattaagaataagggcgtggggcaaggggtttagctggtaagcccagggggaggctcaggaatctatacatcaagggatccgatgcaggggcttcacacagcacacacactttgagaagccgatccacaggattaagtccaaatccttacgtggcctttccagtctcatcttccactcagccccagcctacccccttcattgtcttcatcctctattacaggaattgccaagctcttcctgcaaagggctgaatagtaactatttaaagctttgcaggccatgcaggtctctgacacaatactcaactctgccacagtagtgagaaggcagccatagacaacatattatcaaatgggtgtggctttaaaactaataaaactttaaaaacaggcatcggactgatgaatgcattaacaaaacatggtatagccacacaatgaaaactacccaggaataaaaaggaatgaaacaactgatacatgctacaacatcgaggaacctcaagtgctttacgctaagtgaaagaagctagacacaaaagatacatattgcatgatcccattcatatgaatgtgcagaacagataaatctagaaagtagattagtggctaccttgggctagtgccgggtcgtggggggcacacacagggaatgggagagtgactgttaatagatacaaggtttcttcttagggtgatggaaatgttgtaaaattagattatgggccactggttgcacatttctataaatatactaaaaaccactgacttgtacactttaaacaggtaaactttatggtacgtaaattatatctcattaaagctattttaaaaacacaaacaggcagcaggcagaattcagtcctgcctagcacccttgatctgtccaccagccacaccgtgtaggtgaagaactttcctccacacctggcgcccactctgtgtatattgagtcctcccatcccttggctcaacaacactaatttgacttttaagccctccgtcaaatgttctttcttctgggaatccttccctcacttccagagagaatgaacacaccctttgttgggcttctgtacttttttttttttttttttagacagcgtctcgctctgtctcccaggttggagtgcagtggcgcgatcgtggttcactgcagcctcaaccttcgggctcaagtgatcctcctgcctcagcctcccaaatagctgggaccacaggtgcacactactatgcctggctgtttgtatttttgatagaaacagggttttgccatattgcccaggctggtcttgaactcctaagctcaagcgatctgcccgcctcagcctcccaaagtgctgagattacaggcgtgagccaccacagctggccttctgcaaatttttaaaatatattagtcatattatttgtcatgtttcattaaattcattctctctcaactctaataggtgctaaagacataaaaatgagtaagaatctggcagagcacctacctagcacacagtgggttcttaatagtgattcattgaacaggcctgtgaatgaataaacaaattcattatgagagcattatttagagaagtttggttttatgaagaggttcacaagctagacagaaagaatcagggtctaaagctgaagaggccagtcccaggagaccagttaaggaggctccagggtaagtggagaaaaacagagaaattcaagggcaattgcagaggaaatgtcaataaaatgtggtgattggccaaatatagggtttaaagagaatgggcaggccaggtgtggtggctcacacctctaatcccagcactttgggaggctgagatggatggatcacttgaggccaggagttcaagaccagcctggccaacatggtgaaaccccatctctactaaaaatacaaaaattagccaggtgtagtggcgggtgcctgtaatcccagctacctgggaggctgaggcaggagaattgcttgaactcgggaggcggaggttgcagtcaaccaagatcgcgccaatgcactccagcctgggtgacagagcaagactgtgtctccaaaaaaaaagacaaaaaaaaagaggatgagtaaatacaagatggttcaaaagttccaagatggatggtactggtgacattgatgggtcagggaagccagattgaaaagccagcactagggtcaggagaactggcctgggagggttcttaaattctattttagagagaataaaaattactgttagctagcagttgactgtacctataccggccctaagtgccacagagacatttctcaatggtcagtgaaccctctaaagaagtgctactagctgggcacagtggctcacgcctataatccccgcactttgggaggctgagacaggcagatcacgaggtcaagagattgagaccatcctggccaacatggtgaaactccgtctctactaaaaatacaaaaattagctgggcgtggtggcacatgcctatggtcccagctactcaggaggctgaggcaagagaatcgcttgaacccaggaggcggaggttgcagtgagccgaggtcacgccactgcactccagcctggtgacagagcgagacgccatctcacaaaaagtaataattaaaaaaaaaaaagtgctattaacatctccattttacagatgaggaaacagggcttagggaattaagtaactcacccagggtcacacatggggagtggcagagctgagactagccctgtatctaacatgggagcgaaccacagtgacagccactcctccagtccatatctgaggcacctggcagctcaagatgggacccaagagccgggatgcttcagccatctgactgtagttccactggagaagcccaggcagagtttttggagttgtaagcaaggaagtgacaagcaaaatcctaagaccagacaagccacctcagggagaggagacagaggaaaacagaaagccaagggctatgcctcagtcaagaacccccgaggttaggcacactggctcacgcctgtaagctcagcactttgggagtccaaggcgagtggatcacttgagctcaggagtttgagaccaacatggtgaaaaaaatacaaaaattagccgggcgtggtggtgtgcgcctatagtcccagctactcaagaggctgagatgggagaatcgcttgaggttgcagtaagctgagatcgcaccactatactccagcctgggcgacagagccagaccctgtctcacggggaaaaaaaaaaaaaccccaagaagaaagagtgagcagctgagaaagaaacagaaaaacagatggaatggtagaatgagaaccaggaaaccaagagggaggtgccagaaagggagtgcttgacagcactggaggcttcataagctggggaggagcaagagtggggcaggcagatgtgtagaggcagctctgcaacagaagttggtgccccgaggggctagtccagtgctagcaccaagttcttggttaatagtgaacatgtcaccgctacaccctctggcctggttcccctaaggtattagggctaggtggaccccagggaccctctagtcctagcagcccttgagttgttcaaaggggcatcatcagggtctccccagagattagctcaggccacagagagggaagaagggaaagaaggacgtacagatgttcactcattccagtggagcaggggaaggaaaagagaaataagctgacctgaggcatcagaggggccaagtcatacatggcctcttcatcgtggaagaaagaaaagtgaaataattaaacgtgtctaaacttacacagaaatatttagaaaataccgtggaaggagtgattgaagtcaatgcaataaatacttctgcagagtttaagtatttaaatcagcgattagcagttaagtttccttttactctcaaacagaatgtcaagaagcagataagcaatggcaaggagaaggctcaagctggaaaactggagacgctgcacacgcatgcactgggcctttgcccaatcagcacatctgcatctcagatttgcagagctgctcctgacttgggtctattgcttttttttaatactctcccaaaagttctaagagcaaaatgtcacatttttaaatgcagagagtgctcttgtaaaaacattgtctaacaacactttcaggaaattatataattctttttttaaagccaagggcagttaccatggcaacagtagtacaggtcagggttctaaccctaacctccataaagacaaaacaccatactggttggaaaatgctgctgctggacaaattttaaaaggggtcagctgggcacggtggctcacgcctgtaatcccagcactttgggaagccgaggctgacggatcacaaggtcaagagatcgaggccatcctggccaacatggtgaaaccccgtctctactaaaactctactaaaaatacaaaaattagctgggcatggtggcgtatgcctgtagtcccagctactcaggaggctaaggcaggagaatctcttgaacccaagaggcggaggttgcagtgagccaagatcgtgccactgcactccagcctaggcgacagagtgagactcgtctcgaaaaaaaaagggggtgtcaaggcagtctctatctgggggaagaggcaataatgacaggtttttacaatctgtccagccagcatagaacataaatcggcattacctcattctaaaaaggccgagtccaaccaggctcagtccctctgccggggcaggggctgtactttcctggggcaactttacagcatctggatattactgtgacgaatgacaggatttaagtgacgtgaccaacctgcatcttggtaggaacgttttaacttcttagcttagccttgtgtcctggtttgtttcctaaaccccggtgtttgctattacctctctgatttctgctttcactttttctaaaagtccaagactgcatttttggagagttcctattggagagttagctggaattttagattgaacatcttgccccaaagtgttagacatcatccttgactagtgtgaccagtgccagctctcgcttgcattgtcctctgttgtgacagctagcagatgcattgccttgctgtccctaaccctgctcccctttccaggcctggactggcaccttcacacgacctagcagggtgtcattgtttaaattgcattgagtgtcttcaagtaaaggagtaactctttttatataatatgagtgtcctattcattcaggccctccaatcctatgtggacagacagattcagttgcctttgtaggtaatgaaatgatttctatagtaatactcaaataaatggggaagggaagaaaggagagaggaaatgggcaggtggggagagacagagaaaaaagagagagagagagaaatagtacaggcatgggccacataacaatgtttcaatcaacaagggaccacatatacaacggtggtctcataagattatagtaccataattttcctgtacctttttgacatttaggcatgtttaggtacacaaattcttaccattgtgttacaattgcctacaatattcagcatagtaacatgctgtgcacatttgtagcctagtagccatgggctatatataccatatggccgaggtgcgtagtaggacataccatctaggtttgtgtacctacactatgatgtttgcacaacacaatcccctaacaacacatttctctgaatgtgtctctgtcatgaagcaatgcatgacagtatctgttaaggactggtggaaaactaaatgaccatttcagaggtaatcttccctgtcaagctgggtgatttccagaacagcttccttttaaacaaacaccaggcagtgcttatatgcggaatgtatttgtttagaaaccaaatttcactgatatacagtgtctgtgtgtgaggggtttcctttgacacttgcttagtacataccacataaaaggtatctcaaacataaatagccctgggttttttgttttttctgcatatgcacaggactgcattaggaagtcatttatgaatagcagcagggtaaaaaatgccccagatagagaaaagaatgtagctagtttaatgtttttgctctcacatatgtactctcccaaaacccagccttgagattttgtatcagttcttttagtggtgttgggcaaggcacacccactcctccccaagcactgtattatctgaatctcgataatcgagggggaaaaagagaaaaggtgttcgtgtattaatattgtggaaatggggaaggattacatatagataggtaggtaggtagataaagatctccaaaatggtcaatctttgaattgccaaattccccaatgtaagcaaaaagatgtcaaatcagatggcgaagtctgaatactgaagctcttgcatatcattcttagcaagaagagtcagttaatatgctagttctctcttaccacacagttaaaacaagtttggatacaagacgtagtaaattataagcagaggacaggtgagctatttgtgtgaacacagctgaaggcctgggggtggggggaatgtttaactatgaaaacagacaagaacataaaaggccccttggtggtgccatttagcatggggattagcagccacatagagcacaatggctcctgagctcagccctgcattttataattactgacatgtggtgtgataatcctaaaccatgaaagggaaaaaaagagacactgccacacacagaccaacttaatactgccccaaagctgcaaggaagggaatcaaaaaggactccaagcactgcaaagagttattacaaacctatgcacagaacccaaaccctcactaacagacctacttgctggctgtctaacaaagcagactcagcagactagcaggttctgtagcccagaaccaagtaagagctaaaaggaaaggacaactagctggagtatgggaaaagcttgcagcttgcactgtagaatccaacagacacaactcgggggctggctccacaactcaccatctggttgtataacctccctaagcccaagcatcctcttctgcaaaaacagtgaccaccaagcctccctttcaggctgacgacaagactggcagaaccaaacaagtgcctggcaggtggctggcccacaggagacacgcagtcttcaccactacggctgctagtattgtcatttgggggatgtgagagctgttaagaggcaagtcgagcagttagcacttgacagtgtttacttccttctctttctccccactgtggtctttcctgccctcaaaaagaaccaaaaaagggacagctttatgccaatcctcagagaaggtacaaagtaaaagtgacttggagccacatgtgtgattaaccacacatcccatttgtctgtgcctgccaaaaagcctggagccaaatttcaaacacaatcataccaaccacataaacccaaatggctcgcaagctgcacccttctttttcccttggtcctcattctgtatttctgcttacactgttggtatgcctgttgctggaggctcatcccaaatcctcttttggaatgaggcagagaagctcatagggttatgagctttttgacgggtgaagttattaaacctggcccctttcccatggtaatggagcctcctgatccccactccacccctacagccaggcactggcacgcccattgctcctttaatgtcaaaacaaatgcataaatttaaatgtccatatcttttctacacatatgtaatggctaacttgggacttatcctcagcagcttttcataataagcaagcaattagataggtcagaaatagaaaagacacaccaccacataaaagcaggtcacaagtaaaaattagatgataggaaacaaaattgttgccattccagcaactaatgaaagtatgttactgtaaacaagcctctaatggtgctgtaacccctctcaggaatcaggaaacgccctgagcaattaaactcgggagtccgacacaagggggcggctgcattttacttcaaagtcagagggtactaggagctggttttcatggggatggaaaccatgacactggtcctcacttgctctaaaagataaatctgatctctcagcattgtttatgctcttctgctgtcctctgttgccagaaagtcattttccagtttcctgttcgcttccaaggctgttgtttccgaaaccaatgattacaaatgagaggtgtgttctcagatgaaaaatacaataggtctactctgacccgaggagaacccagcagggaggccgatgacaaaacattgctttggtactgagggctttttatgtactgttgtaacaagtgtgtttctgatacaaattctctgctggcctataaaactgttcatccaacttaagcgttactgtctccctaaatcttgtcaacctgctgcagttactacttttgggtgtaggctctgtcaccgcctctacacaggaaaattaaaaatctctccccagctgaagaactttaaggcacctgggaggtaggaatttattaatagtaaaatattagatatggggtgatttataatagatcttgatactgatcttgcaccaataacaagccaaggggaaatggggctgatttagtaattccctcacatttaaggatgacatcatgaaaaccaactactccagtcttcagtcatagtcaattacagcttggagccagcacggtaattgttttgctaatttgtaagtaacggcacttatttcattttgaaaaatatttgcctttaatatttggtagaggccaggtgaggtggctcacacctgtaatcccagcactctgggagtctgaggcggacggatcacttgaggccaggagtttgagaccagactggccaacatgatgaaactccatttctactaaaaatataaaaaattagccgggcacggtggcatatgcctgtaatcccagctactcaggtggctgaggcatgagaattgcttgaacccgggaggtggaggttgcagtgagccaagatcacacaactgtgctccagcctgggtgacacagcaagactctgtctcaaaaaaaaaaaaaaaaaaaaaaaattggtagagactgcacaaaggctgcctctggccctcctactattaccctcaaaacagatcagctgttatttttagcatagaccatatcatgacatatctacaaaaaccaagttatccattgaaaataacaaaaagcattaggtgagtttaagttgaaggagtaagcaatcttggtaaaagtgaattgagccaacgtaaactttatagactaattagcatgtcagcaggtcaaacggtttttttaaatagtttcattgagatacaattcccataccataaaattcacccacttaaattacaattcaacagtttttagtatattcacagaattgtgcaaccattaaaattttagaacatttttgtcatctcctccaccttttttttttgttgttgagatggagtctcactctgttgctcaggctggagtgcagcagcgcaatcttggctcactgcaacctccacctcctgggttcaagtcattctcctgcctcagcctcccaagtagctacgactacaggcacccgccaccatgccagctaatttttgtatttttagtagagaaggggtttcaccatgttggctaggctagtctcaaactcctgacctcaggtgatccacctgcctcggcctcccaaagtgttgggattacaggtgtgagccacctcgcccggcctccacttttttaaaaaaacatgtaacgtttagcagtcaacctccatttccttctttcccctctagccctaagcaatgactaatttactttgtctctataaatttctgtatcctgaacatttcacatacatggaatcatatgatatgtggtctttgtgtctgtcttttttcatttagtggattttcaaggttcatccatgctgtagcacctatcagtatgccatcctttttactgctcagtaacactccattgtatggatataccatattttatttacccattcatcagaagatgaaaatttgggtttttccacttttggactaatgctgccatgaacagtcacagacaagtctttgtgtggacatgtgttttcacttctctcgggtatatacctaagagtggaattgctgggtcatgtggttcaaatgatttttaaaaactgtttgcatagctgcgggaatgttctccatagtcatatgtcaaaagagtgagcgatatttaatccttatacacacccatcttaccaaccacaaacaatctttcattctctcgtcctgaccctcattctgatgttatcctctatgctcactttgtatatgcaaactactctgagatctgccgtatgtgagcaacgcagagccagatggaatctccaaaaatcagttatcccaaaatcttgttttcaaacagtattgaactacaaccatctaattcttaaaggtccgtctgttgtctattctcagaaacatcttcaaatcactggcccaaaatcatacatatactatactaatatcgaaagagaataatgttcaggtttttaaacaagtttgagactaccctttgtaggccctctttcttttcttcctcactgaacacactatgtccctgatgccagctaatgttatgtatcctcagtactgccaggtcctaaaatgaatcccattttgaataacatagtaaccaagtgcaggagagctctgctgtcactcctcgaggtatttttctcttgtttcagtagtcttactcgaatttgttttcagagtcaacaacagtactgcacaatttaacgtcaagaattttctgctgttgctgcttctgtaacagcttggactttcttttccctctgagttcctctgagagaagcatatataaaatgagtaattgtcgctgctaaagaattgctggagtcagcaacgcttcataggagctgcatttcctcctctcctcctttccctctcaccacaaactctcccccatcagttcagaattaaaggcacattactgggataaagaaatctgacctgaaatatgagttgcagcaacaatggcaagcaaccaagagtattaacaataatttccaatgttgctggaaaggttagatgatctgtctttgaaatgagccaactctgcacacgttcatgagattaaaatcagcttgcttttccttaacatctcgtgcttctcctcttcctaccaccccaaaaggatggggtggctgaggcacataaacaagtggctctggaaattaactttcttgaccagaagaaagctcaaagataaattccattctgcattacttttcctatacttcactatgatcaggattttttgtggtttctctctccctggagagcgaatacctgagtgataacatttctgacacacagaagcttaaaaacagaatactctgtgttatcttgttgggaaatctgtactcttaaatgatgaccattcacccacaatctaggccatttttgagccacaggaaagaggacgccatttctctctgaagatgatgaccttgcgcaaataagttttctgcacctgttttgtcacctgtaaaatgagtataattgtaggattcatggagttactgtatgagtgcttcgaacagtgtttggcagagtaaatgctgagtaactatgagcatatatctttatcatcaccatctccgctaatgtcaccgccacctttgggaagctgcctagatagtgataaggagctatgctcagggattttcaggcaagtacaaagtaccgccatctttattccagagtgttcccatttcccctcactcatcctgcagaagcaataagttcatatgacaaagtaaagaaagaagacagaggacacaggaggaaatgggaaagacatttcacaacaacagagaaaacggtaccttatttggtttctcacaatcatgtttaaaagatgaaattattattattatttttgaaacagggttctgctctatctcccaggctggagtgcaatggcaatcacggctcactccagcctcgatttcccaggctcaagcaatcctcttgcttcagcctcccaagtagctgggactacatgtgctaactaccacaccctgctaattttttttttttttagttttatttttagtagagatgaggtcttgctatgtttcccaggctggtcttgaactcctgagctcatgcgatcctcccaccttggcctctcaaagtgctgagattacaggtgtgcaccatcaccatgcctggcctaaaagttgaaattcttatgaacgtttttttccaatacggagggccaggaaatggggagagccaaccaatctctagacagagaaatcctaaagttgcccaatccagacagcagctggtattttaaatctgttctcttatgttcatacatgagcttcttttgttgaaccccagaagagaagaaaaggacttctgtccagaaaatcatctctgcagactcagtggcagtgggctgagagctgacacctgcacctacctctctctgtagctggccaggcccctggcctgcagtgcggagattcaggacatgcacctcctgtggcagcccagttgtgcctctgctggcacagcctgacaaaacagtgaagctctccatcaaggcctggacaggatgggaggcactgacaggtgacagttcacacagtgcaccaggctctggacctgccaagggaatcacaaacacaagccactcagaaacagcaattaattctgccccaaaggggcaagggtgatcaaaccactgccaacccaccagagatgcctttccaggtaaactgttccaagactaagtggccaaaaagctagcctatcttctaaaatcccaatctcttaaatttcttttggataatttggtatgtatttgattttttaaattcccttttggactcacaagtcatgaatgcattcctctgggtagaagacacttcccatttaacatttgtgtttaattccttcttccctcttggtagaaaatcagagataaaataaattgcttaaagtcccaataatactatacataaataatattaaatacctaaaattgcacttaacaaaagtataagatacagatcctatcttttcagagcttccctttattagggaaagcaaaacaaacttaagaacaatacagagcaagatgtaacatgtagaggcgatcagggccagagctgtacagcaaaatttgggccagaggtcagaaaaatcctcccaaaagaagtaggatctgagcagagcctcaaatagaaaaagtagagtgctggtcatacttggttcctgcttcttcattccctcttcctctaatcagtcaagccttaaatcctaaatccatccactcctctccatctctacttctttaccaaccctagacaattacaaaccttcctgaacggagtctgaggactcaagctctgcatgccaccttccacacaggcactgtccacctaacctagaggcactcaatgttacgggtgttcccaaagcaaatgcctgccgttggcatctctgtgggaagttcctgtcccttcagaatagctgccctaccaaataaagcctgagctccaccacagagcacaggaggcccttcttgatctagccccttcctatgtctcatccctccccactccacgtcaacttatttaaaggtctccagacacaccaggatgtttcccaactccatgtcctcattcaagcctgcttcctttacccaaattcctcttccactctcactccgcccccacaacaaacatctcaagctgaggaaggctctctttctctgccctcccgcaatccatctgcctgtctccactactgcatttacatgatagccactggtgtacacatccatctttattggtcgaatgtgacctctctgagggctgtgggtactcatctttgtatcctcagcattcatctgcagtgcctggcatatatgagatgctcaaaaaacgtttgttaaatgtataaatgaatcattgagcttaaaaaaaattgccccctctcagatcagtgagtagggcaccattccagggacttggatttggctgtagggaataagggaaataggctgctacagccctgacatcactgcagcctcctttcacattggctggattgatagagacatacccaggggaagaaggaactggatgcttactcctcacacacttctgtgagcttggtgctattgtctccattcaatcacccaggaaactgggctgaaacagtgcccactacaccacaacctcccagatagaacccacgaaaaaggcctgaatgtactccagtttgttcttcctgacttctaaataataaaggtaccctccagggttgcaaacaaagttcagaaccagccagtctgcacccagaagcagacaccctgcctggtgggccaagtctatttcaggacttacagaaattatctaggctgataatagctatctggtctgaaatgaagtatgtgccttctcaaatagtcactgccactctctggactgtggccagctgctttctgagaaagcataaggtggtgaaggaagatgtcccgagagcaacaacaggaggtactgactgtaaattccctggagcccctggcggggtgcggggaaaccatatgggcaggtgctccctctgctgccctcatcctgccctcctggcctccggctttcccagccgcagtgggatgtctggtatacttcacacccagagcttcaagaaattatcctactcctactcaattctggggacacacactggctacagctacccacactgggaaacccttctgaactggttgcagagcctcctgccatgaatttacaattatcacaaattaagcacaaataaaaatgcctttcagttccattcttgtatgtgtgcaaagctctgaacaggctgaaaacacatctgcaaaaaggcctgcaatctatttgatctgccctcctctgcatgatgccaccatcacccattaagatcttccttaaatcaccatactgctcacctccacactggggcaggggcaaaaactcaatggaaacaaatcaaataataaggtactcccaaagagggagggaactagtgccaggaagccttcagtgctgaagatgtgcacttcttgccttagagtctatgctctctgttttgccagagtccagaacagggcaaacaccctctttaagggctagagctctagccacgggttggttatatgagtcagtccaaggtcaaagaaaagagaaagcaatgcatggggcacaccctgatgaagtgacaggacagcgactctttacagagacccactggaggccaggtgcaatggctcatgcctgtaacaccaacactttggaaggccaaggcaggtggatcgcttgagcccaggagtacaaaagcaacctgtgcaatatgatgaaaccccatctctacaaaaaaaaaaaaaatatatatatatatacacacacacacacacacacacactcacgcatatatatacatatatgcatgcatatatgtatatatatgtgtatatgtgtgtgtgtgtgtgtgtgtgtgtatataaaagcagttgtggtggtgcacacctgtagtcccagctacttgggaggcaaaggtgggagaatcacctaagcccagggaagtccaggctgcagtaagccgtgatcacactattgtactccagcctgggtgacagagtgagaccctatctcagaaaataaaaataaaaatacagagacttacttggcttgacgtttaaatacactcaacagtgtgttcctgaccatctgacacaatagagtagtatttggttttcgaagttcctcatagaatttttttccctccaagattgaaaaagaaaaaaagctacaacatatgattaaactatccttacaccaaaaagacaaaaaaaaaaaatcaggaattatctaccaccatccccagggtcatataagaaatggtatctttaacagttcagcatacaacgtaataagagacactgctcggcccagtgcggtggctcatgccggtaatcccagcacttcaggaggccgaagcgggtggatcacctgaggtcaggagttcaagaccagcctagccaacatggtaaaccccgtgtctactaaaaatacaaaaattagctgggcttggtggcgtgtacctgtaatcctagtactcaggaggctgaggcagaagaatcgcttgaacccgggaggcggaggttgcagtgagccaagatcgcgccattgcactccagcctgggcgacaagagcaaaactctgtctcaaaaaaaaaaaaaaaaagagagagagagagagactgctcccatttattaagtgcccactatgcaatgctaggtgctgcatatccttctgacacattgcaaggaagcagcactaaccccattttaaagaaagcaaagtaagctcaatgtgcttaagtaactgtttcaaggttgccccagtcacccaaagcttcagacttggccctccttgcggctctctctctcaggaggcagggtcctgaagtgcccggccttgcagtaatcagggcaagagagatgatggtgcccgtggagatggagagaaggggacagagttaagtggccagggagagaatccactgggtgaggagagggaaagggtgaccaagcattgtacggtgaacatccagcccaatgcctgggctactgtgccaacactttctgtgaaaataaaaaagtggtcatagatttaggggtgagatctaccgttttgtaacttactttgaaatacctcccaaaaaataagatggattgacagatggagagatatttgataaagcaactattgcaaaatgctaattgtggaatctaaatgttccctgtacaatggtttcaacatctctacatgttgaaacttttcattaaagaaaagttgggagagggaggcaatgcttataaaaaaaattaagcccagaaatgccttaagaaaccttcctcaaaaagtgtgccagcatcacactgctgctgagagagcaaattggtataatttttcagtggtatccaaggccccacaaaaggtacacatcctttgacccagcaacttcccgctaggaattttatcctgaaaaacataactggataagtttgcaaggggtacagaatgtacaagtgaaaaaaattaagacttaagggaggggacaaaaagtccctgtgaaaacacccaggctaaaggacgtaggttaaactctaagtatggggtagagtagtcctctcctaagagaacagacacagtgtaggaatcaggggagagggtttcctttgggtaaaaaacaagcctctctggccaagaaaggaaagaggcagtgtgattgtatgaagttttcctttgaatatcttggagagacgctcttctgccaccagctgttccatcgccgccttccaggtaaaatgcctgccaggccttcctggagtgcactatcctttttccatagattttctcaaacacatccatgggttcaactctcatctctttacagaaatgactccaggccatctcagacttacttatttctccttttttttctttttctttttttttttgagacagtctcgctctgtcgtccaggcgagagggcagtgacgcgctctcagctcactgcagcctccactccccaggttcaagcgattctcgtgcctcagcctcccaggtagctaggattacaggcgcccgccatcacacccagctaatttttgtattttcaatagagatggggtttcatcatattggccaggctggtctcgaactcctggcctcatgtgatccacctgcgttggcctcctgaagtgctgggattacaggcgtgagccaccatgcctggcccatacttctttttctaagctccaggcctgaatattcaacagctccttcaccatctacttttgtctcatggacacccaatctcaacatgcagaactcaggatctttacccctcgtgcctgttgttcctccttcattccctccctaagtaaatggcaccagcctcttcctacgtacacctggcaccaacctgggggaggtgccccaacatcaccccttccctctcctcacccaatggattctctctctggccactcaactctgacccctcctctccatctccatgggcaccatcgtctctcgttccctgattactgcaagatgctcttaattcttatctccaccaaaatgtcttctatagagcagccaaactgatctgaaaaacccaagtctgatcctgcttttctctgctttaaaagacttatcactccatctctgctgtccagatgaagccccaaaacctcaacgtgacttacaaggccctccaagatctggccctgcttcctgccacggccccgtctctcattcctcggacacttgctcccgtgttttggccattctggtgaagcacagaagtgctcactgtctccctatagccatcattctcctttcttcaagtgccagctggacacacagccacccagaacgaaagctatgtttcccaatcccgctagcagctggcagcttcctgtatgaagggaaggaggtcagttcttctgccatttccttctgactgctggttggaatgtggatgtaacaggcagcactagagcaagcctttggggccatgagacagaagcagcatgctgaggagggcacagcaactgagaagccacctgggtacttgatgaacatggagccacgggatcagctctgaactgcttttttttttttaataggaaacaaatgtaaactcttttttttatataagccaatgttattttgggttttctgacatttgtagcttaacctaccctaattaatgtacttgccttcttttatttcatcagaagtgccaacctttgtcccaaaggagcctctgaatagcaaggtttcctccaggaacacattccccaccgtttctgttccttcccaccaccatggcctgacaaactcctgctcattctactgatctctcaaggaagctccccaaacctccctcactgtgttagatctgtattttttcatactctcatggtactctccgtttctctccacagcacttcctgtgatgagatgtacataattatttgtgcaattattggtttcacatctacatgctcccaaagactgcaaacaccacgaaagaacagaacccaaccactctgtctgctgctgcctgcctcaccccagcacagtatctggcacaaaacagacactcaattatcgctgagaaatggggaagaaccatggggtgatgcatgctgcatgggctttgtgccaataagggactgtctgtctcagacttcctgctttcactctttacctgagagccaaagcctcactcttatactaaaaggggcagaaaaaaaaaacaccaaccatgaaatgaaggaggtggcatttttggttgctaagaatcaagtcccagttggggcttccccaccttcaactgtcacagaaagcaggaaacacaaatctgtttttgtcttctcttcccggacactcttctggccaatcccctctctccaggtggcaggacaatcctctatctctccgttggcacaccacagccccagcctcatcctgccacttctgggtcaggccctagccttcctgtccctttccctctgccacagccagctcatgaacctgtctcccatccttcccccttggcctcatagtggttccttccgcaatctgtctgcacaatgccagggccagctccattcaggaaggcttccacctgggaacagcatgatccaccccacaggctctagcacaagtgcctgagttaacacagtggctcagattctcacttgaccaccatggggcccgagtatagcacctcccagccacgaaggcttggaaaccaggaaaacatgctccgaaaccccatctgactcatctgctcacttttgtggtgacctgtgagctctggagctgctactgtaggccctcaccggcagcctcaaaaggctgggagtgtctcctgtggccacggctgaaaacccacatcccgtcttccctacgcaatctcttccctgcagtcaagagccaagtgagtgacatgctctgatgatgctccttatcagcagcacagcaaaagctgtgttaccacgtaaggatcaaccagggcgtggacgatgacgaaagaacacacctgaaagcaacaatgctcataagcacacacgcgtgctcacttcacaccatactctatcatgaaaaggcatgttgcagatacttcatccaaagcctcacagaaactctataacccactataagtaaactgttgtgagccacacagaggtagaatgtgtatttcagaaaagtgcttcctggcagtaatgtccatatggattcacctccagagacaatcctcactggtgcctcccaatctggatatttcagttcattctgggcatctggtatgtgacgagtacaagattccttaagggtagctcccaaagaaatctaacttttccttggactcaaagtgtgagctgagtttaatcctcccctgctggcttactcgagaaatctgatctcaaaatcttgccgggtgtcgtgtcttgtttgaactgaagtcaggctctgctcttctgtttggtacactctcctcggccaccagcacagaggcacagcccccttcacccacaagatgctacttctactgacaaaaatatttactgacctgaagacagcacaaattcaaataaactctggtgagaaactccccaggtggcccagaccacggccacactgccaaggccactgccaaaccagcctccttcacaaagcaggcccccaccgctcgggtgctcagcagctgggccacctgaggccacactgtgaagcacatggtggctccctgggccgctgccttgtgtgagaagctgggggttaactcttcatatgtatggttaccacaccactaggggccacacatcttgtacatgtttctgattctcacaataccactgtgaagacagtgttaatgccctcattttagagtgatgggaaactggagctcatgagaggctaagaaacacatcagcaggaagtggcaataggggatttgaacctgggtctctgagactccagctccagacttttcccctggcagagcaccacctgcctctgccttgtactttccagttcctcgcctcaggactgggtgaacagatgcataggccaaatgtaaacattcattcatatctactaaaataaaataaactgctcggttcacacgtatcacctttggttgacttaaaagacttcatgaacttaatgaaactcgtttctcattttaccaaatgccctcctccatccttttcactaatgcttgcttatctggacacatgggaaacgttcctaagatctcgctataacatcaatgtctaaattcccagttccacttaaagaaaaaaatcaaatggactcaccctttcattatgtcctttagctgcaacacagcattccaatctcagttacagaacccccacatccctgctggcggtgggccagctccaaaactcgacagaacgcagacaaagcatttgggaacagatgcatttgctgcacagactttaaatttaatcagtgccaaaagaaattactaatatcacacctcatgcaacatggacaaaaatactggcggggggggtaatgttttggagaagacatagtaagtaattttcacatttaataaatgtgatcctcaagcattctaaataccaatgcataccaagttgacacaaacatctggtacctattccacataattttcagcactctgattccccatatcacccagggttctaatgaggagcgtgtgttcagctgtaataaaagtggtaaagatgcagagggaattaaggggtaacattataggctgggaccaagacatcgcagtggggagattttattctaatgacaccattggctaataaggtttttgttattgtcccacagggaattctgaaatgctgtcagctgcaaagagggacaaactcccacagattgtgggactgggtactacaggatctattctgcccttgggctgaaaatcctttctacccccatgggatgcaagaatctgtaagaaagggcacccaggatgatttctcagccaatagcactgcctcacttcaatcgagcttcatgagaaggaatgttaccaacacaggatatgacgcaaaaacaaagctccaagaaaaaaacacctggaatgccctgagctcacaaacacgcctgacgtgtacataacatatgctcatgtttgtaccatctcaaattacaattcattggaactacagcgccttggggatggagcggtggaatgtaccaccattaaactccaaagagggcgcttctaccacagctcctacctgggtttttcaacaataaaacctggcttcaggctgaagcttatccctagtaggaaaaaggtagacaagtcctaaaacttgtaatttggatttctcagggggaaaaaaactagatttttctacagcacaactcttaggcatatcttatcatggtttctttcaccctccaagcaaaatctacatccaaaccttcctcctaacaaactaaccctcttccaagaagtcaaccaccaactttttgggccaaaagccagtgcatatttgtgtattgttgtgttgaaatcatggagcaaccatgttggagaatttcctgtattcaattgtgttttcaaatgttcaaaaggaaacaaagggcacaggttctttaggaatccaaattctcaaagtgttgggaagtgccaagctataaaaggcacatactcttccatctaaacaagataccactatacaatctggacgtgccaacagagggggatttctgcagccctctgaggaagtggtgctgttatgtttcatggtttttatgacctgaagtgaagcagtggcatgtctcagaagtcaccactggacatagcaagaggtgtccttgtattacagaagcaccgggaaatagtgaaccaggagatacaggagctgggttttaagcattccatgatctcttattctatgacaggcttgacttatagatcaaatgatgcactatatgtgaaaacgctttacaaacttcaaatactattagagacataaagtcccttgaggggaagagaaataaatgaatgagaacattttctccaatcaaaaactgttttctctaaaaacttttagaatgattaataaaatatctaagataagatgttcttatactactccctagcattactccccagaaattatttctatgaattgcactggaaagacttaaaataaaactacagctgggcatgtactccctgtaatcatgcctgtaatcccagcactatgggaggccaaagcaggagtgcttgaggccaggacttcaagaccagcctgggcaaaataaccagacccccatctctttaaaaaaatttttttaattaaattaaactatgcacagtattagagtaaaaattcctgttctctgagcacattctggaagtacaactcccaaaggcgagaacaggccatgtttctgcctccagggaattccatcaatccataaagacaatcagttggcatcatcttggccaacagttcttctgatttactttgtttggtattttgttttgttttgtttttggagacacagtctcactctgtcgcccaggctggagcacagtggcgcaatctcaactcactgcaaattccgcctcctgggttcgagtgattctcctccctcagcctcccaagtagctggaattacaggcatgcaccaccacacccggctaatttttgtatttttagtagagatggggtttcaccatgttggccaggctggtctcaaacccttggcctcaggtgatccacctgcctctgcctcagcctcccagagtactggaagtgagtcaccacaccgagcactgatttacttttgaccaataatatggtgcacctgtccctattcttctcacaagaaggaagcttaaacagaaggagacactggctacagcattcattttggaggggataagaatttatgggatgttactgcctaattggctcagaacagagaccaagaacaaatctgaaggtttgaaggatgggagaaaataagatcttttttctcctaccctatgaatttggcagatacaaaataactgaaggatagtacacttctttattaaaatgcaaatgctttatcgacttagattcaaaatattaaactgaactttatcccataaaaaaattacaacttaattcctactaatgcaatatctgatggcaaagtaagacttgcagagctacaaagctacacctcattaaccctgagggatgacattaccaaatctgttcatctctcagaccttgatttgtacctaagatgatcactaattttctcttttttatcatttgcaaactggtgtctagcaagaaagaaaaagatgggagaaagagaggtaagaatgtgtgcaaaagcacggaggaataacatgcattgcatgtggcatgctctgggcctggtgagcattctgttagggctggtggccagggtctggggtgcagagtctgaagcagagacaagtggcaagatgagaaactgtaagagggtcaggaagggcagaagggggaaaccacaactgctggggagttgaatcatcgcctataaccactggtcctgattgcagataggagaccatggattaaaaaaggaaaatctgcaaacttttggtttggctgtgcaaaatattgttaattacagccatgtgtacacactgggccacgaactaaaacacatttactttaaggagtttatacataatcagggcactcacaattggttacaggaatgagtcaaatgcttaacactgaatgccaaattattcagcttaatatataggtcccaattataagactaaactctattccttcctcttcaggctagctagcctgctgcttcaggtgcttctgttaggagggaaactgagagctgacatttgcagagaaattatgaacacctggtcactggtgtgctcttgctcctttcacagtgaagctaaaaggctctgagaagctgtggacctggtttttccagagcttgtggcagttacaggcccatcaagcagtgccatcaacagaactactcagtgtagactgggtcttagagagacagaaggattgtgctcggctcagttgctgtggttcagaaccacagttttttgggggtaagtggacggggacaaggtctggctttgttgcccaggctggagtaccatggtgcgatctgggctcactgcaacctctaccttccaggctcaagccatcctcccacctcggcctcccgaatagctgagactacaggtgtgtgccaccacaccagctcatgtcttatattttttgtagagacggggttttgtcatgttgcccaggctggtctcaaactcatgagctcaagcaatccacctgccttggcctcccaaagtgctgagattacaggcatgagccaccgtgcctggcccagaactacacttttgtattgcacctgataaaattcagaggtcccttaaactgttacacctgttactcctttatagcaaatataagcttttataaatctattgcttcatttatttgggcatatgtttgtgtgtcctctacttaccagaaactccatgagggcaaggactgtgtttcttttacttcctctctcccagtgcttgacacagtgcctggcatgcggcacgtgttcataaacatttgttgagtgatgaattcatgtgccaaacaaccaaactcccaagctgctaattctctaaggactatggagccagtctcctacgtttaatcccagcgctgccacattttagccttttaacctggggcagctacttagccattccctgcctctgtttctttatctatacaatggggataataacaggatctgccccataagactgttcttaggatcaactcatttttattattgtattactgtaattattaccatctcttcaactatgagatgtgttctggaaaaaaaaatgcaaaagagaaacttcatcaaagcacttagctaaaggaaactacatcatttgagtgccaaacctagctctgcgctttctagcaggcaggatgaaaagaaaatatgatgctcacatagatatcataaaaaggaaacaaatcacaggcaggtgcagtggctcacacctgtaatcccagcactttgggaggccagggtgggaggattgtttgagcccataagtttgagaccagcctgggcaagagagtgagacctcatctctacaaaagattaaaaaattagccaggcatggtggtgcacacctgtagtcccatctactcaggaggctgaggtgggagaatcccttgagcccagggaggtcaagactgcaatgagccaagatagtgccactgcactccagtctgggtgacacagtgagaccttgtcttaaaaaataaattaataataataataataggaaacatcagctcttgcaagaaaatacttttccaaggtctcaatttaagaggcctgtaataaagcaagaatcagtgatttttaactttttaaaccaataatttgcattattgtaggtatgaaagcaagaagcaaactggcatttatttgctaaaagcatgtgatggagtttgtgatcttggcatgatatatgccatgacatatatcaaaaagtttggattttgctgtgtcgggtcaataagcaatttctgaaaggataaaatctaagcagagatatcagttcaataaaaggctaagagagaagggtataattcaatcaaattgtatttaacctaaaaataagataaagtactgtactattattgtttaataaactctcccccaaaaatttaaaactgggataaatgagatacctgttcagaaaaacatctattgagcttgctcaagacgaaactttacatagtaacatactgtaaaacatacatctgtatctgacaaagcaaccttccaaaacagatgtgtcatatgatgtttcaaagctgatttccctttttttttttttttgaagtttgtcacattcagtgaaagtaactgctgtttttcagaaatccgtgtgtgttattttggagaaaactttgctttggtgtttttccactctggatcaactagctcctctcttttcctcccaagcaaaccttcgtaaaccacactgccagagggaactcacctttctcccatggagacagctctaatacttgcaaatggtcaaactgaaaataaaatcccttgcatgccatttcctccaacaaaaagggctttgtctcaagatttgcacagaaaaacataccaaagctacatctattatttaaagtagtaattccttctctcagtatttcatattcctttcttcccaccttacttcatctggcccaaagaaccacctttccgccacacaataaatgcctcacttattcaacattgactggcaatgagatattccacataagcaaattatccaaataactaagtcttttcttgtttcaaaaaagtaagtgtctttagtcagttttaaggaaaatctgcctaaaatgtactacatgcataatttcttcttggccatcttaaatattttgagcatcctgaaactcgcttattgtatatttttcttgaagatgtagggctgccattatgaatactaattagtttattaaaacttgatgtgatttcagttactatatctaccaaatggtcccatatttctgtgctttatagttttttcggtttcgtttttgaggtggagtctcgctcagtcgcccaggctggagtgcaatggcaccgtcccagctcactgcaacctccgcctcccgggttcaagcaattctccctacctcagcctcctgagtagctgggattacaggtactcaccaccatgcccagctaatttttgtagttttagtagagatggggtttcaccatgttggccaggctggtctcaaactcctgacctcaggtgatttgtccatctctgcttcccaaagttctgggattacaggtgtgagctaccgtgcctggctgctttatagttttgcctatacttttcatacttgtgggtttttttccagttctggctgcaggcctgtgtctctgcctcaagcctatcacttaccatcttttacactcttatatactcaattttaagtcaatcaagtctggatgaagaccagaagatggctccccaacccatccacagagtaacctatatggacttttgatggctattttccttgtaactcactaaaacgttctgacttccttcatgatgcacaaacctgctgtaaaactgatactgtatcataatattagtgacaatattagggacactgtccacagtaatctaatttgaatggcaaaccatcaaagaaagttaagcttatgcactaaaggtgaactgttgggaatttagttcacaacaaaaccatgctaaaagctctattctattgcttctggggcttcaagcttttcagaagttctaagagaaaaaaacaaatgtataactaggtatgacaaagttcttatggtccctcaatcccattttctcatggtgacctccccttttctttcaggatgaagagatattcaacctgtacagcccagattaattacaattttagcataatttgcacattttttccactctagtttctcaatggaagttgtattcaccattccttcctgtcttctttcttgagtcagtgccagcaagcactgttcatagaaatcagatactcctaccagtgctccctggtccaggtcagtacgaatgatctaccatgaaccacagagtccagggcaggctggaaagcaccacctcacaaagaaaacacctaacggggccacccaaaggcccctctatggcagcagtccccaacctttttggcaccagggactggtttcatggaagacagtttttccacagaccgaggaggagaggatggttttgggatggaactgttccacctcaggtcatcaggcattcgtgagattctcataaggagcaggcaacctagatccttcatatgcgcagttcacaacagggttcacactcctataaaaatctaatgccactgctgatctcacacgaggtggagcttaggcagtaatgctcactcacccgctgctcacctcctgctgtgtgccccagttcctaacaggtccgtggcctgggggtggggacccctgctctatggtacaataccatttgcagctttctaaaatccagccatgacatggaatcttccctgcctttccatgttgattagaagtcggggtccaaattcactctttgcaaatcattattatgtaaggaaaggcatatgtatatgtatatgtatgtatatatacacacacacacatacatgccaagggctattactgtttctcatactcaagaaggttcgcttcctaagctccttcctgaaatgaaatcgtttctttgcccgagagatagctcataatttatcctagatttcaaccttttttagtaaaaagtataggaagttacatggaaacaatgaatggaagtgtacttttttttaatcaaacaagaacaggaaactttccgtggtttatggtaaaactacatatttgagccaaagaaaaaaataaactatgctcaacccctttttactctcccctatccaaaacatataagaacatgcacaactgacaaccacaagacaaatctcaacaccagggacaaattaatatttataggcttcaaaaatatacttccccaaattacttaataaaccccttcaaacaggccgacacctacttcttctactattgtatgaccaaaatgagtcataataaaacttaggaatattaaagacaataagtgaggaaattccagaaaatataaaaactatttcagggagccaaaacagaactatatttatttttctatcaaaatgcataggtataaataaacgggcaaataaaacaggcgctcacaaaagtaaacatatacccggctgcagttctacaacatagtcttctaaattaccacctcctccacattagagaaattacttccttcaacaaaattaacctccaacaccctccaaactgtaaaaatctctactatactgtgagcaatttataaaagcaggcatttttgaggccaggcacagtggctcacgcctgtaatcccaacactttgggaggccaaggcaggtggatcacttgaggccaggagttcaagactagcctggccaacatggtggaaccccaactctactaaaaatacaaaaattagccgagcatggttgtgggggcctgtaatcccggctacttgggaggctgaggtaggagaatcacttggacccgggaggcggaggttgcagtgagctgggatcgcaccactgcactccagcctgggtgacagagcaagactccatctaaaaataaaataaaataaaataaaataaaataaaataaaatagggatagtcctgtcctagctaatcctcagggtcatcatgaaaacaaatgagatcatggcatttgagaagtgtttaattaaatcaggaagttctataaaaatataaagataacatcaataagtatatgaaagatcaacagaaaagaacctcctttctcctcactacccactttacgttacaaaaaagaagcccacaggatacaatgggaaccttgggagcacagaggaaagaacactacatttggacctagaaggcctgggttccaggctcatctctgccattaacaagttccttgacttagggcccctctcttggttgcctcacctggagttaatactacataccttgccaaaatgaattaaagtaaaggatagcaaagaattctataaactctaagtgagatccctatagaagagacaaatgaaatcaatctgctgaacaaaaagtttgaactttaatggtttgtgttataaaatcaactgacaaggaaagaagttggctgtaatcagactcttcccaaacaccccaaggaagaaagccaaccaagacagaggagtggagaagcctccacagtgtgaacctggaagggctcagcttgtatattcattacctaatgaaacgggggctttagaagtgggaattctgaacctgtcactgtggatgagaacctctctgaatccacttaaacccatgaattgaaagactgggttggattttttccattcctggttaagatagagccacacaaatcctaattctaaatgtggatgttcaacattccagaataaacagcagctcatggagaaagcaacagaaggatggcaagaggaaaaaatagatcaacaaactacaacagattggtcacttagtaattaaaaaagaaaaaaacgaaaagaaaacaacccatctcaaagttcaactcaaggctgaattcctatcagaaactaccagaggccaaagactacatctgcataatattttaaatctgagcctggtctttgagaaaacatttgacaaagattaccaaaacatctatttttctttctttctcctcatttttctcaattattttccctaatccctacacttcactgaccactcctgcgttctcaactgcagtaagcaaatacatactaagttggataacatattattttgtatctatggtacacagctacagtgttggaatggctcctgattcttcctgggttagcaaatgttcacttaaatcaagtgtaccacctatttcagctattgagtctctttcatctttatgggactatattttgaaaatcactagaaactgcgtggttcccatatattgggctcaactgaaactttaaactcatgcaataactgttaatattcaagtataattttacctagcagtaaagttatattttgcacatcaaaagcaaaatgaagcattaagaaatttagttatatacattctttcatatccctttacataagcagaatacaaagtacttactttttttcccccaaatgaatacaggatttcaacaacattaagacatgattattttcacttactcccatataataggtattcttattaaagaaaacatcttaatgtcaccatatatgaattcatctaatctctgagtactcatttatcatctctacaactacacatttgacagaaccaaactgtggccctaagaaacaagaattactggcatagctaagaattcaagaaatcagaatacagtctccaattatgcatttacttcaaataagaacaataacttgaaactctgtgttaggctttgaattcacctccagcctgactttaaaaagctaccatgaggcctaactccagctggcagtagtaaacatccctggctatctaacaatatttttataaacaaagcatcataaagaacataacgttcaaacggcatggaaactgttttccacggtccatatttgacaatctttcaaaaaaatgttaatattacacatattagcactgtgtaatatataagatgtaaccccctcttcacaccaagatcagttgcaaaagaacactatgatcatatttcagaaagtaacatgtaaggaaaaagaaaaaataaagaacactatgaccttggcaaaattctcaagtgttcagacagaaacttctagaagtgcttgtttgtttgttttcaaattctgctttttgaaattactcacttgatttttaggccagaaaggatgcaaacgtctgaatttctgcagtcacctccctcccactgcttttaattgctctataaagcaatccctgtggatacctatcttaaactgccctggccttgccaggacaaatgttggcccatgtattccagtaaagccatgagtattctgaaggtcaaacaaaatacatattatttccaatcagaaaggaagcctgtgctttctggaataaggccccagctcaaccttgacttggtgcgctatgaggcaaataaaccaagaactgggaatggccttcctttttaatcagtactttctgaaggatgctactgataacagaaaaaaaaaaaaaaagtcaatatacttgataattcacatctccctctgtcttggctggagttttttacagatgcatttacagatatttaaaataatgatcataaataaagctttaagtttagagtatataaatttttatttttcccccactcctgaaaaaggcttgatggttacttagctttttcttttccttttttttctattttaccaaacaagtttccacaagtccttcctacgcgtgtcctcacagccaagcaaagagcagtgagatttctcaccattaattcactcttcatttcacatgttcctacagcaccagctgttagtttatattttcagtctttactattaaaaaaaaatttcaactgcaactgcaccatttccccttagccccagcctttttttttttttttttttttttttttttttttttttttttttaggaaagtttaggacagcagaaaaactgctgagctgtgacacaaagaaaagctgactctgcacatgcctcattgttttctattttcattccagcacagttgtggctggaaaccagccttcaggattccccgtggaccttgccagccctggtccctggtgttttaaaatgttacactttatacactactcatagaggtgtgattcaattgagtatgttccctgtggttctgagtgaggctaatatatatcatgtatctttggagaagtaaccaaaatatgtgtttagggaaaaggaaaaaaataggatcaagggagtattcagagatgtaattacacatactcaagtgggaccttttgtgtgtgtgtcttggaggtgggagatttaatgtaaacacagaccacgtttgtgctttctgttatacacatcctgcatcaccacacactgagcacacatgtgttaaaatgctgacacattcattacaagaacatcatttatcctattacaagttttagagttttgcatgtcttttgttgatggtggggttttttccagattttcttagttttcttcctcaaatacacttgataacttatttttaaatgtgagagcattattataacaccaacagcatcctcctgcaatctatggacacagattattttgccagagtaaaacagattccaaaaggctgttcacaccttctttgggggacctaaaacacagggtccaggaagagctcagaaacaatccttaaatcctgatcatcgccaggtgtggtggttcatgcctgtaatcccaacactttgggaggccgaggcaggtggatcatgaggttaagagttcaagaccagcctggccaacatggtgaaaccgtgtctctactaagaatacaaaaattacccaggcatggtggcatgcgcctgtaatcccagctacctaggaggctgaggcaggagaatcacttgaactcgagaggcaggggttgcagtgagctgagatcgcgccactgtattccagcctgggtgacagagcaagactccgtctgggaaaaaaaaaaaatcccgaccatcatcccactccactgaccttgtaagcgaggccactcctcaaagagctagggatcccacaggctaaaaataaccctttgacccacatagaaattacaactcagaggaagctgagacaattcatccactgagagccattctcctgtttggagagggcctacaggcatcagcagcacctaaacatacagcctttcctggtcatgatttatttcttagcatgacagtaaatccatagcttacaatagcaggacgttgctgtcagacaccaaggtctctcagcatagccactatcctgaagtcatgaatcacacctccaagtccagtgacaggttcagaggctttaccaccccctccctcccctaaatccacaggatgcccactctgcttctctgctcatgcgatgatttcattagttcaaagatattctgccttctatcatttttctccttacagttcttaagagaatgaaccagcttcagaaaatggggaaagaaaaaacaaactgatcatcagatgagggttcaaatcttgaactggcttcttagaagctgtgtcactttatgcaagccacagtctttctcagtcttagttccagataaacagtgaatagcagcacattctttatgagattattataagactcaaatgagagaatacacaagaaaatacctagcacatattaaatgcctgctaaccttttacctatgagcaatcataatgctcaattcatacttttcagagggtgtagtcattcaataataaagaccagtagaaatattttaaatcttttgtaatcttctcagccaggtttgggacagcaactgaactgtccaacctctctctaaaggcattacatcataactgtaattacaccaggctgtaactgatatcaatgtaaatacacctactgtactacaccataacaacatcactgttatggtactataaagtattacaggcatagatgttaactgccacagtatttataataaacaaatactttaaaataaccagccgggcacggtggctcacacctgtaatcccagcactttgggaggccgaggcgggcggatcatgaggtcaggagatcgagaccatcctggctaacacgttgaaaccccgtctgtactaaaaaaatacaaaaaaattagctgggcggggtggcgggcacctgtagtcccagctactcgggaggctgaggcaggagaatggcgtgaacccaggaggcggagcttgcagtgagcagagattgcaccactgcactccagcctgggtgacacagcgagactccgtctaaaataataataacctaaatgttcatcaaaaagggtgtatctatatcatgaaatacatatgctgcatttaaaacactgttatttgtacagacagaaatatcttatgacatgttctttttgtatgtaaagaatgatacaatttattaaccttctaaaactatgtgtatttgtccatatgcatgcacatacatgcatagaaaaaggattaaatggataactctaactataaatggttcttacctaaggtaggggtgatgctagagacgggttggagacacgagaggaactctgactttgctctccatccttctatgaggttgacacaaaagtaattgcagttttttccattaaaagtaatagtaatggccgggcacagtggctcatgactgtaatcccagcacttgggagactgaggcaggcagatcacccaaggtcaggggttcgagagcaacctggccaacatggtgaaaccctgcctctactaaaaatacaaacattagccaggtatggtggcacacgcctataatcccagctacttgggaggctgaggcatgagaatcacttgaacctgggagacagaagttggagtgagccgagatcatgccactgcactccagactgggtgacagagataagactgtctcaaaaaaaaaaaaaaaaaaaaaaaagtaatggcaaaaaacacaattacttttgcaccaacctaatacattcttaatgcttttactgtgcaaatgtgtttttgaatattacttagataattaaaaatttaaaaatatgctctactttatcataaaaataattctgaccaaagccaatgctagttgattggtttctgctctacatatcttattttaaaaatcatatgtggtttaaaggaacaatctcagtgtctctctaggaagcagagaatcctggtttcctccacttcagtgacaacgccctctcatagacctgagagctgtggcccaacttcctcctcctctgtggtcagcaactctacggacctggggccttgcctgggtaggatgctgtagagaaaagacctggctttgaatcctggttctgtctataccatctgaaactttgccttagttttctcatttgtaaaatgaagacatctacactttgtgaggattacataatgcatgcaaatatacgatacatattaaatggtcaataaatggcagcttttatctttactattattaaccaggttagtctctagatttcagtatcaattctcctctgtaaagggagggcctatcatttgattattttgaaagttcccagctctaatagtctatgaacatgtgctatagaagacaatggacaaatatgtgctaaatagtgaagccaggtggctgagaccaaagagaccagacaaatggctaagcagagctttggcaatagtgtgacttatgtgacctattaccatatggggtaagaggcaaagaggataagagaagtcttttcaatcccacctagaagcctttagaatctggagagatgatagacaaaccgccacatttatattcttctactgccaaacagaaaacatttccagtatctcctagtgcccgctgtaggctgagaagagcaaagcattaaaaaaaaaaaaaaaaaaaaaaaaaaaaaagatgaatcttagtgtgaccttcccaaacataaacttcattttccagcctcaccaatcttttagaacagaagatcaagtcaaatccctttagaatcaacgggtaataatatctcagcacatctaatctattttgggggctcagttgaaaccccatctcctttattagccttcccaaatcctcctcactaaaagctatcactctctttcacttctcacagactttgttcttcaactctattaatttctgcttcacattagttatttgcatgcctattttatctcccttacagggccataaacccccttacaaagctgaataagggccgggtatggtggtacacgcctgtaatcctagcactttgagagaccaaagcaagggaatcacttgagtctaggagttcgagaccagcctgggaacatggcaaaaccccatctctacacaaaaatacaaaaattggccagcgtggtggcacgtgcttgtagtcctagctacttgggaggctgaggtgggaggactgcttgagcccaggagccagaggttgcagcgagccaagatcacaccactgcactccagcctgggtgacagaactagatagaccctgtctcaaaaataaaataaaaataaagatgaataatgtcctatttagtcgcccattcacaagccttattgagcacctatctagatggtaaatactatataaggtcctggggatacagaaataataacgcattttccttcttcaaggagctcacagtctaatgggaaagataggccagtgaacactcaatcatcaaggtgttaagggagcctggagggggagcctccctaattcacctcaaagaaggggaagatgagaagggtcaaaaaaaggcttcctagggcaggtgatatctgaggtgattcttaagaattaatataatctacccaagcaacatggataggaaatgatgaatctgtattaaaaccaacataggtacacatactttgaagaactgcgtggcaagttcttataaagttacatacaactcagcaattacagtcctaggtatttactcaagaaaactgaggacatatgtccagaaaaagacatgtttatagaggttcatagctacttaactgcataatactaaaaggaaacaacctaaacatccatcagcaggtgaatgaataaacaaattggggtatatccataccgcggaaaacattcaacatcaaaaaggaacaaattactaatacatgcaacaacttggctgttgattctcaaaaacattttgctgagcaaatagaagtcagacacaaaagagcacatgaacttctagaacaggcaaaactaatctatagcaacagaaagcagattagtaattgcctgggactggggatatggactacagggaggctgaagagaatgaaaggggtggagatggataatagaaaaattctctgtatcttgattgcagtggtgattgcacaggcatatgtattcattaatactcatcaaaatgtacctttaaatgtgtgcaatttgctgggtgcagtggctcacgcctgtaatcccaaaactttgggaggccaaggtgggagggttgcttaaacccaggagtttgggaccagcctaggcaacatagcaagaccccgtctctacaaaaaatacaagaaatagccaagtttagtggtgcacacctgtagtaccagtgactcagaaggctgaggtaggaggatcacctgagcctgggaggttgagggtgcagtgagccgagactgtaccactgcactccagcctgtgtaacagagcaacaccctgtctcaaaaataaatatataaataaataaagtgtacattttaatctatataaattatacttcgatataaagttgattttaaaagaaaaaaagagtatgtagtacagaacacagactctggagccagactgccagctctataatttattggctgtttaagagttaactagtaatggcattaatattcacactgcattaatatttagattataggcaaagatctggaagtaagaaatgacatgatagtatgaggactacaaacagtttggtatttagggaacataaatcaagaggaaagatgtgaaaacagatgaggccagagagacagacagccgaaggctgcaaatctctttgcccccacacctaagaaagagcatctgacatgccatgggtgcccattcaaatgtttattttcattgatgaacatccattgagataccattacacacccactaggatgactaattcaaaatgacagataataataaggtttgcaagcatgtggagaaactagaaccctcatatattgttgctgggagtataaaataatacaacaggccaggcgcagtagctcacacctgtaatcccagcactttgagaggccgaggcaggtggatcacgaggtcacgagttcgagaccagcctggccaagatgatgaaaccccatctctactaaaaatacaaatattagccgagcatggtggcaggcacctgtaatcccagctacttgggaggctgaggtaggagaatcgcttgaacatgggaggcggaggctgcagtgagccaagatcgcactactgcactcctgcctgggtgacagagcaagactccgtctcaaaaaataataacaataataatgcaaccactttgaaaaagagtttggcagttcttcaaagggttaaacacagagtaaccatatgacccagcgattctactctcagacacatataaatacaagagaaataaaaacataaggatgtgcttgactctggccttggccaaagccatacttcccagaaaaaagggaaaaaacataagcccacacaaaaacttgcatgtatatgaatgcccataacaacattattcctcatatccccagacaggaaacaatgcaaacgttcattaactgatgatgaattttttaatgtggtatatacataaaacaaaatattacttggccataaaaaggaatgaaataccaaatacatgctgcaacatggatgaaccttgaaaacatgctaagtgaaagaaattggtcacaaaaggccacatatggcatgactccatttctacagaatgtccagaataggcaaatccatagaaacagaaaatagattagtagttactagggcctggggaaagggaagaatagggagagattgccaatggataaagaggttttttggaggatgattaaaatgttctaaaattgactgtggtggcagctgcacaactctgataacatattaaaaatgattgtacactttaaagaggtgaattgtatggtatgtgtattatatctcaataaacttgttataaaatgtgcaatgaatatactatcaatagtccacttgtggttaggttcagtggctcacgcctgtaatcctagcactttgggaggccaaggcgggtggatcacctgaggtcaggagtttgaaaccagcctggccaacatggtgaaaccccatctctactagaaatacaaaaattagccaggcgtggtggtgggtgcctgcagtcccagctcttcgggaggctgaggcagaacaatcccttgaacccaggaggcagaggttgcagtgagcccagatagtgccattgcactctagcctgggtgagagtgagaccccatctcaaaaaaaaaaaaatccacttgattcaagcaatgtttgataaaagttaaacacaaaggaatacgaagtatcctttttcgttcaatttgctgaaacccatattaagtccctgctatgtgccagctacagtggccacaaatagtaagacagagtgccttggccttaagcagctatactcccagagtcgagagagagtgacaggtggagtcaggatagagagacaggtacacagtgaggtagcacattagagggtcccctagaaggctgccgagggaacggaggaaacacaaacaagggccatgatcgcctcttcattaccttgtccagtaccttatccctaagttatggtcctgttagatgtgcatttcttctattttaagtcccgctcacatttatatttagtaggaggccgctgtggtgagtggtgtgactgattctccagctgactgtcctaagccaatcactgtaactccattactctaccagggactgattcaaggatgggaggaaaagctgagtcaattcagccaatgattgcaaagagagacatactgggtgtctggggaaagaacctctctcgctcttagctgaagccagcattgcccttcctgtttgaaggagcaaaccgatggctcctgacagccattcctaagcaccagcacatccttcttcagctgaagatgaccctatgccagtaaagcaaacagacaaaacaacctaagtattaaataaaattagtcatattcccattttctcccatccactattaaaaaaaaaaaaaaggcctggccatgccacctgatgcctgtctcccctccctggtctggaggcacctacagagcagggggccaggagttccacgggtctcatttcctcccgtcagagcctagcacttagtcaaccactgcaagtcacatattttgcaagaacggaaaagcgatgaacagagagttatcaatctgttgttatactcaaccccaaacatttttaaaagcagattttaacggagaaaaaaaattacctacaggcctttcctattaaaacagatgaacatagttgcctttattgattcaagcaaagaccacattttactgaggaaaactttctgtcccttgccctctacctattcctgtggtgccaacatagaaaatgtcctggacttctagggaaggtaagctcccggggtggggacgccgtaggtgtgatgtaaagtgccaggcatgaggctggcatttgatgttaagcgctgtagcaacgatcacaacaacagaaccagcggggcgtgtacaggctggcggttacgacatggaatggtactggtttctattctcagcatgtgtcactgacttactgacaagacagttaaacataaaaggggtccattatcagtggtaactgggatcaagtccttgggatagcaggaataagaaaaatccagcagtaatccccaaacctcctgtttctcaagagtttcaatttcctgctccaaaccttttcaaaaactgctattaccaaagtaaactgatttaagttgactgttacttcctttccgtgatgtgacagccccaaaggatgagcagggagagacaggcccccattatcctccacttcttaaggcttctttgtatgcacgccgcatgagataattcattaacgaagaaaaagttactggttatgataacacagtccctggcacacagtaagcacttggtaaatgtttactgaatgactacaggaaatatctgagtgctggacagaggaacaaagcctcaactctcccaggtttacttttttagccaacctgttaacaacaataatagtgcatgtcatcaaagagctggaaaggagctggcttcagtaaggctgcagtcactcactactcagtgaatgaatcgatccattcagtttctctgacccccatccagaatacaaggtagttatggccagcacaggcataactcccaacggacttgttattaaccacactgggtaactatgaatggatgcagagacaccagttcagttcagctgcagactgtccggaacattatcttggttaatcatctactccagggtaccggctcttcagatcacgctgaggtctgcttctcaaagcctgacaggatcagaactgtacaacctctcacagtcttctttatcccttccccaagataactcgtcatgatcgctatagaataaacctgaaagggtttacttactaccctaattacaattactcagggtgaagcactggattctcctgcaccatgaagaactttcaaatgtaaccatgcacacctcctcttcccctaactccacacccccgtcaatattttggcttcattaactagtcaaaggaaaaagagtttgccaaatggcaaactcatatttcacacaggtatctcagccaagacaggaaggaaacatcaaatccatagcccagtgtataaatgttcagcactgaaatgaatgaaaacgaacaggacacttgtggttacgctttgacttaaatccttagttaaagggaaactaaagctgatccagttcagtttatcaacaggagagttcataaggaattatcatgagcaaacaggggcagccacccccgaaactgtagttgccttaagcagaaacggaggtgcaagtgaacttagctgtgaaagggtccctctggatggtcacctccacagaagcagcagctgctcaagccccaaggcacactactaaagttaaggagtgaaaggctgctggggtagaggaagaccgaaattcttccaggaaggaattctagtttaagcctgtattactgtcactgcagttccaggaccctcccactgcaggtccctctctcccaattccctggcatctagtcagaccaggaagagcaggtgagggacctcaaggactcctcaatgcagtgagtgggtgtttgaagctttaaggctaaagctgacttatacgtacgtgaaggagtccctctttttctgaccatcttcctgggcatgtgtcctgctggcaaatcaccaatgccagcactctctacctcccaaccccgccccctccaccatgacacctgggccatgacccaagcagacatgcagtaacaaggcacagtgtggctgggcacgatggctcacacctgtaatcccagcactgtgggagggtgaggtgggcagatcacttgaggtcaggagttcaagaccagcctggagagcatggtgaaaccccgtctcttctaaaaatacaaatattagccaggtgtggtggcacgcacctgtaatcccagctactcataaggctgaggcacaagaatcacttgaacccaggaggcagaggttgcagtgagctgagattgccccactgcactctagcctgagcaacagagcgagactcgaaggtcttcaaaaaaacaaacaaacaaaaaaaaaaaaacaaggcatggtgtggggaagagagccacaggatggcatcagaagacccatgcactggctgtggttctgacaaagtgacaccaaagggcacatatgctagaagggtccagccatagaatcatagaacctgtgaataccagaagcacccagaacatagcagtcccctcaaaggaagctctgagattcaaagtgtgctccaagatgatgtccatggctcaccaattcccatggagagttaaaactaccaaggatgctttggacacaagaaaacaatcactatgaaagcaaggactctaaggggacaacaaactccaaactcagttgttccagacaaggggtttttttttgttttgttttgttttgtttagagacaggatcttgctatattgcccaggctggaatacagtgtctattcataggcacaatcccactactgatcaggatgggagtttcgacctgctccatttctgacctggccagttcatctctccttaggcaatctggcagtcccctgggagtccccagggaagtcaccacactgacgctgaacttagtgcagacacctgattggcatagtgcactacaacagcccagaactcccgggctcaagtgattctcctgcctcttgagtacagacccaaatgatcgttacagtttacataaaggcagggcctgaaataaaattttcaaaaagctagatctttggtactcaacactctttccatctaaaaccagaactagaggccagacctgagcaatacaaggctgtgttccaaaaactgccaatactagtaccatgttctttgcctctgtctttctctggcataaccaagatcagctcagcctggcagggttatgcttggtgaagagggatacaggcaatcgggacttggtgctcgtccccaagggcagaatacttcctggctacttgtgtttggtatgtctttgttttggtttagccctggcaatctggcaggcagtcgatttccagggggagctctgtccacggtatggatgccccaggcttgaggtcctcattcattttcataaacaaagcccagttgccacagtgactggtgctgcaagcagctgctaaataacagaggtcacccagagctttctctgggttctacagtctgttcctaggcttctgtgaacagtgagtgggtcaacgggagctgcagtcataccagccagtactttatatgggagtctgccccctgaggagaaactcccaagaaagctgccagatacacaagtgatttcaggtggggtccaataccccacccctgacagatctcggtctggggcacaggaagaatgaagggcataaggagtagcaacttcctccttgtggcttcaacagtccccagagcagtgagagggcacagggtcagagcttggtgcaaaaggaatgatcctggaaaagtgagtgtggagttgggccagtgctgcttctgcaccctgtgtgccgatcagacgctttctccctgtcccacttaggtgggaaacggctctcaccacccccatagcaggaagcacaacacgcctcccacccagtacacacaggtaaaaacttctggactggagtcccaaaggtctcttcaagttagaaatcatcaccattgtgtttccacctccccaaggcaagcctgtccaaaggccacaagatctgctagacctcacaagctggggcacaacctgcaccatgcccacctgcctgggttgttcatttgttaaaaccagtaatagtttgtcttttactctgcaaagtacagcttctgtcctcaaggtagatcatttcagacaaaaacaatttaaaaaaaaaaactgcactataaggcaggtcctcttcgctcttgcaaaaccaagtcaccttggctagagcccaaggaagctgtaaaatagaagtgagcataaacgtcacttagtctttagactcattcccatgttaacatggaataataaacattcttcgaccccagtgccagttccagaaataagtgatcatttaaaacttaagcaaaattaaggtttaccattcccagaaacatatgcttctgtctttatcaaccatgaaccaactaaaccactacaaggaaaggaaaatggaaatgaaaggtccctaattcgcagtgtaactcaaaggtaaacctgcagatttgggtcaaacacgcaaccaggacccaaatgttttatacacaggattttttgtgttatttccaccactgtagtttattacaggccagaagaaacctaaacagttaagaagtttgtccttaggcaaatagttcaataatttagacttcaaagactccatattaacctctgtttacacaaagtaatgtgtttcctttgcctgctgaacatcaaaacacgtaacaattaattacctctatttttgaaaacgacgtaagtcctgtgaaatataatagccaacacattttaagcagagggaaaaaagcatgttcaaaatctgctgcattctctgtagagacaaagtaataacaaaacatccatggaatttaattaacatagaaaattatttaaaaacaaaaacttttctccttaaaattgtcatttttctttctgtattatctatttttttccatgttgccttatgaacacagtgaatctaataatagagcagactggcttttatatccctttacttaaaaattcaacaaagttaaaattccacgtaaaggtaaagcttagataattcaaagttatgtcatgttctaactagtcagctctcctgagagcattcctagtccatcattaaccaataattaatggctaatttcctagaaattaactctatatcctgtatagggaagtgtaaatggaaaaacagctagtggccctaaatgagagagagctttgcaaatactaaggtcatctttgatatacagagacaatcgatattcctttgaatttgtacaggaattttaaatttgcattttttccccattatatgaccctcaaaataaccacatttggctaataataacattattatctatggagtgtttactattgtgcaagggtctcttctaagcatttgacatgtattaacatgtttattcctcacaacaaccttgagatacactattattggccgcactttacagatgaaagaactaaggtagagtgatattaagtaactcactcaaagtcataaaattattgaatcaagtgattaagccaaaccagacagcagggggaaggtagaacctagactagaaggcagtccagcctcctgggttccaaaatcgaagggagtttcttctcagagaaaactctgaatcggggtcacgcatggtggctcacacctgtaatcccagcactttgggaggccgaggcaggcggatcacatgaggccaggagttcaagaccagcctggccaacatggcgaaaccctgtctctattaaaaatacaaaaattatataaaaatataaaaatggtacatgcctgtaattccagctactcaggagactgatgcaggagaatcacttgaacccgggaggtggaggttgcagtgagcccagatcacaccactacactccaccctgggccacagagcaagaatctgtctcaaaaaaaaaaaaaagccaggtgcagtggcctataatcccagcactttgggaggccaaggcaggtggatcacagggtcaggagtttgagactgacctggccaacatagcgaaaccccgtctctactaaaaatacaaaaaattaaccagtcttggtggcgggagcctgtaatcccagctacttggaaggctgaggcagaagaatcgcttgaacccaggaggcggaggttgcagtgagccgagatcactccattgcactccagcccaggcgacagtaggagactccgactcaaaaaaaaaaaaaaaaaaaaacaggcctggtaacccacgcctgtaataccagctactagggagactgaggcagaagaatcacttgaacccaggaggcggaggttgcagagagccaagatcacaccactgcactccaccctgggcgacagagcaaagctctgtctcaaaaaaaaaaaaaaaaaaaaaaaaaggccaggcacggtggcttacgcctataatcccagcactttgggaggctgagacaggtggatcatttgagatcaggggttcaagaccagcctggccaatatggtgaaaccccacatctactaaaaataaaaattaaaaaaaaaattggctgggtgcggtggcacacacctgtaattccagctacttgggaggccttgaggcaggagaattgcttgagcccaggaggcggaggtttcagtgagccaagatggtgctactgcagtccagcctgggtgacagagtgagacttcatctcaaaaaaaaaaaaaggaagaaaaccctgaatcaagatatcccaaggaatatcccagtgagatctgacctaaatatatgtcctaattctatggaaaactcaagtactaacatattaaagaaagaaagaaacaaagaaaaaaggaggtccagatttccttaatcatctgctcagaattctcaatatcattttaactctacacatattttctacattgtccaatattctttgcaaattacctaagaaaatgtttaaagcctccagaaaaaggaactatttggacattatatactggaattttcactacatttttttcctacattgtaatgttttcatggttttttaacaattcatgtttctggcaaacttgttcttttaacactcaaagctaaactcatgtaacacatcatgctggctgcagtttgaagctactatccagctgggctgattttaaaatccaattctgatagcatggtgtctcccgccttcaataagagttgaaacctctcctttctagaaaatcttcacatatcaaaaagacaaaagatacttttctctttatgtatttgaaaattgcaaatagtaacagacgctgctgagatctcatttcctatcctctgacaggttcccctttggttcaggcctgaagaatgggcatgacatatgagtgtttattttcctgcactaaagtgaaaatctatctgcctttgagagttcagagttgatctttaattccatcatttgaataccgaacacctactacctaaagtgccaagttcttgtggctactcgagaaacagcagcgaacaagataagcagtttctcctctgctttcatggagcttccattctatgcaggaggagaaatagacaatgaacaaatacgtgagatggagtttgttttggtttggtttggtttttaagacagagtcttgctctgttgcccaggctgcagtgcaatggcgcaatcttggctcactgcagcctccgcctcctgggttcaagccattctcctgcctcagcctccctagtagttgagattacaggcgcctgccaccacacccagctaattttttgcatttttagtagagtcagggttttgccatgttggccaggctggtctcaaactcctgacctccggtgatccacctgcctcagcctcccaaagtgctgggattacaggtgtgagtcactgtgcctggcggtgagataatttttaaggcacaaagaagctcctcctccaggaaaggacaagtatagcaatggatgggggtgctttatgcaagtggggggcccagagacccagccactgcctatcccctgtctggctcacagccccatcataggctcaatgaggcaaaagtgttcccaactagatcaggatagctctaaccacaaatctgagccttgcttcttttaccaacagggagcaaagtcctctgagctccctcaactttgacacacaccatccggccacttttatacaacacttaaattgtccagaattcatttgcttcactgtcaccattcagatgggttatttgttagacaaaaattctatgtagctctacaaggaagaagtaagggctgggagaggaggttacagccagatgaactgtagcacaacacaaggaagaatttcccaagagtcagggatgttttaaattcaagtaaaggttgggggcttagtcaacaggatattagaaaggtagtttacatatcaggctgagtttgaccagataatctccaaggattcttaaaatgccaacacaggccaggcgtggtgctcacacctctaatcccagcactttgggaggctgaggtgggcagatcatgaggtcaggagatcgagaccatcctggctaacacggtgaaaccccgtctctactaaaaatacaaaaaattagccgggcgtggtggcggatgcctgtagtcccagctactggggaggctgaggcaggacaatgacgtgaacccggaaggcggagcttgcagtgagccgagattgtgccactgtactccagtctgggtgacagagcgagactccacctcaaaaaaaaaaaaaaaaaaaaaaaaaaagccaacataccactagaactctaccatgccctatgaataccaaatcttcccagatgtaacttaccctaaaacattacttgaggatatatgttgttaatgagataaaaattcagatgtcggccgtggttcatgcccgtaatcccagcactctgggaggccaaggtgggcggatcacctgaggtcgggagttcgagaccagcctgactaacttggagaaaccctatctctactaaaaatacaaaattagccaggcgtggtggtgcatgcctgtaatcccagctactcaggaggctgaggctggagaatcgtttgaacctgggaggcagaggttgcggtgagccgagattgcaccattgcactccagcctgggcaacaagagcaaaactccatctcaaggaaaataaacaaataaataaattttaaaaaaaattcagatgtcatgaagaaataacctaaaacttaacaattgctaactaaacaataatggaacaacagagcacttgaaacacagtatctcgttagatcttcaaaacaacccagggagatggatattatctccattttacagaggagtacactgtaaaatgtagcaaaccgaggttacacagctactcagtggcagccgtgggatatgcacccaggcagctggctcttaacgtctatgctctaaaacgctgcgctccattaagttctcctgctggcagtgaggagcattttcctcttagattgggttctatgaatatcctaaaatagtacttaaacctttgaaatttgatgaaacttttttatatataattatatatttctattgtatttataatatatgctgagttaactttactatagtttaccaaattgtagaagttagttcagcttccaaatcttatttccaagcagtagcttcaaaacactggaagaatctggctcaaaatcagttacaacattttgccatgacagtataacacatacacgctgcattagatatttatatttctgctaaatatcagagatgctcaagttggtgattatgacagagctggccctccactgtggcagtttccattactaaattcactttacaagaatgcaggatcctgtttaacatttgatttaaactgatacttaacacgacaagatactactggcttcccctcccttttgtttccccattttaaaaaactaagccatcaaattgcctttcatttaaactaaaaaagaaaaatgttagttccaaagttggggattcttaatagattctagctggtacatttttaagtctgtatttgtaaatacagacctaataattttttttaaaaccaaagaaccaaaataacaaattaacttcatgaagactataagtaaggatattatttatttatttatttatttatttatttaattttccaagatagagtcttgctctgtctgtcgcccaggctggagtgcagtggcatgatctcggctcactgcagcctccacctcgtgggtttaagcaattctcctgcctcagcctcccaagtagctgggattacaggcatgcaccatcacgcctggctaatttttgtattttcagtagagacggggtttcaccatgttggccaggctggtctcaaactcctgacctcatgatccacttcagcctctcaaagtgctgggattacatgtgtgagccaccatgcccggctggtaagtaaggatataatggatatgcaacccgagtctacttcaacagagacatcagtggtatatttagaacccattaacaaatttaaatgatttatgtaaatacttacaaatattcacataagtttacacatatacattagagcagaaaaattctcagaaatcatgcatttttaaatttgtgatatacataaattgacaaaaattttcagcaataattaaaaatctttcccttgctcattacagtaaaatctaataatcatgaaaacttctattcttttaaaggagcagtgaaagaaataattttacaggcccaaaaagaaaagtccctggagtccctgcttcacaaatactactgcattatatccttacatataaccttcatctttaacctagcaaatagcatactcgggagattgctgcataatgcccatgctgacaatgatagtgatttgaaatcatgtagtttggggtttaaagaaacttggagatagtacaaggcaatccccctcatctgccagctgagtacactgataattgagtgacttccctgcaaggaccaagagtccttggtggagtccttcattaaatctttatttggtccagaagaaaagattcccctactaagatatctcttctgtattattcagaaaaaaagcaattctgaaactttttgttgttaggatccctttattgctttaaaattactgaggactccaaagagattttgttaatataagtctattaacattttctgcaatagaaattaaaactgaggaaatttttaaatatttattaattcactaaaaaccaactataataaactgtaacataaacagtatctttcatgaaaaacaactactttctaaaacaaaatgtaaggtgagatgagcagcactgttttacatttttggaaatctcttttttttttttttttttgagacggagtctcgccctgtcgcccaggctggagtgcagtggggcaaactcggcgcactgcaagctctgcctcccgggttcacaccattctcctgcctcagcctcccaagtagctgggactacaggcacccgtcatcacacccgactaattttttttttttttttgtattttttagtagagacagggtttcaccgcgttagccaggatggtcttgatctcctgacctcatgatccacccgcctctgcctcccaaagtgctgggattacaggcgtgagccaccgcgcccggccgcaaatctcttttcttgttaaatttcaaagacacatgcacagcaaatctctttaaatgtctggcttaatacaagaccactgggttttcccatctacttttgcattcaattttttgcaatacattgttctggttgaaggatatgaagaaatctggcctcacacagatacagtatatgcagttggaagtttcaaatcttaagtttttttatgtttgtttgtttgtttttgagacagggtctcactctgtcacccaggctagagtgcagtggcatgaacatggctcactgcagtcctgaccttccgggctcaagagatcctctcacctcagcctcctgagcagctgggaccacaggcacacaccaccattcctggctaatgttttagtttttcgtagagacacggtctcgctgtgttgaccagcctggtctcaaactcctgggctcaaacaatcttcccacctcaccccgtgaaagtactggaatttacaagtgtgagccaccacacccagccaaatcttaagtctttttatatacttgtggttatttcttctttactattacacctaaactcaacaaataatcatttcttaagtttagttgcaaggtagcatctgaattacataataaatttttcatactccgtaacattaaaatcctttgctttccccaaaatactgcgtaatttcaaagtgaaaaatagtacctttacaccagagaattctggcagacatcactctagccaagtgaccaagattaacgtcactagtaataattcctatcaacataacatatcctcgatttgatgccctgaaaagaggacatcacctctatggtattcttccaaatgacacataacctcaatgtaatcctgagagaatgtcaggaaaaaaattaattgagggacattctccagtagttcccaaagcgtcaaggtcattgaaagaccagggaactgtcagcctggaggaggctaaggagacaaggcgactaaatgcaatgtgagatcctgggttggattctggaccagaaaaagaacattagtagaaaaactggtgaaatcctaataaatattatactttagttaataatattgtaacaagattaatttcttagttttgatcattgtactttggttatgtaagatgtcctcataaggtaaagctgagtgataagcctaaagaaacgctgtactacttatgcaacccttctgtcagtcaaaaattatctcaaaataaaaagtttttaaaaatcacttgctctggccaggcacggtggctcacgcctgtaatcccagcactttgggaggctcaggcaggtggatcacctgaggtcaagagttccagaccagcctggccaacatgatgaaatcccatctctactttaaaaaaaaaaaaaaatacaaaaattaactgggtatggtggcgtgcacctgaagtcccagcttcctgggagcctgaggcaggagaatcacttgagcctgggaggcagagtttgcagtgagccgagaccatgccactgcattccagcctgggcaacagagcaagactctgtcaaaaaaaaaaaaaaaatcaattgttctatcttgtactctcaagatgtggaatattttaccaatgcatgattttgtaatatcatgcatgattttgtaatatcatgcatgattttgtaatatcatgcatgattttgtaatatcatgcatgattttgtaatatcatgcatgattttgtaatatcatgcatgattttgtaatatcatgcatgattttgtaatatcatgcatgattttgtaatatcatgcattggtcatctgaaaaataatggtttactgccaaataagacatatttcattatataatattttaaaaatcacatttgttaatatctcaactgatttcatcagaaaagtatttaaccattgagaaactgtcataatcatggtaatggatgtaagttttccaaaattttaacttgtgtgaaaaacgaaattttattattggcaacaaatactgttgttttccttgaactaacaggttcactttgttcattttcttttttttttttgaaatggagtttcactcttgttgcccaggctggagtgcaatggcaccatctcagttcactgcaacctccacctccagggttcaagcaattctcctgcctcagcctcctgagtagctgagactacaggtgcatgccaccacacccagctaatttttgtatttttagtagagactgggtttcaccatgttggccaggctggtcttgaactccggacctcaggtgatcggcccaccttggcctcccaaagtgctgggattacaggtgtgagcccccgcgcccggctcactttgttcattttcaaaaatgtctgccaaatactgaagtctggataaccatcagttgtctgtcagtcactctttcacatcaaatggtgttccatgaaaaacagaccagatcagctcacaactcaaacaactgcacagtgcttttcctcaagaaaatcattgtactttggaatgcagaaatgcaacatacgtacctcccattttaccatatagaataaggaaaaaacatgtatctgagggtaacaacactcttaaaggaaagtggcagatgttttactgcaagtgtgtgccagtgaagtactgccttcattcctgctgagtcaccagcagttttatccaatattgctcttatacaattagagcagtgttaacccaatcttggaattattataaaaatagttggccaggcgcagtggcttacacctgtaatcccagcactttgggaggccaaggcgggcagatcacgaggtcaggagttcaagaccagcctgaccaacatggtgaaaccccatctctgctaaaaatacaaaaaattagccaggagtggtggtgtgggcctgtaatcccagctactcaggaggttgaggcaggagaatcacttgaacctgggaggcgaaggttgctgtgagctgagatcacgccactgcactccagcctgggcaacagagcaagactccatctcaaaaaaaaaaaaaaaaaaaagtagttttaggccaggtggagtggctcacacctgtaatcacaacactttgggaggcaggtggattgcttgagttcaggagttcgagaccagcctgggcaacagagcaaaaccccgtctctaccaaaaaatacaaaaaattagccaagcatggtggtgtgcacctgtggccccagctacttgagaggctaaggtaagaggatcacttgagactgggagccgaaggttgcagtcagccaagaaatgtgcccctgcactccagcctgggtgacagagcaagactctgccaaaaaaaaaaagaaagaaagaaagaaaagaaaaaagaaaaagctgcaccagagcaaaagcaaaactaacttgactctcacggagcttacattttagtgggggaagataaataataaacataagtaaattacaagcagcttttgaggtgagaagtgctacgaggaaaaacagagcaagataagaaggaataggagtttctgtggttagagagggattacaattttaagtagggtggttagactgggactgagcctagaggtaccatatagatgaggaaaactaccaatacacagcctcaatccacttcacttgggttctcctgtcccccactggtcctgatcctcagcaccgccaccgttcttgagcattcatctttaccctgtaacttccagttaaagaccaagtcactgcctcaaaagaaaacaaggtcttttccatccaggtgctcagttcaaatccacctggctcagccaacagctcctcagccatctcccaaggacattccccaacctgctttttctccattgggagcacaaagctaaacagcaaatgcattctgcccataataaggttgttctagctctctctccccctcttttcctacacatatatattgtctaaataaagattaactttttgaagacctaactactatgtgccataaacttctggctgctttacaagtattttatcctcatcaaatcaaaggaataggtataattagcagtattgtatagataaggcaacaaaagctctgcaaaccacaaaactgggactcaaatctccaaaacaaaacaaaacaaaaagttggggggcagggagagcacttcttatccacaccctctcccaactccatcactcccattgtaccactgtggtatttccactgtactgctctaagtaaaacttacggaaaataaagaaactgggcatcaataaagtctgtttaacagcaacattatatttcaggatcagatctaatttttgtaccaaaaatatgcctgaataatagaactgcaacttaaaagactgattaaatatgtccaccatgtgttacggactgaatgtgtacccccctaaaatttgtatgttaaaatcctaaccccagtgtgatggtattgggagatggggcacgctaacaggtggagcaattaggtcatgaggacagcgctctcatgaatggtatgagtgtcttaaaagagactccagagaactctctagtttgtctttttgaggactgtatccatgtgaggatacaatgaaaagtcatcagtctgcaatttggaaaaggccctttccagaacctaaccatgctggcatcttgatcacagacttacagcctccagcactgtgagaaaaatacatttctgttgtttataagacatacaatctatgtgtgacttatatgtgactttgttatagcagtccaaactaggtaagtactatggtaacattttcaaagaatactatttccagtagtttcattcataataaacgtgatcctctggtttatatgcattatctcatttataatcctcacaagaacacaactgagacaggaactactgatacttcaattttacaaatgaggacactgagcctgtggtcacacagcctatgatctggacctgaacctgtgtgcctgaatccaaaacccaaggtcacaactagtgcacgatcctgactctctgacctttcatatgtctctgtcaagaccactcttgacactgtggtggagaattactttccctaaataaaggtgcagcaacccaacaaagttactcttcatcttgataaagccctcaggtattacccacattcagagggtaaaatctctacaaaatccttttgttacaagtccaaaatgaaagttcactggagtgactctgttccagcgaaactctgctgggaaagcccaacggcctgatggaaaggcacaacatccaatctttgggttccaagactgcctctaactctgacatttagtccaaaggaacaaggatattcattttactacatctcttgctcagcaacactagccttcagccttaaagaacatatctcacagtacacactgagctttgagttcctacaacttagagcaaaggcagccaggccgataactcactttagcaatagccttagttacacacccctgagctcactctccaggaaagtcagagggagtatcagttttcatcattattaatgaagagtagattgaagaggatagcattacagctctaaaacagaggttcttaaacataattctaataagacagacatgatgaatcttgttcacatttggacacactagagtcttcaaaagaaactagtgaaaactacaaaagcagtgctgaaagaaattaaggaaaacctaaacaaatgaatgggtgtaccatgttcatgaatagcaaaacagatactacaggcaacaaattatgagcacttttcattctatcacttgtaatcctaacttctctttctccctttgaaatatttttaaatgcaaataaccatacttattttagaataaccttgaatttagttttatctttttgaggaaaatcatttaaagtcttcaatttaactatcagttgtaatgttattcatgatatctcacaacctaactgggatatacaagtaggtcttgttatacagaattacctctccaaaataaaagcataatgagaccttttaaccataataaagcagcaaagaaaaatcatagtcttttgtcagtacaaaggctttcataattcctcatagctctcagatctgtgtttctatcaactcaaaaagttggctgggagtcatatgacagaaagggttaaaaatactaagctgctactctagacctgctggctgaggagcaggcaggttgcccagggtttcaggatagcccgcctcacacagagtaaacgtaggggatgctgtacacccaggaataaattcctcaaccagtgcatactctcctgaggcattcttgtaagctttttccaagttgagtaataaacagaaataatagatttttgggggcctttcctgagttcagggagatctgacaacatcacgaaatgtttcggcacagtcctctgaaatttttcattagaattcttttcttctgaatcatgttaataaagtaagatttggtctgggatttgtacataagtacttactcacatgttgctcaagcccaaaaggacaagaaaaagacgctgaggcctgtcaacaggaggcagggccaggctcaggaactggaagattactggatggatgttttcaaacagagctacacacagctcccttatataacactcaattggcttttagataagtctgaaatatccttctatactttgatcttcagctgtctccgttgccttcagagtcaacagaaactggcacttggctccaaaagcctcaaatctctctcatctataagggacagggacttctattatttgtctacaatttgtcaagctgagttaattataggtgttatcattctatatgtcaaatgtagcaaaataatgcaaacctgtttacctgtttcttcctttcctgcatgtagtataccctgaccttaaattggcatgcacttgatttcaaatgaagatttttttaaacagcatcttccaactgcagtagcagttggaaaattcactttttgctgacctgggccacctaaacagaggacatgaggaacctgacttgttttattttaagaagaaaaaactatttaaagccctgatcctggctcctttgaacatttaacacttaaaacctgaattgttacactacaaactagagttccttttcctctatttaagaagaggcccttgcgaagaatttatttagttaatgaaagttaaacaattgtgtttctctcacaaaacaaaaataaacaaaacctcttgaagatggtctctgggctctctaggtctgcaagtgtccatatgagctccctcacggagagcctagagcagtacactggcagtttagaaaacaatatagccacaagcacttctccaaaaagaaaagcaactcccctcttggcccaattccaaaacgcaattgagccgggtaaggtccaagctaatctctgtaccgtctctctgccaactttctcctgcaggcattaggtttttcagcatgggctttgcaaataatctaacaattaattagtgcttttgaattcaccccataccattaatggaacactgccagacagcctttgatagggtatttctagagctaattaagcttggcaaaacagaggacacaaacttcctggcactcacaagggccaggctgagacctggcaggtgacagacagtaaagttgtccttacagataatcctggggtgatgaaaatggcaggctgcttggatcaggctctcggagtcctctataatatgccagaccctactctcaaattatataactatcaggcttttcgcatttgagctattctttcaccctgaagacattttttttcttctgagtgaagatttgatacttaaaagtttggtattgcttctagtccacaccccatcctgtcacccccgaaaagggttagtttagaaaaaaacaaaaagttgtatactaggtttttttttactatatcttaaaataaatctcatctcaaaatgtccttcttccaatcaaagagtccttgcataatccaagatttctcactcctataacctcagtcacgtgggaaatctatttttttcactatctaatgtcacacagaattccagactgctccacatgcatggacagcaacataaacacatttttgggagggctagaaaaaagctagcaggggggcaaaaagaaaaaatattgttacattcctcaggacttttctggttcaatttcaaaagcagaatgaccaccacctgagtcttgcggcgagctccagagctgtacataggttgtacgctgcctctccaaaaacagtgatgaggccagagaaagcaaatcagaaaaccttataaactactcaatggcagtgtaaacaaataaaagttagtttaaaacacaacttttcaggcacagagcttaaatattctcagtcttatccccacttataataaatgtggtgtcagggtgcttaataaacatcaattacaacttacagaaatttttcccttctaaaaaatgttaattttttaaaagctctagactggagtgtgattataagaataaagtagggccgggcgcggtggctcatgcctgtaatcccagcactttgggaggatgaggcaggcagatcacctgaggttgggagttcgagaccagcctgagcaacatggagaaaccccattcctactaaaaatacaaaattagccaggcgtggtagtgcatgcctgtaatcccagctactcgggaggctgaggcaggagaatcgcttgaacccagtaggcggaggttgcagtgagccgagatcacgccattgcactccagcctgggcaacaagagcaaaactccatctcaaaaaaaaaaaaaaaaaaagaataaagtaggaagtcaatggggaaacctgagctagaaaattagagccctgctagcagaaatgaggtatacccaacttttaacttttagtccctaactccagagccaccctcgctaacccacctaaagtcccccttttatccactcagcccatatcacctctcattaccgaagagtcccttggccacaggttccgggaccaatgaccccgccctcagtgacccaacacgaatctcctaccttggtctactaagtcacaaggcaagaaatgagacaaggcaaaagaggcacataaaaggaagaaatggtgggggcgggaagaattccttctttaacaactgttaggattatgtcaaggtgtagccccagctaataaagatgcacctggtttctgcaggtgcaccacacttacagtcagagagctaaaggcatctgtggaactcactgcctcaaaccaacttcctctccagcacatggatccctctgacccaaacaagtttaccaaaggtgttcaaggtagctgttgtaaaggcatgctaaaatcaagctcccttttatggcactaagaaattgtctaggtgtttgcagtttctgtgttacaatttgtgcattgagaaaacagatgacctatgctgtcaaatgtggtcctcagactaacggtatcagcatcttatgagcctgttaaaaatctacagtctttgacccatcaaggcctactaaaacagaatctgcattttaacaagatccctgggtgattctcatgcatataagaaagcactggcctaatatttgtttataacctcaaactccaaaagcaaaacttcctattccataaacaagatggtatattccacctctggcaaaaccactcacctctggcaaaaccactatgaatatccttattataaaatatatttaaaagtgattattttctttatagaaaaaaatctgttgtatcatgctccttgctcacatttaatatgtagtttaacttataaaaataggttgacctacaactcagaaacatttactatgtaaaactggatgcaactgtatttcttcgaaactgtaatttacaacactgtaagaagcacttctgcaaaaggtggtaagaccctcaaaactcatgatcctgaaaaccaggccccctgagaaatgaaaagaacaagacttggaaatcaggagggtaagtaagcaaggaaaagagggtttaggctattaagacgatgatttttcaaggacattcattcacaacacaaagagattttctttagatggtttggggaggttgttttgtgttttaagactcagctttttcagttctatagatgtaattatctttaatattaggctatggcacagtattccactgatgtgagaaatacatctttatccactttcctcctcaaaaggaataggttggggaaaaattacaaaagcatcattctgaatttcctaagcatatgactcccaagggtccttccttctaataaggagtcctggtcatcattttctcttgccagtatctccaaatccacctttgcccaacagcctattctcagcccagcagccagagtggtcctgttaagacatccttcagatcatatcattcttctgctcaaactctccaatggctcagtgtcattcagagtgagaaccttatgatggcctgcaatgccttgggctatacacacccgcaccgtctcccacccctcagttaactctctgacttcccattccagcaggcacctggcccacctgctattgcctgagcactgcaagcaaacttccaccacagggcctctgcacttgcttttcctgctgcctggaatgctctttccccagatatccacttagctcacctcctccaaacctttgctcaatgttcctagtgaagcccttcctaatcaccttacttcaaattgcaatccccgctaacaatccccaacctctttgctttttattcgacgaacctgctgatatatgcattttgtttgtttctggtctctctccactagagacatgcttcataaggacaaggatttttatctgttttgtttactactatctctccaacacttggaatagtgtctgaaatacaataggtactcagtaaatccttgttaaatcaatcaatcaacactttaggaaagttaactgtattagaaaaaaatgaaaaggccagcgaggtggctcacgcctgtaatcccagcactttgggaggccgaggcgggccgatcacgaggtcaggagattgagaccatcctggctaacacggtgaaaccccgtctctgctaaaaatacaaaaaattagccgggcatggtggcgggtgcctgtagtcccagctactcgggaggctgaggcaggagaatgcatgaacctgggaggcagagcttgcagtgagctgagatcgcgtcactgcactccagcctgggcaacagagcaagactccatctcaaaaaaaaaaaaaaaaaaaaaaaagaaagaaaaagaaaaaaatgaaaaaactcattatttgcactaaccccaaagtctctcccctttctgtgcctcagaagctagcaaagtacctgaatcttaggaggtacttaacgttgaccagactacaagtcttcatctaaaacatagtagttatttaaaagtataaagaaaaggcaaaataagtggttctgtcctctaattaactcaaaaggaaaagataagggcgggcaggagctatagagcattttgcttcaccatgtagtattataactttaactttcagcaatttaacaacataattgtcatgcacaggtgcatcccactggaaaagttcatcacaggaaaatgctgtagcagtccagcggggtcaatgatgaaaacaacacagcagggaggccaggcgtggtggctcacgcctgtaatcctggcactttgggaggctaaggtgggcagatcacttgaggccagaagtttgagaccagcctaggcaacacagtgagatgtcatctctataaaagatcacaaaattagccaggtgtggtgccacgtgcctgtagtcccacctacataggaggctgaggcaggaagatctcttgagcctgggaggttgaggctgcagtgagccaagactgcactactgcactccagcctgggtgacagagcaagaccctgtctcaaaaaaaaaaaaaaaaaaaaaaaaaatgcagagcaggggctgactccagaggctgaacctctgccctcctttgaggcctatgctacctgtgtatcctcatgggtggagtaggagagtaggaaggaagggaggtgttactcagatggccctggtcaatcttctggactaggacgcagttactcaggcatatgaggacaaaaggaagcaaaacaaagaacacagagcaattttatcaagaccttttccttttgccatatatggttcccctcattgccaacaaacagagtaactttaaaataattttttaaatcaacatttccctttgaaggtagtaaaattttccacattacactgtagatttttttaaagatgtttaagagctggcaagggagggcaggggaatagctgggcttcagtccccagagcacctgctgcctactccttggaaggaacgttccaagagctatggcatttttcagccctctagaattccacctgattgacagtgccctctcagaaaacaaaaatatgactagattgaagttcaggataaatgttttttaggccattctggcagagatcgttttaaagaaaatgaaagtcagtggctgccatggatgtggtgcgggatgggccaatcatgcgcctcggtgctgagcagggtcagtcctaaaggaaggcctcttgctggcacgcttcccggaacacttcccagaacactccctgctcctacatcacttccaaaatcagcgtgctcagagctcgaagctctatggggtgataaagatacctccagagttggattaattaccaaagcaaacaagctgagaaagtctaatttcctatatacacaaccgtgtgcaagggtaagcttttagcaattaaagagctgtgtaggcacatacagataaagctgtgtcttgatggaagtgttgatcactgtaaaacacaccatcactgctgtcctaaaataacccaaatcaatcagaaatccagaaagctgggtggcaattatacagcctacgataaggatgcaaagcaaagagaaacctcgattctcttgacttggctaacatcacatctagcaataatcttactcattcttggtaaacatcctcccctccactatatgcacattcagttgcccaactagctattagtaaactctccttgaaaatgataaaaagggccaggtacagtggctcacgcctgtaatcctagcactttgggaggccaaggcaggtggattgcttagctcaagagtttgagaccagcttggaaaacatggcgaaaccttgtctctacaaaaaatacaaaacttagccaggtgtggtggcatgtgcctgtagttccagctactcaagaggctgaggtgggaggatcgtttgagcccaggaggccaaggctgcagtgagctaccgtgccactgcactccagcctgggcaacagagtgagaccctgtctcagggaaaaaaaaaaagtaaaaggccttgcattaggctatccaccccacctccacacacacacaggtccatacagggcaagggaatctttgagaaatgaactcacctttctctcaactactgcctcaactcccgtgtgtgtgtatgtgtgtgtgtgcgcatgcatgtgtgtgttgtgtttgcacacgcatgcacgcacatgctgtttctgtagaaaaatctaatggagaaggtaggtggggaggtgcttcatcacacttggctgtgcacaatatcctcaaagggaatacactctaaaatgcaggctaccctatccactctgggtctttcttttatttttgagacctagtttcgctcttgttgcccaggctggagtgcagtggcgccatctcggctcaccgcaacctccgcctcccaggttcaagtggttctcctgcctcagcctctcgagtagctgggattacaggcagccaccaccatgccactctaggtcttttaatagcagttatttgctctttaaaataaagtttggcactctggtgataactggtatcacatttgacaatatcctttccttgtgtatcaaaaagcagaattaaacacaaaactggttaaaataaccagctaaaggccaggcatgatggctcacacctataatcctagcactttgggaggccgatatgggtggaccacttgagctcaagagttccaaaccagcctgggcaacatggcggaaccccatctctacagaaaaaaaacacaaaaattagccaggcatagcggcgtgcacccgtagtcccagctacttgggggtctgtggggggaaaatggcttgaacctgggaggtcgaggctgcagtgagccatgatcgcgccactgcactccagcccaggcaacagagtgagaccctgtctcaaaaaaacaaataaaataaaaataagataaaataatcagctaaaaacaataataatcacagaccaaatcaactagctgtgttctaagacctgagggttggcaaaaaaaaaaaaaaaaaaaaaaagaagaagaagaaaaaaaggggagggggctttttttcagtttgctttgaacctttgagcctatccatcttctatccttacattccctggtggtagtcccctgccagcaccctccagccttcctgcccttatgagtattacagcctttgatcactcgtttggcagacaggagataactatggcagaaccacctctgaggttcacaggccgttaactcacatccaagatttctctttcaagtacaggataaatgaataaattgaataatgaaaatgtggtatatatacacagtggaatactatacagccttaaaaaagaaggaaatcctgtcatttgcaacaacacagatgaacatggaggacattatgctcagagaaataagccaggcacagagcgacaaatatcatatatgatcaaacttatatgcggaatcttaaaaagccaaactcatggccgggagcggtggctcaggcctgtaatcccagaacttttggaggccaaggcgggcagatcacaaggtcaggagttcgagaccagcgtggccaatatggtgaaaccccatctctactaaaaataacaaaaattggccaggtgtggcggcgcatgcctgtagtcccagtcaggaggccaaggcaggagaatcactcgaacccgggaggcggaggttgcagtgagctgagatcatgctactgcactccagcctgggtgacacagtgagactccatcccaccccctcccagaaaaaaagtcaaactcatagaaacagtaaaatggtggttaccagaggctggggagtgggggtggaaggactgaggagatgttggtcaaatatacaaaatttcaattagacaggaggaataagttcaagagattgactgtacaccatggtgactatagttaataacaaggtattatagtagccactgccaccactgagcctaagatggccatgacccctgtagaggtgacccccactcacctacccctctaggactcatgccttcctcaaaaatgcctgggccatggagctggtgccagtcatgtccttcaccatgggggccaatactcagcccctaccaagtacaacatcatgaccaaccaggtgacgccctgaaactatctagtgcccttccaaggtggtaggaacatgctgacatacagagccacctccaggacccccagtgcccagcttggagctgccaaagaaactgtgaccacctcactcgacagtgaggaggcccccttcctacagccccctataaaaatgtgaaaaaaaataatatattttacacatgaaaattgttaagagagtatattttaagtgttctcaccacaaaaaatgataagtgtgtgaggttatgcatatgttaaaaagcttgatttactcaccacaatgtagacatgtataaaaacatcatgatgtacaccataaatatatacaatttttatttgtcaagaggtgctaagggtgcactataccaaaaaggtcacaggatttgttggtgcagtttgtctgcaaaagcatgtctaagttctggtccaaccaagacttgaattatctttctaaatcacttactttctctaagccctattattctcattctagaaatgaagaaaatagtgcctgcctacccccagaggctgctgtgaggatcaaatgaaatacctgttataaaaacatttttaagattacaaatacaatatggtattattagcctctactcaaggctgccagcttgtaccattccagaccaagtattaaccagctggtatctcagcttgctctcccacagacacaaagagttcagagctttctgagcaggaaaatagctcagactaaaagcatctcgattttcctgtggactctacctggaattccaggtacatccagtagagaggaaaagaaatgtgtttctcaatagaaatctgtgcacagtttgcaggcgagtttccaaaaggatacatctgggtactgaattgagacagtggaatgaagaagttagccattccaccaagagcccactggcatcaatgccagcagccctgctccagagctcacctcagcggcacccctctcacctggcacaaggggccagtgataactccagcccttccaataaaactgatttccctgaattctccatgcatgcctctttttcttattactaaaactcctggaaacatagccctgcctaatgttggcaagcctcagaggcagcagctaatatcttttaaagatgtgtagaacagttgggaggttgttttgtttttgtttttgtttttgccttttcaagtttttatttttatccattttttgtattaaaaagaaaagcacaattatcacaaattacaaaggaggaaagcagaactagaataataaatgaatcacttcagcctggaaagcagatattttcaataatagtaatgttataacacaagtatagacgagtttttaaagcaaaacttagacttaagcccatagtatcaagcacttattttttaaacttcccacttttcttacattaggtagcttacaggatctaagaggccaataaataaccttagataatttctttttttttcttttttgtttttaaccccaataaatctcttgtatttattctctctcttttttttttaacccaagtaaatcacctaagctaatttctaatcaagaggcattatggtccttacacagctcgtgttcaccaagagcacagtccaccctccatcctcaacagtgctatatgataacgaaggaacgagggaggggagggaaagcatgagttttttgttttttgagacggagtttggctctgtcgcccaggctggagtgcagtggcgcgatctcagctcactgcaagctccgcctcccgggttcacaccattcttctgcctcagcctccccagtagctgggactacaggcgtccgccaccgcgcgtggctaattttgtttttgtacttttagtagagacggggtttcaccgtgttagccaggatggtctcaatctcctgacctcgtaatctgcccgcctcggcctcccaaagtgctgggattacaggcgtgagccaccacgcccagccgaaagcatgagttttgtcagaacaacactaacactgggacatggatatcccccgacccacccggccccgactgccttcattcactctctatcacaagcagagaaggaaagaaaggttttcactgaaggcccagacaaacctatggagctggaacaagcaggctcctattattctaacttgggctcaatttacgtgctcccttgtgctctgcccctcctctggccacataaccaaaaggaggcctttgacaaccttcacccctctgctgccagacctccacaccttcccaccgatttacagctttaaggccactttggttaagtcagaatatgaataaagaaggcccactacttgagggtccttctgctctgatgacctgtgtctgtctcttctgaggccaaaggggcttaatctggttccaggatgtcacactggtagctactcacctggtatttaatcaatcaagaagaggtttattcatcccacacacagggtctcctccctagagaaggatctagtggttgatgggctggattctagagccaaactgccaggttcaagtctcaactctgccacttattagttccaggactttgtacaaattattaaccaaactgagtctcaatttccttgtttgtaaaatggaggtgatgataataataatacccatctcatagagttgtcttaaataaattagctggcagagatcaagcccttgataaatgacagcctgtgagccaagcactgctgggtctgaagctaatgaggccacatactcagcctcactgtttgaggccaccgtttgaattccaagattaaacagtgcatgcctttggctccaagggatggaagaagagagcatccaaaccacagaataaaatccacaagcctcattatgatatttaagaactttcataatctactccatccttctttccaaatagacctcctgctacatttccacaccagctctccaggtcatccatttatttaaaaaaaaaaaaaaattaagcacctaaatgccacattccgtgctaggccaggttttcccacctggtgaactcagtgcctccttcttcctagattctgcccagtcttcaagacagagttcaagatctagagcttccacatagctgtccctggctactctgacccacagggcttcccctcgtgacccctctgaggtctttgggttttacttggctttcactacacattcattatttggttatatggttatattttataagcctaaataaagtacaagcaactcaaaagaagggatgaatatggctgggcacagtggctcacgcctttaatcccagtgctttgagaggctgaggtgggaggatcacttgaggtcaagagttcaaggtcaacctggacaacacagcaagatcccatctctccaaaaataaaaaaaatagggtgggaacgaatcttacatttctttgcatgtatatccctaagtgactactactgtgctttgtactcagcagggatcagtgaataaatgatttaatgtttcaggaggacataaatggctcaaaacctattaccattctttccaaacaaatgatttccttcaaatcaatatagtagagaggcctaaaggctcaatctccagacctggactaagtaggtttatagttccacctgccatttattagctgtgtgaccttaagaaagttatttgacctctctgtgcttccatttcctcacttataaactatggattattaaagtatctatatttcttagagtatttatgaggatgaaatgagataatacatgtaaagaaatttggggcctgacacacagtaattatttgaaatattcatcattgttataactacccagatgagctaaattcagctcatccagaatgcccaaaaaaccattttgtaaagtatgctgggcctacagagaaaaatatcagatattagcatataaaaaattttttttgcagccaggcacagtggctcacacctgtaatcccagcactttgggaggccgaggcaggcggattgcctgagctcaggagttcacgaccagcctgggcaacacgatgaaaccccatctctactaaaatacaaaaaattagctgggcgtggcagcgtgtgcctgtactcccatctactcgggaggttgaggcaggagaattgcttgaacccaggagatggaggttacaatgagccaagattgtgccactgcactgtagccggggcgagtgagactctgtctcaaaaaaaaaaaaaaaaaaaaaaacaaaatttccctcttcttcattcatttgatctattatgttgtgcaaaagggaaacaaccaacaaacttctacaccaaaaaggcatccatacctctgtgctatttatcagttgcctcatgctattataaaatctgtaattcatccagcggtggtggctcacacctgtaatcccagcgttttcagaggctgaagggggtggatcacttgaggtcaggagttcgagaccagcctggccaacatgacaaaaccccatctctaccaaaaatacaaaaattagctggatatggtggtgcatgcctgtaatcccagctactcaggaggctgaggcaggagaatcgcttgaaccaggaggcagaggttgcagtgagccgagatggcaccactgcactccagcctgggtgacacacagagcgagactctgtatcaaaaaaaaaaaaaaaatctgtaactctactgtcccttccacctcagcaaagccttgagtgtgtattcaactcaaatatatatatacttgtgtgtatattttcccaaaggcttcaaataggaaaggaagatctgaagcaaaactgattcactatcaaattcatcaaggctggacagggccattgaactcactcctttcccataaagtgccttcttcagttgtgtttttcagtctgacccaggcatcaatgaaggcagaaagcccagcctcaaacccacaaggtgagactagacatcttgtcatcaaaacagcatgttttccatcaagccgcttctctccctctttctctctctctttttttttgggaggtgggggtgggggggtgcatttctactacttttcgatgagattttaagtcaattccattttaatacacaggctaaaaggcaaatagcacttcaataatgagacaaaatgaaactgctgatagacaaaaatagagaatgggcagttgaaattcataaactggcattcaaaaaacaacaacaacaaaaaaggcctagcaactttctttcaagatatttatagccaggggaagtggctcacgcctgtaatcccagcactttgggaggctgaggccaggagatcgagaccagcctggctaacatggtgaaaccttgtctctactaaaaatacaaaaaattagccaggcatggtggcacacgcctgtagtcccagctactcggaaggctgaggcaggagaatcgcttgaacccaggagacagaggttgcagtgagccgagatcacaccagtgcactccagcctgggcaacagagggagactccatctcaaaaaaaaaaaaaaaaaaagatacttgcaatgagaggaacattctactttccaatccataaaccagtttctgccagctgactctcgcttagtctacgtctgcacacaaccccagatctgagtctattggagtcttaagggagatctggtttcttcagtataacacagaggtgaagagcatagatgtaaaatctgaatgtaaaatctggctcttccactttccagctacatgacactacgcaagttacctaatctctccatatctcatttcatcatttataaaatgccaaattaattctacctccaagttgtgattaagtgagctcattaaataagaatatccttattcatttttatattctttaattgtttagcccagtgcctggatatagtgcccactcaatagatgatcattactatcactctcatctgtatgtgcaattcaacagccaaaaccaagcagctaatcacttttcgagtcaatgcttttcttgctgagacctgccagtttccagaactggtccaacaaattagttttatgtagctcattacagaatagacacaatggaaattataataaaatagagcaaattaagcttccaaatttactaagtaacccctcacagtaaacacactaagatggtggtgtgggagatccgatactcttagttaagcaacaatgttccaagtcatttgcatcttttcatctccaatctcatttggcctccaggaagctcagtgtatttctctactttttaaaaagttagtaatcccagcactttgggagaccaaggtaggcggatcacctgaggtcaggagttcaagaccagcatggccaaaatggtgaaaccctgtctctattaaaaatacaaatattatccacgtgtagtggcaggcatctgcagtcccagctacttgggaggctgaggcacgagaattgcttgaacccaagaggaggaggttgcagtgagccgagatcaggccattgcactccagcctgggtgacagagcaagactctgtctccacaaaaaaaaaaaaaaaaaaaaaaaaaaaaggttacatattgaaatatgtgaaataggcaaaactaaatacctcccaagcagcctatgtcaagagtgtcacctcaatctagaagatctatttatttgctaataaaggacaaaaatgctttcttgaaatccttattcagggacaaaaatgtaaatacaggtcaggcacagtggcacatacctgtaataccagcatgctaggaggccaagaagagaggatcacttgaggtcaggagtttgaaaccagcctgagcaacataggaaaccctatctctacaaaaaataaaacattagctgggcatggtggcacacgcctgtagtcccaactagttaggaggctgaggtgggaggatcgcttaagcccaggaggtagagcctacagtaagccatgattatgcctctgcactccagcctgggtaacagagtgaaacttcatctcaactaaagagactgggacaaaatatatccaaaaatatataacaaatatgcaatttatattatgcaacttacctgcagtggctaaacaggagctcatcagggcaaagatggcaatcacataatgggaagtcatttttatttctccaacagtgcgtctcgtccagtcacttcagcctgctcagagcacagacaatctttgcaaatcagaagtagtcttaaagtccctccttgcaattttcaaactgcctgtaaaacaaatttcaataagaaaacttaatgaagaaacttcataaacaaacagacactaaaattaaacagagaatttctgaaaagcgtaatgtaagaaatttatcttaaaagatgcaaaatagcactcaagcaaactagactgagggcagtgactatctaataaagatttttatagcaaatacttttgcaaatgacatatttgttattggctttttttttttttttttgagatagagtctctctctgtcgccaagctggagcacagtggcgcagtcttggctcactgcaacctccgcctcctgggttcaagcgattctcctgcctcagcctcccaagtagctgggattacagacatgcgccactacgcctggctaatttttgtatttttagtagagatggggtttcaccatgttggccaggctggtcttgaactcctgacctcgtgatctgcccacctcagcctcccaaagtgctgggattacaggcgtgagccaccacgcccggccctgtttttgacattttaaatctttggttttatagagaattttcagaactacagaagaaaatcaaggtgcacctgaaatataacaccaccagttaagttgtggtaccaaagtaatcaatgacacttgatacatgcaaccctagtgccagcaagaaaacaaaaccagcactgattagagactcaatctaatgttataataacagggttatcacaaggatcaaattaagttgtgctaggaatcaatctgaaaaaaataaagaaacataaaaaggcaaggttcttatttcaactgtttgccaacattttaacaggaaaaaagtcttccctgtctctcagcccatctgagactatctggttactggactcaaggatctagaaggttctttctaagcttttcctatccagagtcttcaatgagagttttgtggtggtttgcctaacttgaatattcctcacacggccctaatggtcactgatttagacactccaaagtatatttctccagccctctatccctgagcctggcacaactcacagaagttcaattaacaaacatgtactgagcatttactatgctccaggcatggttccttctcatcaagaataaaagttatgggtaaaagtgcaaagaccctccctgatctaagccctggaaaaggcagaatggtggcatttccgggagccatctcacacacctgggggttgtggccttgtcatcctcactcaggaaatatcacgcaacaggagttgcccatagctaccttcagagacaaagccaatgtgggcgcttgtagataacagtacaaaaaaaattattttaaatgagtttttaattaaatggtcttaatttattgcatcaagtgacaaagagagatatttaaaatggctctttgcaattgtaactttacctatgagaacgggggaaatagggtgactgcaggacaggggtgggagggagcagaagcttttcactgaattcccttctgggttttgtattaataccatgtgcaagtattacctatccagaaataataacagtaaagttccaatttcaaaaagaatttcttagatatgtcttgaaactaaattattatataggcaggaggccactatggttcaatcttgatatacgatagtgattaaaatcctagtatgaatagcatacggattatgataaagattaaaaatctgcctgggtgtgaatccactctgccccttaccaaatggtaatgttaggcagcttactcttcttgaatgaacatatcctgtggtaggaaatgtatggtaggctgttgtgaggattcagttagttaatatacatacacaatgcttagaacagtccctagcacgtaacaaccaaccaaataaatgttagctacaattactgtactgtatcactacttgtccattctctttgagctatttataccaataaagtggagaaattaagatatagctatttatgtaattcttagctactgtaaatccagttcaatcttttgtttactgaaaaataaacattacaacagtcaaaaggagataagctaaagagtggactcactaaaagaacaaaattaccagtcaagttgaggcataagtcatcaatgacacaacggtcttgtctcaaaagctgactaaattatagagataatttgggagccattaaactgacttattatccctctaagtcgaacatttctgtcaccataattccacatcaactctgatcatatggaaatcttctccgttaacttaaaaattcaaccaccacaaagaggatctgtctctatttttttcccttcgaaatattagattccctaaattagtgaattggttcacaagaactatagtgcctcctgcctatataataattttgataaggaaaaacctctctgaaacaatatgctatttcagcaaatgttaaagacaacttttataaagcaaatccctgtaaggagatctcagaagaagatgacttcccagaggattttatgaagcacataaactgtaagcggcacgaggcttgtgggaatatttaatgagcttgcgtcaccctgcccacagctgcagtgggtctgagggtctgtgctgcgttaatccaggggcttaagccaggtctgaacaaacctgtggaaaagaaaggcaaatggttccattaaaaatataggctgcaaattgctgacaagaatattgggcaattattaaaatgcagcaattacagatataatagagccaagctaaacagtttgatgcccaaaggcaaaccacagcaagtttacaccggatcttaaaacatctctgaggaagtcctggacaagttgaaactacacactgctgtttgtaacaaaaagggagcttttcttcttttagcttaaaagtctctccataatgtaactgttcaaaaagaaaataaactgcagaaggtttttgtctaatctccccagtgtggtgaaagattcccaaggcagaggagaagcaaaagggaagtgtgtcattctcattcagctgaactccagttttggccacaacttgtacacctcagtgccttaacacccgacttaggaatcagttccctggaatgctggatggactgaaggcttccgaaaagttgtagctttgataaaactaacgaaatacaaactcctctttcttctgtgaggttctaccacactgactgcaaacatcagggactcccaatcctgactttttgacctcaaagaatctctggactttatgaactaaatgctttctttagaaatatgggttctggctgggcacagtggctcatgcctgtaatcccagcactttgggaggccgagctgggcagaacacctgaggtcaggagttcaagaccagcctggccaacctggcgaaactccagctcaaccaaaaatacaaaagttagccaggcgtggtggtacgtgcctgtaatcccagctactcgggaggctgaggcaggagaatcacttgaacccaggagagggaaattgcaatgagccgagattatgccactgcactccagcctggacaacagagtgagactccatctcaaaaaaaaaaaaaaaaagaaaaaaagaaagaaagaaatataggttctgtctatggagtagccattcctttattcctttactttcttaataaacttgctttcacttaaaaaaaaaaaaaaagtagaaatacctaatgtaaatgatgagttaatggtttcagcaaaccaacatggcacatgtatacctaatgtatacctatgtaacaaacctgcacattgtgcacatgtaccctagaacttaaagtatttatttaaaaaaaaagtagaaatataaatagggtactctgagatcatgaaagagcaatttggaataatagtcattttccccacatttcaaagcaacatgttccatttaaaaggtaggtgaactttgatgaactgaagaacacttagtattcatcaatgaacataagaaaattctgagaacttggccgggcgcggtggctcacgcctgtaatcccagcactttgggaggccgaggcgggtggatcacgaggtcaggagatcgagaccatcttggctaacatggtgaaaccccgtttctacttaaaatacaaaaaattagccgggcgcggtggcaggcacctgtagtcccagctactcgggaggctgagacagaagaatggcgtgaacccaggaggcggagcttgcagtgagctgagatcgcgccactgcactccagcctgggtgacagagcgagactacgtctcccaaaaaaaaaaaaaaaaagaaaattcttagaacttaatgggtttaaaaaaaaagcaaacaaatgtgctgctaattctgctaatttcagagatcccctgggtttatttctgagtccattaaactgagcatactgccccacatgccctcatgacccaacagagtgcacaggtaaagaccaagattagctgaaaaaatcccatccaaatgaatcctcaaaaccatcacgttctaaaccaatattcaaaaggatctggttgggtacaatattccctaaggtgaggagagaaatcttgctctatctaagagaaaaactgtggcaaaatggatgtctggcaataggctaaaaaccagtaagaaaaaattagtagcttccccttagatggctaacatggcctggctacatccatgagttgattcagaatcagaactaaactaatccccatcttcagatagatttggcacaatgagagaaaaagtcctagatttggataagaaatcttcggaatcacatccaagcacaactgatattcaataaatattactgctatatgccaggcactgttcaagatgccagggatatagcaatgaaaaaaagacgccaaaaatcctgccctcagggagcttatatccgagtaaaaatatcatttactacttctcacaagacatttaatttcctgagtttctcctttcaacaaatctttattgcttactctgctaagcagtggccaaggagacatgttttttgcccttgtgggcttaaaagctggtgagataaacagacaataatcacaaacatgtaactacacgatataatcagagctctaaaggaaaagtatacgcaacctgaggataagcgaagattttaaaagtcaggtgatgaatgacactgcaggcagaggaagcattacaggagggaggagagctgcagagctgaaagggaaagagaagaggaataagttcaaggaggggtttaaacagggaatagcgtgatcagatgggattactaaagatttccctcacgctgtacagagaacagactgaagggaggccagactgcctggacaatcagttgagattctcacagcatgtcagacaagaaaggatggaggtttagatcagaatggagcctcagtttcctcctttgtaaagagtgtaacagacaaaacttagctacatcacagagttgttgcaagaatcaaatgagattgtgcatgtatagtattaaaactatcatttatcattagcaagctgtttctaccaaagagatttattatcctgaggtatcagattaattagtcccaacattctgtggctgccagtggcaggaaaagaaaggaggaagattactctggaaccacctgtactggtaggcacgggggaagcagtacgcacagatggtacgaggagagcagagaagcctgactccactctgcctgttctgtgccggctgccttcagaggcaaggtgggctgtccctccagagcaggcccaccctcattcctggctgggagcatgatcaacaaatctggccccagcagccttggtttccttggggccgaacttcagtccgtccttaagagcccttccatctatcccaagcacaacacacctcactcccaaggaaaatacaggaaaaagggagggtgggtgttgacacatttcacaaagttggaaaagaccatgttttattcaaactcacaaactaggatggctttttcacccacccttgcaatactctaagaaccaccttttcacatttaagatttttgcatccaaaggtttctgtaccttttcatttataagggtgtctgcttttaagctagaattaataaagaactgtatttgggggttcaaaacctggcttacccagctgtgttacattggaaaagtcatttagcccctaccacgccctcatctgtaaaatggtagcaatattttgattataatataagacagaatataggcatggtacctaaaacaatacctggcccacacagtctattttattttattctttcttttttgagatggagtctcactctgccacccaggctggagtgcagtggcacgatgtcagctcactgcaacctctgcctttgggttcaagcaattctcttgtctcagcctcccaaatagccaggattacaggcatgtgccaccacgcctggctaatttttgtatttttagtagagacagggtttcgccatgttggcccagctggtctcgagctcctgacctcaggtgatcaacccacctcagcctcacaatgtgctgggattacaggtgtgaaccactgtgctcggccccacactgtctattttaaataaataatagtcattggtatttttatggttaaaatatacctagacttccaaaaagaaaataagcaaactactagtagcaaggcaacagaaatagttgtttatagcaaattttgtattatttttgagattagactttatcatctagaatttcaaaaattccctccatcacaaaaaaatgattccaaattccatacaaggtatgggttctaaagatactcataatgtagcaaaactgtccaaatggtggtgaagccattgcctcaacatttctggtataagttacagggatctggctgcagggcccttctcgattctatttgatgattcccaattagctgcaggggttcagctgggggctgtggaacttggtctggcactgccaccaaaccaaccaagctacctagaatgaggaatcagctgtcatcaaaaaggtttaaatcataaagctgtaattattcgagcaaaattcagcatatcagaatattctcaggacaacagtcatcctccctcaggccctagcaagcacctggccattgaaaaaagcttttgatagcctggacaacatagtgaaacgctgtctctacaaaaaatttaaaagtgcaccaggtgtggtggtttagagcccaggcatgtgaaacactaagaattaaaactcttcaatggttgcccactgccgtccagataaacagcaaaacttcacatggccaccaaccatcgtctagttagtccaagctcatcttctgcacactccagccacactagtgtcaattcagtcccacaaaagggccaagtcctcaccttccaaaagtgatgttcactatatcggaactcaacatccctccatggtccctaggatggtcactttctaacatcttcaggtctcagcaaaagccttacttcttgaaggaagcctcctctgattcccttggaccaagttaaacttggacacctagaacgcagtacaacccttcaggttgtaattattatgtaattatttccttccaagtatggctttcccactgtcttaattccagcaaggcggatcacagtctacctacacttggctgacagcgggcatctaatgagggtaccacagtggactacaggtataaatactactgtgcacactacaataaaaatagtacaggccgggagtggtagctcacacctgtaatcacagcactttggtaggccaaggtgggcagatcacttgaggtcaggagttccagaccaacctggccaacatggtgaaatcacatctctacaagaaatacagaattagccaggtgtagtggcacatgcctgtaatctcagctactcgggaggctgaggcaggagaaccgcttgaactcggcaggcagaggttacagtgagctgagatcacgccactgcattccagcctaggcaacagagcgagactccgtctcaaacaaaagaaaaaagaaaaaatagtacagcaggatgataaattagaacatttctcaataacaagagttatgtataagaacctcaggcatcctcaaaggaaaaggaggcaggagtgcgaccatcagcatgttttaccagctcagaccttctgcatcctacttccctcatttctaatatgaagaaattaaacaagaaaatcttttattctatatcatactataattgtcattacatggactaataatcctgaatcccttctagaaaatgagacttcaaacacacttgtggaaatctgaaatgcataattatgtaaaggctagcaggaataacttcacaaaacagaaaagtgttatccaagaaaaatattcaacttggcaacataagaataaacagaatattaatactacattagctattttaatatataacttacgtaaacaaaaattatttaaatgcagtatcttcccaacaatgtaagcacacaaaaaacctgaattttgtcagatctaaccattttatcacaatctgccatctttatgctattcctcaaagtccaagaactctaccaatagtcctcacctcattccaaaagagacttctgattaatcccatcctactgtgaacattctgtcacttatcattttgtgtataatttgttccatgttatcttctagtcagagccaatttggaatgctagaacaggtagtatctactccgaccctttaattttacagattagcaaaccaaaaattagaaaggctcaacgactggcccagctttacacagctacttagttacaaagccaagacttgtccacatgctgctttgtaattattctgtggttgatcaagtgtctataccttattccccttcctgtcagaagctgacatctctgctttcttctgaacccacaaaatgtctgttatcatctactgaacacctatcatgtatatcacaatttcccatttaatcttctcaacaatacaaggagacagatgccctttactccattttgtagtgagaaaggtgaggcttcaagatgctaagtaaggctgggtacagtggttcacacctataatcccagcactttgggaggcagaggccaaaggctcccttgaagccaggagttcatgaccagcctgggaaacatagaaaaaataaaaataatttgaatatcaggagtttctgaaaataaataaataaataaatacaaacacaaatattagccaggcatggtggcgcatgccaatagtcctagctacttggaaggctgaggcagggggatcacttgagcccagaagttcaaggctgcaagtgagctacaatggcaccactgcactccagcctgggcaacagagtgggactctgctctgtcaccaaaaaaaaaaaaaagatgctaagcaaccccaagtcaccagcttataaatcctggcaccaggacttaaacctaggtctgtctaattccacgcccatgctcttaactactacaaacaagagatcctccagaaacagctgactttcaaaaaaaagatagggactgtgcctattactaagccactgtagacatcaaccaggccctgcatggacactcactttctggtggtgggtagtctgatgagatctggcacaagggacaaattattttgttctgaaaccagggtggcaggccttgatcagcagttttagtttacttcattcattcactcaacaaacatttattagcgcctaccctgtcctgggcactgttcagggaggtgggcacatagcagcaaattaaacacactcctgttttcacataggttaccttctaaaggtggggacagacaagacaacaaataaataatatgtcaaggcatgagaagacctaggaaaggaaaataaagcaggttaaggagagagagtgatgacaggagggatgctattttagacagggtggtcagagagggcctcccagacaaggtaacatttaagcacagaggtaagagataaagctatgacaatatctaaaggaaaaacctcccaggcagtgggaatagtgagtgcaaaggtcctgaggtaagagcatgcttggtttgtcctagaagcagactacagtacagcatagtggaaagtgcggggcccccatagcctacctgagttcaaatcccccacctgccttttctaagcaatataattttgggcaacttacttaaagctccatgcctgatctataaagtagagataatgattctacctccttcatgggattgttatgatgactaactaaattaataaataaagcacttacttcctagtatgttgttagaattcaggaaatggtagctttgattatttttaactactcactgataactcagctccattctagacaatttattttcaatgtgatacctttgaatcccagggtgaatgacactgcaggctttgtacatggccaatagcttcctcctaagcctttgcctttcttggctgggcttcctatccctgtaggaaccatgccgatgttatctcaataagagcaggaggcaaattcctctaactttactattacactaatacaaattatgtacttcattccacataatccctacccataagagtctgacacttcttcagagctgaatttattgccctgaggatttacggtattggtttcacaagatggggtcctgccaatcctgacttcccactagcatcatcagcagaagcaagcagaaatttcagggacaaccccttatcttgagaagggttaaaacttcacttcgaaagatggtaatttaattttaaagaatccgttctccaatgtcctttttgcctaaaattaagatttctcttcaaagaaattacaacatcaaagcaaaactcaagagtcatctggcctaaaagtctcaagactgagcacagcccccaagcaaggcagctctggaagggactgtgtaaccagacaaggggatgggcacagaaacaaggcaagatgtcagggctgcaaggaaattctgccctgtttccccctgccctcttccctagctcttttctttaacgttgtgtttgcttttcatctttgtagcctgctgggttaaagggcaaaccacaggcagagagaaaccgcagcaagcccatgcctgttagaggtaaaatgggagtcttcccaaaccacttgtaaggatggggggacccacaggtgctgctttgagtcagacatgaaaacgaggtcagtgttctagtccaacgagtcttaaatgaggctttttaaaaatcagattctccttccccgagattgatggttttccctttttttgacggggtggtgggagggggggatagggtttcactctgtcactcaggctggtgtgcagtggcatgatcatagctcactgcagcctcgaactccttggctcaagctattctcccacctcaactacagtccctttaagcagggactacaggtgtgccccaccacacccagctgactttttaagatttttttatggagatggggtctcactatgttatccaggctaatcttgaattctttgcctcatataatcctcctgcctcagcctcctaaagcactgggattataggggtaagccatcacacctggccaattttcccttcttttttttttttttttttttgagatggagtctcactgtttcccaggctgtagtgcagtggcactatctcagatcactgcaacctctccctcccaggtttaagcaattctcctgcctctgcctcccaagtagctgggattacaggtgcctgccaccacgcccagctaatttttgtatttttttttagtaaagatggggctttaccatgttggccaggctgctctcaaactcctgtcctcaagtgacaggagtcctcgagactcctgtcctcggcctccaaaagtgttgggattataggcctgagccaacacgcctggcccaattttccctttttaatgccctgagtgcacctataactggggctataagaaatccataaaatgggctgagcgctgtggctaacgcctgtaatcccagcactttgggaggccaaggcgggtggatcacttgagatcagaaattcaagaccaggctggccaacatggtgaaactccgtctctaccaaaaatacaaaaaaaattggctgggcctgatggcatgtgcctgtaatcccagctacttgggaggatgaggcaggagaatggcttgaacccgggaggcagaggttgcagtgagccaagattgtgccactgcactctagcctgggtgacagagtgagaccctgccacaaaaaaaaaaaaaagaaatccataaaatgcttcttattcatttaataatgtttatcaagtgcctgcttcatgccaggactgttccaggtgtgggtattcaacagagaacaaaacataaaaatccctgccctgatggagctttcattctagctaaaggagacagactataaacaagatacataattatatattatatagagaccaatgctaagaaaacaaagcagaaaagggagagacaaagtatgtgtgtggggttttggtttggtttgtctgttttgagtaaggacctaacagaagcgaattctgtagctatttggggaaaaacattccaagcaaaggaaacagcacatgcaaaggccctgagacagagcgtatctggcgtgctcagggaccaacagtcaggtgcggcagctggagcagattgagcagcctagagagcacaagagggaagtcaactgggtcaccagcataagagtggtgggctggttgggcagggctttgcagatcactgtaagaattctggcttttattctgagaaagacaagaataaacagtagagtggttttttggttttttggtcactctgtcaccagactggagtgcagtggtgcaatctcagctcactgcaacctccgtctcctgggttcaagcgattctcctgccttagcctcccgagtagctgggattacaggcgcccaccaccatgccaggctaattttttttttagtagagacggggtttcaccatgctggccaggctggtctcaaactcctgactttgtgatccgcctgcctcagcctcccaaagtgctgggattacaggcgtgagccactgcgcccagcctagagtgttttaagcaagggaatgaaggaatctgacttaggttttatcacaatcattctggctattgggtgggaactaggctgcagaggggcaagaagagaaacactgctctctggttgttctcatctttagagaaacttaaggaagattattctaagccccactgtaaccctaaactctatgattctgagttgattttctgtgtcttttctatagctataatttatatcaactgtaagcctgatctttccccaaagccataactgaagtgggctgaaatgaagaattccatttgacaatatatctataaaccaggcccatgctacacacctagaataccaagatggtaagactcaatcctgctctggggaatctgccgaaggaaaaacaacattctcacgaggcagcaagagaagcacctgccaggaggagccacatgaagccccactggaggagctggcagcagtgagagcctggaagagtaagcaggaacccccatagagaaggagggacatgggaaatacagaaggtgacactgtggaggctgtggaccacagagaagtaatatggtggcttttggactgtaacagaaaaatctacagaacaaccagatggcactgtccgataggctgttggaaatatgggtgtgaaaaaacagggagctgctgatattgaagcacagaaatatgagcaactcaatgtagactgaaaagacaagaaaaagaaaagaagaggggagaggagaggaggaaaggaaaatgcaaccttggaaaatgtcaacccatagggatcaagcattgaaaaggaagactgggctgggcactgtggctcacgtctatattcccagcattttgggaggctgaggcaggcagatcacctgaggtcaggagttcaagaccagcctggccaacatggcaaaaccttgtctctactaaaaatagaaaaattagctgggcatggtggcgcacacctgtaatcccagctactcgggcggggggggggggtgggagtgtgcagctgagggaggagaattgcttgaacccaggaggcggagactgcagtgagccaacgtcgtgccaatgcactccagcctgggcaacagagtgagactccgtctcaaaaaaaaaaaaaaaaaaagaaagaaaaagaaacaaaatggaagactgaagagacatccggaacataagaggaaaaccaggagaactcgtttcagggaaaccaagaaaaaaaatgggggaaaaaggatagtaaagcagcaaatgcaactttgcactccgtacttcacacctcttctagcacctcatgggggtgtggtgggggtgtggtgggcgtgggagccagcagcaggcagaagagtaaatgggaggtgagaagaaaagcaccaagagctaaaacacattagcctcagtgacaagactaagagttatcaaagattatgcagcatcaggaaagtcttattcaacactctgtggaggtgtaaggtgtgagaaacaggaactaagacctgccggggctgatcttctggcagtggaaaggagatttcttagttaacacctaggtctcacaggaccactaatcctgaaactagcagtaggcatcccgaaaggctagttgcttctgacaagtgctgaggacaatatattcacccacacatcatccaaatgctaggcttcgcacctccatacctttcccacactaacatccctagttttctcctccagcagaataatgctaggcagcagggactacatttcagttcaaagcatggtaaaaaaattcatataacaaaaaccatagcaccactaccaggtatgatgctgtgagcccataacctgggaccattcaggcaggaaaaggctttaccaaaaacacaagctgggtcccggaacactggacccaaaccctttcatgtcagcaaaaactgcctaaatgctcttctatttgctctctgagaaacaaaaagaagccgaaggaggaaaaggcctttaatcctaaaattattcttaatttccaatacagagcatttgagaaaaatctgaaagccaacagaaaaactagcagattctttaaaatgtgtgtctacagtcctttctcctttaccctctgcaaaaaaaaaagcaacccaactcccaaatgatcatttttcttggcttaatttcactattttttgtgatacataattggaaacagactgctttttcctggctttagagaacaggatcttcagggttataagagttgccaactacagaacctcaaccttagcaaaatttttttgcaaacctcttacctatctacctacttgaaatacatattaactccaaagaaaacacgtaaatcccctattattatgcaaaagtggattttctcccaacaaattagacactcctctccttttcctagcctacccattgaaatcctgctctgtgttcagctatgtcccattcaaacatgaccaaaagccctaaccagcatggtatctagatgggatactttttggaagcattttcttttttcttcatattttctttttttgtgtgtgtggtgggggtagggacaaggtctcactctgtcacccaggctggagtgcagtggtatgatcatgactcactgcagcctcgacctcctggctcaagccatcctcctgcctcagcctcctgagaagctgggactacaggcacacaccaccatgcctggctaatttttaactgacattttcaggaatttagtagaattggttctacaggaaagctccttatttagcccacacagtgaatgaaattaaaacctggaacgtcttagagaacaaccactctaacaatgaaataaagatgccacaaattgaaaaaagatataaatatggaaaaatgtgaaatgcaacaagtaggtcatccttcccctagctcctgtgtcaaaaacatgatacatccaatggctgtacagctattgtaacgaataatgagtatgacagcttaaaagctcaaagacaagtgtctttacaaaatgggctgttggcataagtatttttttcaggattcagatgatttatcacgaatacataacaagtagcaatctctctaaagtctcgaaaataagaaaatgaataggaatgtctattcagaaatgctttggctaaaagatagaccagcaataggaaacatgcccatttagatcagaaacttctcccacacacatagggaagaccttacgctgcaatgatgcaaaatgtatgtaatgagtcaatggtgctttccctcaaagttaaatttaatttgccagccaactgcacaaaatctaatataacaaaatgagatacttattctttatggagactcagaagagttttgttttaaagaaaaaaccataaaagagataactcacagcaacacagtgagtatcttacaaaagtactcagggtaccacatgaacacaagcctttgtgattagaatctaagtttttcacctcaaataaccttccagaatgaaaagaaaaaaaaaaaaaacacacattctgctccagcaattatcacacagttagttaattataaaatgaaatttccaaatagtctccagagtatttttgcatccaaggaccaatatcacactgtcaaaacaataaatcactaaaaatgctaacaaaacgaatactcccaaaagggacccttttcacttgccagatggaattaagtattcatcaagtttccattagcaaaatagtatgatacaaatttaaaaagaaatccagagttctactagaccctccacctggcccatttgatgttctcacctataaaaggtagtgagtcatgcttgtgaaactgcagaccttcgcccaaggcaatctgatccacaggaaagctcaaggactagtatctgtaaagatcattttctaaagatcatttttcaaggactaatcaacttaaatgtgtttttacaaatgatccatcagcaattttacacaaaaaacctgaccttcggcatataccagagaaatgaattatgtgcctggaaggacagaaaagcaggtgtttcgtcctcctgcaaacaacacccaactccaaaggcccccttcactaggagtccaatgtccagaaagtatacgcttctttataaccattttttaagtaaagatagagctaacatttcagacttaattctaaattatcttggcaacagtttaacattaaagtgggcttgcgggcatggtggctcacgcctgtaatccctgcactttgggaggctgagggggaaagatcacttgaggccagaagttcgagaccagcctggacaacatggcaaaaccctgtctctactaaaaatacaaaaattagccagatgtggtggcccccgcctgtaatcccagttacttgggaggctgaggcacaataatcgcttgaacccaggaggcagaggttgcagtgagccaagatcacaccactgcactccagcctaagcaacagagcaagactctgtctcaaaaaaaaaaataaccattaaaatctaattctaaaaatcaactttgctaggctctacatataactgaatcctcttcccaggatggaagaagatttcaacataaaagaaccaccaccacaaaaaccagacattaggctccctgccctgccccccgacaccaaaaaattatcttcagcagggcacattaggatggcctgaaggcatggttctggggctcttgttctagaccttccattttaaatatggtctctatccctcataagcagttgtcagcctattaagtcttcatctttggcctgaaaaactgaagaataaaaaatgaagaataagttccaaatgacagtagcctcatgcagaatttatatcaatgttgtttcaaaaacacattttggttgagagagcaagacatcaaaatcattattcaagtggggaggaagaatgcttggaaatttgtgctgattcttaagcaaggactttgcaagcagagaaaataaagctcaatgtcagttaacaaacaaatgtgctatttcaaaagatataaaataagaaatctagaaattttatattcctagatttatttattatatttctatatttcctggacagagcccaggaaatgaacccagatccttcttgtaaggcccttccaagctgtgttgatttatttcagcttgactagacactgaacaaattagcaacagcttgtgttttatgacatgctgcaaagaaacaatgctatcattccaagtgttactctgaagatgcagaaccagagaagttactgctatggctcttggtacacttaattttcttcctacagaaatgccctcactcaatctgctgaaggctcactattatgtgtttaaggttagcttttcatataacctagattcactcttaaattccaaattgcttatattcctagtggcaatacaagactgcttttacattaaaggcccctaaaaacatttatctaactcaagttatgcaaatttcaaaaaagttaacattttttaaatttacaattgttttaaataagtttaaaaatatggccgggcgcgatggctcacacctgtaatcccagcacgttgggaggccaagacggcggatcacgaggtcaggagattgagaccatcctagctaacacggtgaaaccctgtctctactaaaaatacaaaaattagctgggcgtggtggcgggcgcctgtagtctcagctactcgggagactgaggcaagagaatggcgtgaaccagggaggcggagcttgcagtgagccgagatcgcgccactgcactccaccctgggtgacagagcgagactccgtcccaaaaaaaataaaaataaaaataaaaatataagaaaaatgctccagtagactgatggaaatggcaataaaatcacttttaagtaactgttaagactgaaaaagaagactgtcctttagtagctaataaatctgacagccaggagcagtggctcatgcctgtaatcccaacaatttgagaagatgaggcaggaggatcacttgagcccaggagttcgagaccagccgaggcaacatagtaagactctgtctcaaaatatatacatattatatattatacaatatatagttatagattatatatatgtgagattttacatatatttacatattttatatgaataagtatataaataaaaataaaaaataaatctgacaattacaatttttatccaacagcaatgaaagcaccacaaaaagatgtttcaaaatgaactatcaagaagggaggtaattcaaaatgaccacagagcagaatcatccaggcaaaatattacagcaaagttattacttacacagtcacagtctaaactctaactgttctgtctgttaagcttaaaatgtaaagtcaggacctttcacagatttttgaagccaggaaattggtcttcacttatatactaaagaagtcagcagtgatcaccttcttaaaactcaaaggacagttgagttccctgggctcttaggctcagattctgccctcagaaaaacaagcactcacctgacttttacaagtcacaaccaagtttgcatgcaagagagaaaaattaattcttttgagtcttaaaaacaatggaacaacactttccttcaagccaacgaaaggctttctgtaagaaagccctaagcaacctgaaggcattttggcccccagtcatcagagcactgaataaggacaattaatttgccaagctccaagaccagaaaccatagcctagtagggagtaggaggttataagtgtttgttgaattactcgagtaaactagagcaaagcatagaagactaaatgagatcctaaataaatgccactctgtagtataagcgcaatgctaagatttaaaaagaagggactcaactaattttgaaagttattttaaaataggatccatgggaccctaacgtagtaaatgaaataaaggtaaatcaatactacataatatggggccgggcacagtcgctcacgcctataatcccagcactttgggaggccgaggcgggtggatcatgaggtcaggagatcaagaccatcggggctaacacagtgaagccccgtctctacgaaaaatataaaaaattagtcgggcgtggtggcatgcacctgtggtccccgctactcgggaggctgaggcaggagaatctcttgaacctgggaggcggaggttgcagtgagccaagatcactccactgcactccagcctggacgacagagcgaaactttgtctcaaaaataaataaataaataaataataaaaaaatactacataatacgcaagaaacaagaaaggaaactggcctacaaaactacagacaaaaattgaaaaccttttttttttttttttttgagacagaacctcgctgtctgccaggctggcgtgcagtggcacgatctcagctcactgaaacctccacctcctgggctcaagggatcctcccacctcagcctctggagtagctgtgattacaggtgtgcaccaccacgctcagcaaattgttgtattttctgtagagatcaggtttcgccatgttggccaggctggtctcgaactcctgacctcaagtgatccacctgcctcggcctcccaacatgctgggattacaggcgtgagccaccacacccagccaaaaactttttttaaaagtcaagtttggccaggcaccgtggctcacgcctgtaatcccagcactttgggaggctgaggtaggcggatcacaaggtcaggagatcgagaccttcctggctaacacggtgaaaccccgtctctactaaaaatacaaaaaaattagccgggcatggtggcgagtgcctgtagttacagctgctggggaggctgaggcaggagaatggcgtgaacctgggaggtggagcttgcagtgagctgagattgcaccactgcactcccgcccgggcgacagagcgagagactccatctcaaaaaataaataaataaatagataaatgtcaagtgtgattttttcaagcatattcttattgtttatgtttacaagtatgagtattcatagacacatcacacttatactagtatcaaatatgatacatctgaactactactatacttgaatattaacgtaagcctctgaggaattcacagtaatagaactgctgttatttaggattactgatcccctattgtcttgcacttagaagatgttaatgaaagatgatgacaggattgtgaacacaccaacctccctgagaacaaattcattatattcagttttctacaaaacacaaatgaggatcattacaaaaggattcacaacaaattcctctggatttccatttctcccaggtaagttgaaatattattcaaaccacacaaaattagtttacatacaaacttcactttttaaagagatgggggtctcactatgttacccaggctggtctcgaactccttggccaagtgatcctcctacctcagcctcccaaagtgttggaattacaggtgtgagccactgtgcctggcctacacaccacttaaggaaacaaattgaaaaaaaactatatgtgtgtttatctatctgtccagccaccatggagttcttgacatatattcaacatacaggccctgtcctcaaggtcattcttaatcagttcaaattaaatctagtcctccattataaactccaaaagcaacttagttattttgctagatattttgccctcccctttcaaactatatgtttaatactctaaaaacgggtttatgcgccttatagatatcaacagtgtgttatgctccccctattgactaatattcaaaataacaatgaactccccacgggttgcctttgaagtgctgggattcaaaactatgttggtgatttttatatttaaaaacatgagctgaatcaacagttgttaggcaaagctgccgtgtaacggtcagattccatcaaaacaggaaaaattaaagttgacaaatgtcaaactgaagggccaaaaaaaaaaaacgctcaagccttgaaacactaaacaatgcagaaataaagccaaaagcaaagaacagcaagaaatagagcaacatcctttaactgacacaatggcatgaaatcaatttcatgttaatagcccttaagggggtaagaattatttccctgcctcctgtgccaaccccaagctgtttcctaaggaagccaagtaatggtgatcaacaatgtctggagaattaataaaagaaattaagaataaagatccatgttggccaggcgtggtggctcacacctgtaatcccagcactttgggaggccgaggcaggtggatcacgaggtcaagaaatcgagaccatcctggccaacatggtgaaacgccgtctctactaaaaatacaaaagttagctgggcgtggtagcgcgcgcctgtagtcccagctactctggaggctgagtcaggagaaactcttgaacccgggaggtggaggttgcagtgagccgagatcgcaccactgcactgcagcctggggacagagcgagactctgtcaccaaaaaaaaaaaaaaatttccatgttaattaatacaagtcagagttctatttataattatttggggccagtttcagaggaactttaattgggcaccctcataagtatgtaaaatcgcctaaattcatcacagataccttatgtgtgtttcaagagatatgcgttcagctcaaatagaaagctgaaagatgggagaagatgcatggactatgcacacaaatctatgtacacacaaatcggcctgcacttgccgctctccgctgaggaaggaaggtagctttggagtcagaactaacagaaagttatgtatgatcttggacaagtaacttaacctctagtgtcttatctgtaaaatagggttattaatagtgcttttcccatagagatgctgtgaggattaagtgcacacagtatgggcttagaaaacgttagctgttattattatccaaaagaaacaactgagttcacactgaagtaactgtttgcactctgcattcaggaagaagaaacggtcttgacgtgtgtttttactacctgtggagacttctcccaaaccgctcacttcttcggaaggacataaaactcagaatacgcctggttccccagcacagcctgtcactcctactatcctctgccctcgccgctcctatcctgccaccgcagggctagcggcaagcagcgctaacctccgtgcggtgcttactcggtgccaagcactgttgtagcacctcacacacattaaatcattagatgctcacagcaactttacggggcaagtactactatcctcacttcacagctagggaaatggaacggttttcttcttccagcttttcgtgaggacaccaaatccactaagttctactttgccaaggtaattcatgcttgacacgtcggctcctgacactatgcgattctgcaaagcggggcaaatgccctaataagatcaagtctgcaagcagattcttctagcgacagtccaagatttccaagtttgtcctaaccaaatgaatacaagaagagagccttcaaaataaaccggggcgggggggggccgagctgcagcttgcggctcagcccgcaaggcaccctgagggcgcggccagcggggaacgcaaaccgcgtccgtgcacgagtccgggagccacagcctgggccacggcaattgactgcgaacccacaacaaaccattcccaccgaagctgtcacgcgcccggagggaagtggccgccgcgccccgcaggggtcagaaggacccgcggagaggaagagtgagggcgggcgtggagaattcctccccagcactgcgcatcgccgggggcactgcctgccccgtgcggccgctgcccacgcaccgctggccaccggtgcctgctccccggagggtaaacaccgccccaccagcgcctccctcccaaggccggaggtcctggcggctggagcgaccctggccggtaagtaggcactggcagcccgcgccgcgccgacgggcacccgcgcagcctgcagagcccacagcccgggcgggctgcagcgccgcggggctgggccggcacgtacctcggaggcggtgtgtccagcggagatccacccgcagcaagttggaggaaagcggcggcaagtttccccgcccagcgctcggcggcggcgagctccggcagctgctgcgccgcggcaaaactacgccatccggacccgctggggactctcacctcctgcagggagctccgggaatcgcgcagggaaagtggccggggcgcgagagccgccgactgccctccttcactcgctgggaagaggaaagtgccgctcggcgtccccgaaaccctcgattacccccatcaggccgacccggcgcactcgccctccctcgcacacacgcgggcggggacgggcaggacgccacagcaatcagcgcgcggggggaagggcgctcctccgccggccccaccgggggctctcggccgcccagaaactcctcctcccgcctcccgcctcccgcctcctctctcctccccctttgcctccgcggctgatggatgagccccgaatgctgctcgagcctgtgcttcccttcgggacgaggaggccgagagagaaggggctaggggcgcggccgggctcagcgtgcccgggttggggcggcccctgtcctgggggaagcgcgagggagacgtgggcacgagctgcggggactcgctccctcaaacgaggtcctttgaactttccagggctccctggaagagttggattttcatttggttccttggtctttatataaaagttctgaaacctcagataatctgatcacagcctcttgccctctccccagcagagctcccccatgcacacattcattctgtccctgtgctttttcccaacctccggtcccgcttgttgtcacgctctgatggtgggcgccggcggagtcttgcctcttcccctccagcagctgagactgcattacccagccgttccccctgctagctaaataaattaatacaaataatggagctaggtcagcattaccggcgttacccggaggtgggcgcgatatgaacgacagtctcggcggggcaacgtcctaagtacctgtgcctgtgcgacgtcctaagtacctgtgcctgtgaagtacacgctgcagaagttgaactgctggcaccagaacaccactctgatactcttgcttacacccagtttttcttattaaaaagtatacttaagtaacaggacattgttttacaaacaggcaggtgaaatgaccgtggactgacaggtttcaaagaccagacttccagtcctgactactgtgcgaccttccacaaatggctaacggctaatacccgtcaaggctcagttcaaatgaagggcttggcctagaaggcttcttccagttctaaagggctatggacctatgcctttttttttttttttttttttttttttgagatggagtctcgccctgtcgcccaggctggagtgcagtggcacaatctcaatctcagctcgctacaacctccgcttctcaggctcaagcgattctcccacctcagcctcctgagtagctgggattactgacaaatgccaccacgcccagctaactttttgtattttttgtagagggggttggcagggcgggggtctcacttagttgcccaggctggtctcaaactcctgagctcaagagattcgcctgccttggcctcccaaagtgctgggattagaggcgttagccgctgcacctggctcaatcctaggcttttaatatgttggagagtagaatgaggaggcttcttatgacatgttatttggaaagttattgagagaacaggaaatatttctcgtcctcttcctcttgtacctataggcagagaatccacccaattgcagaattggagattcattcacaaaggtcaaatgtcatcagtcacctgaattactgcaaaaatctcctcactgaaccatttttttccttaccaatattcattgagcactgactatgggagagccctgagtcaggcattgggaatacaagtaggcataatattctgaaggaataaacagtccagatggagctagcctctgcttttataaagtctaagtttaaggccttaagatttctcctagactcaaattaaacagtatttgatatggtttggctgtgtccccacccaaatctcatctcgaattgtaagtcccacaatccccatgtgtcctaggaggaacccaatgggaggtaattgaatcttggggatgagtttttcctgtgctgttctcatgatagtgaataagtctcacgagatctgatggctttaaaaacaggagtctccgtgtaccagctctctctgcctgctgccatccacgtgatatgtgacttgctcctccttaccttctgccatgattgtgaggtctccccagccatgtggaactgtaagtccaataaacctttcctttgtaaattgcccagtctcgggtatgtctttatcagcagcatgaaaacagactaatacagtatttatgccttgttaacaagttttagtttcaagtacagatgtgaacacttgaactaggtgtgaatatttaatcccacatttaaatgcatcggccaggtgaggtggctcatgcctataatctcagcaatttgggaagccgaggtgggtggatcacttgaggtcaggagttctagaccagcctgaccaacatggtgaaaccccatctcaactaaaatacaaaaattagccaggcatggtggcgggcacctgtaatcccagctacttgggaggctgaggcaagagaatcgtttgaacccaggaggcagaggttgcagtgagctgagatggtgccattgcactctagcctggacaagagcaacactctgtctcaaaaaaataaaattaaattaaatgtatcaatcatgttaaggccttctaaataaaatggcctggtagataatttaggagtgtcttgtctttaaagagtgatgaagtgactggtccccgtagagccagattcacaacagtaaccatcaacatctgagccagcgtgggtactgaattcttttttgtttgtttgtttttgttttgagacagagtctcgctctgctgccgaggctggagtgcagtggcgcaatctcagctcactgcaacctctgcctcctgggctcaagcaattctcctgcctcagcctcctgagtagctgggattgacaagcacgcaccaccatgcctggctaatttttgtatttttagtagagacggggtttcataccatgttggccaggctgctctcgaactcctgacctcaagtgatccacccgccttggcctcccaaactgctgagattacaggcatgagccactgcgcctggccatgggtactaaattctatacatataaacacatttacttctcacagccctctaagaatatgtataaatgaggccgatatacatgcctttatacaaactgagatcttgtccacgattcaatctcacatccaccgacctcaaaacctgtccacgattcaatctcacatccaccgacctcaaaacctaagtccttaaccaccaggttcttctacctgtcatcagaagctttatagactggcaaaataaaagggctcttttttttaattctgagctatttagtttcagtagatgatatggaaaaacacaagaaattacatcagtatttacaaaattaacaatgtctacagagatgttttctctttaaatctttacaatatgatattaaaagcagaaatccagatacctcaagcatagacgaaaggtttaaaataaacttgaatttttggttcctgagcaaagctctataaaaaagggttcccctacctcttttctttctttctttcttttttgagacggagtttccctcttgttgcccagactagagtgcagcagcgcgatctcagctcactgcaacccccacccccacctcccaggttcaagtgattctcatgcctcagcctctcaagtagctgggattaccagcacccaccaccatgcctggttgatatttgtattttcagtagagacagggttttgccataactcctgacctcaagtgatccacccaccttggcctcccacagtgttgggattacaggcgtgagctgccgtgcccagttgcccaacctcttattaatggcaatattaactgatttctaagggaatggatgctccctttcactaatttctcatggagaactgcattcaagctacagtatttgttactgtaagataccagctttcttttggtccaaagtggtttcttggtcatttgtttggaattgtttcaaacaggattgtaagcaggggggtgaaattgaggtgcattacttgcattaaaaatgtttgccagcagagtttcagtgatttactgaggctgtttttcatacaaggaaccacccctcctgtaggtgtggactcacatgttgacagtgactcagatttagtggcatgtctccagattctgttgattagcagttcacagtctgctaatcagactttctttaatcagataaagtctaaaagactttatcattagaaaaatcatttggttgtttctctataatctttttttttttttttttttttttttttgagacacagtttccgtcttgttgcccaggccggagtgcagtggcgccatcttggctcactgcaacctccacctcctgggttcaagtgattcttctgcctcagcttcccgagtagctgggactaaaggcacacgccaccacgccctgctaatttttgtatttttagtagagacaaggtttcaccatattggccaggctggtctcaaactcctgacctcgtgatccacctgcctcagcctcccaaggtgctgggattacaggcatgagctactgtgcccagctattatcctcattttacagattaggaaatgatgcacagagaggttatgtaacttgcccaaggtcacacaaccagcaagtggcagagtcaggtggcctggctacagaatccgttcatgctctgaacctccactttgtgctacaggtgaaagacaccttctactcataaaaagagagtctcatatttccttttttttttttgaaacggagtcttgcactgtcacccaggctagagtgcagtggtgcagtcttggttcactgcaacctctgcctcctgagttcaagcgattttcctgcctccacctcctaagtagctgggaatacaggtgcctaccaccacgcctggctaatttttgtatttttagtagagatggggtttcaccatgttggccaggctggtctcgagctctgtgatccagctgcctcggcctcccaaagtgctgggattacaggtgtgagtcactgagcctggtctctcttttttttttttttaagtttacttcaaaggctaagtacagtggctcaggcctgtaatcccagtacttgggaggccgaggtgaatcacttgagcccaggatttcgagaccagcctaggcaatgtggtgaaacccagtctctacaaaaaatacaaaaattagctaggcgtgagggtatgtgcctgtagtcccagctacttgggaggctgaggtgggaggatcacttgagcccggtaggttgaggctgcagtgagccgtgatcgtgccactgtactccagcctgggcaacagaactgagatctgtctcaaagaaaaaaaaaaaaaactcgattctttaaaaactttcaaaagataaaaatgaaagtttgtttagaagaactattaccccaccaccaccacataaaaatagattcctttcactaatttaaagtttgtctaatacagccaacagcttggaggcaattgcacaactactcttaagaatgtgtgacagaacatgaaccaaatgttccaaaattgttgtgacaggatgctgatctacaaactacagtatctgcccttattttctgctctgttaacctattatcacagacagatttactactttatttttcagattcgctcataaagacccagttcatactcgttggtgttttatttcatcataacctaaggccataatttaaagccacattttctatatctatctacgagattagaatttggttttcgctgataaaattgcagctggcaaatttcaattaatgagaaaaaatacaatcagatgaacctgtatgcagagcagagtccaaagcaggcactggcttcagatctggggaattccacagagattttggacataaaaatccaaagcaaattttctcacagtaaccgcaagttcctgcaaactcaccatttcctgtgactgtgcagaagcccccaatggaggtttccacagtacaccttcaatttccccctcagcagggattctgatgaagcaggaaacctcacaccatttcaaagtgacagtaaaaccccctgagatccctgtggtcttagctccttagggtatgtggcaggaccttgctctcccaacagcagggctgggattccagaaggaaaactccatcctcagccccacctccacaacactctgcagagaactagccccacctcttttgtttatctgttttctgtttactgggttttggtctagagaagagaaaaaaagaatcatgaattatgtaatgttattttgtgctcagggggacaaaaaaagacaaggggcacccggaacatatattaatgcctgtaaatgttttgaatctcagcccaaaatgaaagtgtgccagaaacataactttcttattttttaaaactgaactgaagttgcattgtgagtcctttagtcaaatgagggtctccctgaaccctctctgttcagggttataccttgaacattgaacagaaattagtgagggcaccatctcatcctcggatcatcatcttatctgtgcttgattgtttcgtaatgaacatgtatcatttttaccaagagccatgagatggttattcccgagatttcagagtttacttgaaagtaataccagtttagagctgaaagaactatatatgtgtattactattcgttttgagttgcatctgtgtggtatttcatccaaaaagttcacaatacttgcaaatattaaccaaggtagcttcagggaaatgctttattcctaaagccaactgatcaaacatttccttcctagtgcctcttgatactcagttaacacactaaagaaaacaacctcattgacttcatttcaacaagtagaagaaatgctgaaagtctacttctaaaaatatctaaatttaaaaattattgctgttattattgggtctgttattattaccctttattgagcacttattttgtggaaggccgtgttgtaagtttgggtttataaaatgtattttctaacatattttgaaaatgggcatatccacatatttgtcataaaattacctgctgtaacatttcttgagtttcttttaacatgttgtctaaggagaaagaagagtttcttaacttgtaactatttttttttttgagacagagttttgctctgtcgccaggctacagtacagtggcgtgatctcggcccactacaaccttcacctcccgggttcaagcaattcttgtgcctcagctctcaagtggctgggattacaggcacgtaccaccatgcccggttaattgttgtattttctgtagagcagggtttcaccatgttggccaggctggtcttgaactcctgacctcaagtgatctgcccatctcggcctcaaagtgctgggattacaggtgtgagccactgtgcccagcccaacttgtaacacattctttaagattcaggaatgagttaaatagaaatttgtttttatgttgtattttttattttagtgacaatcttaaaaagcaatcttttatcctgttttttttttcctgacaaggataattaagaaccaaaagactttctcataataaaagacattatttgcttatagtccatgtttttcaaagtaggaaatgttttcccaaaggtttctaagaatgtttctcttcaaaaagcgttcagtcagttggaggatttaaaattttatttttggtttataatacattgttaacatttgagaaaaataatataaaatttttaattaaaacttccttaaaaaaaaaaaaaaacttcctttggccaggcgcggtggctcacacctgtaatcccagcactttgggaggccaaagtgggtggatcactctacaggaggttgattttatttcttctcaagtcttcaataccttcttctccctctttgaactcagcagatgaccttgtttcttattttactgagaatatcagagccctcagaagaaagtatctttgtcttcccaccacatctgccgattttatctatgcgtcttctctgctctgctttctctcgttaccctggatgaactggccttgcttcctccatctgtgccctggagtcattccttcaatgactcaatgactttcatcctgtagtaattccctcttgcaattgcagcctcagatttctttctttcctggatcattctcatcaacttacaaacatactagaatatttcttgtctttaaaaatcttacttgaccccatctatccaccttacccctatttctctactccctttgcactaactcctcaaaagagatgtcttcctttgttgcccacacttcttcatccacagctcctcctcaatcagatccaatcagatcacttgtcaaggtcaccttgtggcaagaccagtgactgatactcagttttcatcttacctaactgctcttagtttacgcaagagattacttcatcctctttgagacactgcatttggctgcagggataagatgtactaatggtttccctcccatcacactggctgttccttctaagtcacctccgctggcttttctttctgctcccaggatctaaatgttggcttgtcccaaggcaatgtccttggtcctcttctctgttgagacactctctgtcctttgagacggagtctcgttctgtcgcccaggctggagtgcagtggcacaaactcggctcactgcaacttccgcctcctgggttcaagagattctcctgcctcagcctcccgagtagctgggactacaggtatgtaccaccacacctggctaattttttgtttttttagtagagaaggggtttcaccatgttagccaggatggtctcgatctcctgaccttgtgatctgcccacctcagcctcccaaagtgctgggattacaggcatgagccaccgcgcccagctgagacactctctctgaaggtgttatcatccagactcatctagcttgaatctgcgtcctcatccaaatctcatgttcaattgtaatccccaatgttggaagtggagcctagtgggaggtgattggatcatgaaggcgaatttctcatgaatggtttagtatcatacccttggtattgtcctcaagatagtgagttcttgcgagatctaatcatctaaaagtgtgcagcatctctcccctcactctcttgctcctgcttccaccatgtgaaacacctgctcctccttcaccttctgccaagattggcagcttcctgaggcctccccgagaagtagatgccagctttatgcttcctatacagcctatagaaccatgagccaattaaacctcttttcttataaattacccagtatcaggtatttctttatttttttagagagatggggtctcactacattgaccaggctagtctcaaactcctggccttgagtgaatcctcccatcttggcctcccaaagtgctgggattaaagtgtgagccaccacacacggccagtccagaatggactaatacaagacccatttctttaaatggattacacattgatgatctcaaaattttatctctaaccttgaacttcaaagtcatgtatttgtgacttctcaatatcgccacttgatttttcaactggaaaatcaaatgtaacaatgaaaaaaactcaactcttgattcttgcacacacattctgtctatcctcatctctgtaaatagccctgctgttcacccagtagctcaggtcaaacacattatgggtcatcattgatttatctctgtctctttaaccccacaaccagtctgccagtcagtcctgtttaccctcaaatgatcacttctcactatttccattgctgctacaaccctggtcaaaataccatcatctctaacctaaacaatgttgatagttctggtttccttgcttcctgtcttgcttcccacccactaacaaacatatacacacacactcatccagtaccatctatgtacaggtctcattagtgaagaaacctgatccttccttaaagcaggctccctgtgtaagctccacagtacactataagcaccatgaaggcaggggccatggctatcttaatcagcactatattcctagctcctagcagaatggcagcatctgacaggtattcaataaacatcaaattaagggatggtttcattctagagatgggtacccacagttaagaggttgaggcaattagtaatgtttgcaacaaccatgaagagagatgcacctctagggctcaatgagagactgatgcaaaggttctgagtgttatgcagctcaggacttgggagtcatcagaatacatctgacctgagggaaccgggaccaatttgtccaggcagggagcaagtatgtggtgtaaacggcatgaatgaatctccacctggaagccaaaggttctgacatgaggaaggggtttccatagtcagacctgttcacatagagtaaataaatcaaaccccctaggctggagcaaataagcctgctgactaaagctagctgaaagagaaagagtcagatacaggagtagaaataatgtataatgctttactatattgctcttattttggtcttataatagtatactgctagagtttttaaaaatgatgtccatactgctattatcattgctggaaaacgctggctatttccttctagagaaggaaaagtaaacaagtcttaaagggtctttgactaactccccaagtgagagaaaggaaggaagccctcattaatgtacacatcccctacttcctactcactttttcttttctttttttttttttagggagtgaagtgtatatatcttttttaacttttttttaaattaaaaaagacaaagtaagtttcctaaactagttctccagacattcaactttttaaaaatacctccaggttcaactcagctggaattttgagtgctgctgagtacacttatatacttgcctggttgtttttctctttcctatatgttttactaactggcatttcagtttgagactctttcagaggagattataatggtcttttcaatagcactctgcagctccactgcctttgcaggtattgtactgtcaaatgtagcctgcgggggtatcaggcagcatttgggtatttatgtggcaaagggacagcatcgacatattttgggagatgccgacttgacgtggggaagaggaatattcgttagaaagggtaataggtctgaaaagcatatttggtaaaaggttttgttatctttgggaaatctcatgtacaaacacaagaaaagtattatgtcccaaggcctttgtgtggcacagttctggtgacagcatattttcattgtatatattggttcattaagctcaaaccaacctcataattacatgattgtgacaagattaactgaatggacaatccaaatggccgaaaggtcaaatgagggtccctctgtctaataatacttttactcttctgttatttttaggctggcttagtgagaatgtatcatgcaggcttgcagaggattgcttacgttttgttccaagactcatttattactattgtgtgggccgaaatgtgcacaacataccaaatccaggcacaaagtagaaaattaatcttcacaggagagaacaaatcttatttataagaaatcttcaaaagacagaaaaatgcaaagaatataacaaacactcatgagtcaacatccaaaactgatcattgttaacattttgacaaattttttgtctttcctataagaaataaaatattacagccgggcatcatggctcatggctgtaatcccaggactttgggagcccgaggcaggaagattgcttgagcccaggaattcaagaccagcctgggcaatatagcaagacctcagtctccattaaaaaatgttttcaatttaaaaaaaaaaaaagaaataaaacattacattagtcacccctagaaagtacaggaaaaaaagaaaaaaaattacagatacaattgaagcccccttgcactcccctcaaccccagtccaaatcaattactctcccagtctcttcagaggtaaccactttcaggaatttagagtgtatccttccagtgtgtccctttcttccgcatatgtgtgtgtctgtgtgtgtgcatttaaaaagacagaacatgaagatgctattagtatgaatgtgtccatttaagaatgttccattttccaatgcccaccaaggagaaaaacaaaacaaataaataaaaacgttacataagcagtacataatctgtaacttgcttttcattcaacagtatgttttttttggtttttctgttttttttgagatggagtctcgctctgtcaccgaggctggagtgcagtggcgcgatctcggctcactgcaagctccgcctcccgggttcacgccattctcctgcctcagcctcctgagtagctgggaccacaggcgcccgccaccacgcccagctaattttttttttatttttagtagagacggggtttcaccgtgttagcaggatggtctcgatctcctgacctcgtgatccacccgccttggcctcccaaagtgctgggattacaggtgtgagcgaacacgtctggctgatcattgttaacattttgacaaatttgttatctttcctataagaaataaaatattacagccgggcatcgtggctcatgcctgtaataattacaatgattttaaaacccatctgtgttgtgtatatgtagatttagttcatttctcttagctgctatatatcccttgcattactatactattacaatttttgtttataagttgccttaaaggtgggaaagtaaagttgaacgtggtttcatgtatgtttgttaaccactcaattttcctccttgtgatacttattcagtttctagacagagcaaatcataaatgtaaagggaagaatggagacagatctattgtacagcttggtgactatggttaataatgtattataatttcaaaattgttgagagtaaatttcaaatgttcttacccccaaaataagaatgtgaggtgacaaatatattaattagcttgatttaattattccacaatgtatacatctatcaaaatgtcagctgggtgccatggtttatgctataacccctgcactttggaaagcttaggcggaaggatcacttgagcccaggaattcagcaacatagtgagatcctgtctctacaaaaaatttaaaaattagccacgtatggtggcgtgcactggtagtcccacctactcaggaggctgaggtgggaggatcacttgagccgaggaggttgaggctgcagtgatctgttatcacaccactgcactccagcctgggcaacagagtaagagagtcacaaaaaaacctttctactaatcacattatgccatgtaagcacttagatagatggctcattccacttttcaggctcaaaataaaatgctttttatgctgacatcttgacttaggtgacttttcccaggtactcaccaccaaagatctacacacaaggattctctgccgtccctctgatgttgtgtccttgctttgactacaaataaaacaaagaacattaattgagtatagttgtagcaaacttgagtttttggctgaaaattaacatttatacaagaactcctgaaataccaagaaactgctttggctgggcacagtgggcacttgtagtcacagctactcaggaggctgaggcaggagaaccactttagccaggagttgaagactatagtgtgctatgatggtacctgtgaataaccactgcactccagcctgggcagcatagtgagacctgtctctaaaaacaaaacaaaacaaaaagaaacttctttgacttttcttgcacagttgacttgaattttgtgcatagatatttggagtagttaaaaaaaaaagattctgaaatatactcctagatatccctctccattcatattaaacttacttattttacatcattttattttattttgagatggagtctcactctgttgcccaggttggagtgcagtggtgcaatctcagctgactgcaacctccacctcccaggtttagagattctcccacctcagcctcccgagtacctgggactacaggcgtgtgccaccacacctggctaatttttgtatttttagcagagacagggtttcaccatgttggccaggcttgtctcaaactccagacctcgggtgatctgcctgcctcagcctcccaaagtgctgggattacaggtgtgaatcaccacgcccagccaaacttaattatttaaatctaagttgttagctgttagatgaaccgtttctaaactaacaaactcaccgttttaacaacagtaacacttaaaatcactactaatgaaaattctaaatatgcaaactgtaatttcctaatgaaatagctagttttttcttataaaacaaaatagaaaagtatcacatacaagaaactccacatcttgaccatttctaccttgcaatatatattcttgactcactcttttctgttagtgccaaaggcaacactgacagtcttgcataatccacaaggtggtccaacattaatactctctggaaaatagttgggatgacagcaaagctgaatcatcatatcactttacagtgtctcaaagtatcaaagactaaaactgtgattgccccactctctggatatttccccagtggtgcctatcttgaaaaagcaaattcaagagacatgaaaaaaagttattgggtttggttttgttttatttgagataaggtcttgtcatgttgctcaggctggcctcaaacttctgggctcggatgatccttctgcctcagcctctggaatacctgggactataggcatacaccactgaatgtggcttctcatatggtaattctattttaaattttttaagagctctgtatgccattttccatagcagctgcaccattttacattcccactaacactttacaagggttccagtgcctccatgtcctcatcctcaccaacacttgttattttctgtgggttttgtttgtttttaaaataatcatatatactttttgttaggtgtatttttattgggtcttatcctctgaaaaatatataacaactcttcatcagtccaaatacttggttagttggaacacatacaaataatatccaaagaaaaagaagtagcttctccagcatggaagaaaaggatagtcagaagtaatatctgaaaatatgcaatgaatggaaactacatccaaagattatagtgaaacaaggcaatctctatgcaataggctgattatttatgtgattaagctgacaaggatttacatctgtttttattcagctttttgtttaaataatagcattgtacattctcatattacaaatgttattgtatactattatatattataacatgtttaaagacatcaaactaactttttcaactgttcttgaaattttatggaaataaacattagaataaacgttgtgggccaggctcatgcctgtaatcccagcactttgggagacagaggtgggaggatagcttgagacctgggttaaagaccagcctggacaacatagcaagacctggtgcttaaaaaaaaaaaaaagttagccagacatggtagcatatacctctagtcccagctactccagaggctgaggtgggaggatcacttgagtccaggagtttgaggctgcagtgagctataaacacgccactgcaccactccagcctgggcaacagagcaacaaagcaaggccctgaccctcccccaccccaccaaaagaaaaaaaaaaaaacggtatgtgttcactgatactcaaggaatttatagattttcctatcaaaatcagtaggctccattaatttataataatttttgttttaaaacttacataatactagcatgcacagtatttaattgcccctacatccttataagttaaatattattggaaaactgaggtacaaacatctgcccaaagacatatgtttaataaatggttagctgaaattcaaagttaggtgctctctttccaaatccctacttcttttcactcctccattagagaacatagttctgtttgaagacgtgcagtttctttccttttcttttgtgtgtgtgtgtgtgtgtgtgtgtgtgacagggtctcactctgtcactcaggctggagtacagtggcatgatcatagctcactgcagcctcaaactctcggactcaagcaatcctcccaccttagcctccgtagctgagatgacagacgcatacaaacacaaacacacctggctaattttttttaatttttgtagagacagggtcttgccattttgcccaggctggtctcaaactcctgggctcaagtgatcttcctacctcggcctcccaaagtgctgggattataggcatgagccaccacacccagccaagtgcagtttattttttttttcttttctttcttttttttttctcacatctttttaggtctctgaacacccagaacacatttatttcaaataagggctcaattaattacattccagacttggtccctgtataagaagctaaaacaaacacaggatgctaattcagcacccagcactgaagagtcaacatgaaaacaaggcatttcacacacggatgatggaggtcaggagtagagttcgcatcagagacttagtttaggaaaggagacagctgtggacaggggcagtgccaggctctccaaccccttttccctgcctgcaatgctgaggatctcatgagatgggcagggatgccctccagatcttctaaaaccactgggttttgtgtattttttgaaaaaggagtgactcccaagttctggtaacagtcttctagcacctcacttaaaaaaaaaaaaaaaaaattgaggccgggcatggtggctcaagcctgtaatcccagcactttggcaggccgagatggtgggggtggtgatcacctgaggttgggagtttgagaccggcctgaccaacatggcgaaaccctgtctctactaaaaatacaaaaattagccaggcgtggtagtgtgtgcctgtaatcccagctactcaggaggctgaggcatgagaattgcttgaacctgggaggcagaggttgcagtgagccaagatcacaccactgcacttcagcctgggagacagagtgagattctgcctcaaaaaaaaaaaaaaaaaaaaaaaaaaaattgccagtctggacctctgtctcataagagaaagaatttatcattcagataatgattgttgatggcaaattctgattatctataagaattttgacaggctaggtgtattggctcacacctatagtctcagcactgggaagtcaaagtgggaggattgcttgagcccagaagttcaagaccagcccaggcaacatactgagacccctatctctctaaaaaaaaatttaaaaattagccgggcatggtagtctctgcaggtacttgggaggctgaggtgagaggatcgtttgagcttaggagttcgaggctgcagtcagcctgtctaaaaaaaagagttttgaaataagatctccatgtcaattagacattcttattcctggctcatagcaggaataagctacatatgtattcaaaatatgttgaaaaaatgatatttgaatgaattcttatgaactgctagctacatatggttggcaaatttaaagaatcaatctaacacatctaacattaaaacttagtaaaactggccaggcatggtggctcacgcctataatcctagcactttgggaggcctaggcgggcagactgcctgagctcaggagttcgagaccagcctgggcaacacagtgaaaccctatctctactaaaaatacaaaaaaaattagccaggcctggtggcgcgttcctataatctgtaatcccagctactcgggaggctgagacacaagaatcgcttgaacccaggaggcagaggctgcagtgagccgagatcgtgccactgcactccaacctgggcaacagagcaacactgtctcaaaaaactatagtaaaaccctgctaactcaaaaacttactttggaaacttatagagagcacagtggttaaaagcatgggtttgaaattagaaagatcagggcttggattttttttttttttttttttttagaaatatcaacatgagggcttagatttgggttctactacttgtcagttgtctttctaatttcaaagcccatgcttgagcacattactaaacctaaaattctttttttttttttcttgctctgtcgcccagactggaatgcaatggtgggatctcagctcactgcaacctctgcctcccgggttcaagcaattctcctgcctcagcctcccaggtagctgggattacagacgcgtgccaccacatgcagctgattttttttttttttttttgaggtggagtctcactcttgtcacccaggctagagtgcagtggtgcaatctcggctcactgcatcctctgcctcctgagttcaagcaattctcctgcctcagcctcctgagtagctgggattacaggcccccactgccatgcctggctaatatttgtactttttagtagagacagggttttgtcatgttggccaggctggtctcgaactcctgacctcaggtgatccgcccacctcggcctcccaaagtgctgggactataggcatgagccaccgcgcccggcctaatttttgtatttttaatagagatagagtttcaccatggtggccaggctggtcttgaactcctaacctcgtgatccgcccgctttggtctcccaaaatgctgggattacaggcatgagccaccatgcctggccagattctttacctgtaaaaaaggaacaatcacacctaccttttaggatttctgggcgaattaaatataaataatgataggcttagcacacttcttggcacaaaatatgtcaatatgttgtagctattattagtacagaactcaggatcatttctcttggcatcagtttctacagaataatcctattaatgttggaaatgtaggtgattaagttgaatccacactgacactctgacataacctggaattacatctttgaataatcctcaggatcagttggcttatttaacacttttctctagggtacagaaaaatgctagttatttgagctttctaaatttagcatgccaaaccaataaaaatttaccagttatccaaaagagattgtgataagttttctattactcacaaccgttgaccagttactttttgtttttgtttttgtttttttgaggtaagagtctcactctgttgcccaggctgaagtgcagtggcacgacctcggctcactgcaacgtcggcctcccaggttcaagcgattctcgtgcctcagcctcccaagtggctgggattacaggcgcccaccagcacgcaaagctaattttttgtatttttagtagagacggggtttcgctgatccacccgcctcggcctcccaaagtgctgggattacaggcgcgagccaccgcgcctggccaaccagttacttttgcttgcaccaagttgatcattcttacccctagatgaaaagcagtatcaaagcacttttggttgcaaatgatggaaattcaattaatattagcttaagcaaaaaagaaggtactgacctcaatgttgccagagctctgcttccttgtgtgtgctggcatccatctgcagatagcttcttcctgcacagcctgatgttaagaccatgcgcagcttcaggctcatgcggttctttcagtttgaaggcccaaggaaaaaaagctcctttctttcttagtagctacaaatcttaaaga

SEQ ID NO: 52 - DNA, 7486 bp, Homo sapiens
ggctctcgtggaggcagctagcgcgaggctggggagcgctgagccgcgcgtcgtgccctgcgctgcccagactagcgaacaatacaggtacgtctcgcaccgcccgctcccgccgccgccgccgccgccgccgccgccgccgccgccgccgccgccgccgccgcagcgcccgcacaactttccggcccgcgccgccgtgagcgcgccctgccgccgcctccccctgcctctactccccattcccttcccgccccctccgccttccctcctgctaggcggccgggaaggaagaagcaattcaggtgtttcaacttttccaacgcgttccccgagctccccgctttcgggggtcggccccctcggcggacgcccgcccgtggcggccccaggggccgcagccgggaacccagggcccccgaggccagatgtttgggcagctgcggctgcggcggctgggcgagcagaggggcggctgcgggctgtgggcgctgggcggcggcagcgggaagggggccgggagttccccggcccgcgacggactccgctggggaacgggcggccggtgcccgccgggggctgcgcggctggtgcccgccgggggccgccgcacgggcaaacttcgctcccgggcttggcccggcgccgcgcgggcccgcaggctacgccgctggctctgcgttaacatggccgtcgcggagcgcccggtggcccgggggggcgcgggccggccgcccccctctcgcctcccgcccgcccggcgccgccgccgccgctaacatggctggcgcggcgctggcctccggcgagggcaggggaggcgggcggagcggtcggcggggcgcccggcgggctccggcctcggccccggcgcccgcggcccggggcgggcggctcggagggccgggggcgccgctgcgggccctggagcggccgagcgtcatggctgcacgggcgcctttgttatcccgaggagtgcgccccgcgccggggggcggggaggtccggcccgggcccccgagcccccgggcggcccgggcggggcggggcggggcggggtgggggccgacgggcgggcggcggcggcggggcccgggccgctttgttcgccgctgtcgccgccgcccgcgccggccgcgcgcggatcagccattttagcgagtgggactccgaggcgcggcggacgccgccaccagtgccgcggctgccgccggcccggccgcacaccccccgcgcaccgccaccgccgccgcccccggccccgcgcgtcccccggggatgacagcggcggatttcaggggcactttctttcatcaggaggcttttgacaaaatggaaggtgaattacgggtgtcccggtgacccggcacgggggccgaggcgggctgcctgctgccggccgggactcccccgctcccggtcccgccccgcccgggccgccgctgcgggtctctgttgggcagcctcctgggcggctgctgccaaggggagctctttagttttacatgatgaccttgggtgtgggaaaaggaaaagatggcgggaagctggggggtgggacagggacgatgacatgccgcagctgcatttttatttggaaactttggagaaagtgttctcggctggacctgcattctgggttacagatgagcacgactagccctttttatacaccctccccctttagatagtgacgaagtgatgaattgaactaatagtacgggggtacctgctcactttccagatctcccgtgttgtaaagccgtttttttagtaagccaaaacacatcaacaatagtgacaatttcagatgtcccctacgtatagttctcctgctttggtcttgtgttcagcagtggtaagagttgttgtttttaattgtgttaacagttagcagatgaccagatagtcttaagtcatagatttcaagcttctatcacccccaccaaatgtgtcctctctctacccttcccactttgtgattgtagtttccaaaacatagcagttctgtaaacgtaacactgagtaccctacttgggtcggctccatttggagcacttgatcgcttttgagaagtaactcgcaaaccagcgcgcttcgtgctggtcaaaagttaaatgacaagcgacaatgaagctgatttctttcctactctgccttctgccactggtgtccggcattgggggaaggggacttcctaacagcaagtgtagttttagttttgctctgcctttggtacgtcttgtacttcttgtcaattcctccttgcttttcctcattgtatttctttgtttctcttttatcacagtcaggatggctaaaggtgaccccaagaaaccaaagggcaagatgtccgcttatgccttctttgtgcagacatgcagagaagaacataagaagaaaaacccagaggtccctgtcaattttgcggaattttccaagaagtgctctgagaggtggaaggtatttttctttggtacccttcaaactagtcttagttgggtttcttactttggggttacttaccttcagattttctcccagatagctgcttgcttcctcttttacttttacttagaatcatttttgcttgtcttaagaattttgtgtgtgtgcttttatttttttaaggccctgcacaggtttcaggcctttacctacccccttttgcaagtggttctagcaactgctagtttaatcacaagaaactgaataggtatgtgttcactgcatcgagggatttaacgagtcctgttctttgcagacgatgtccgggaaagagaaatctaaatttgatgaaatggcaaaggcagataaagtgcgctatgatcgggaaatgaaggattatggaccagctaagggaggcaagaagaagaaggatcctaatgctcccaaaaggccaccgtaagtgactataggattcaagataacaattaataccttttcttctgcttggaggatttggttttttggtcgtcctgtatttcatttcaaaatgaaatattttttaaaagatacttaaaagatggcaatacctctgcaaaccattctgtacttgggctttacgatgcagtgccagcgttgtctgtggttaaggctgaagtgtttgtgggctgtgcttgcacattcacagtggttgtctgttggcctttccattgtgaaggaggcactctagttttggttgtcagggtccttgaagtatgttctttatgcctttcctagtaattgaaagactgggacagcaccatatatatatgcgcgtatatatacgcatatgtattatatatgcatacacacacacagagcaccatatatatatgcgcgtatatatacgcatatattttatatatgcatacacacacacacgcatacatatttgagatggagtttcgctcttgaccaggctggagtgcaaggtgtgatcttggctcactgcaacctccacctcctgggttcaagtgattctcctgcctcagcctcctgagtagctgggattacagacatgcaccaccatgcccggctaattttttttatatttttagtagagacggggtttctccatgttggtcaggctggtctgaaactcccaacctcaggtgatccgcctgcctcggcctcccaaagtgctggaattacaggcgtgagccgcgcaccacatatttttctaaccttatatattttagaacctacaactttgtagcattgtatatggtatcatagattacttcactttagggagaagtcatagtggtaggagggagatgcttctcaggaatgtgggatttcaactttaactcaaattttttgtggtttctcatgtaatgtatgtaattcttccaaggtctggattcttcctgttctgttcagaattccgccccaagatcaaatccacaaaccccggcatctctattggagacgtggcaaaaaagctgggtgagatgtggaataatttaaatgacagtgaaaagcagccttacatcactaaggcggcaaagctgaaggagaagtatgagaaggtaaggtggggctggaagcctggactggtgaacaggcagtggttctgctatcagtaggttgcagggcatgtggcagctttgctgggctgagtacttagcatagcgctcaagggcccatccccctgcaaggtagctacgggtgctggtgttcatgcttttttttgacaggtctttgttttggggacaacttcaggcttgaaaaattttccttactctttaaggaaaaaaaaatgttaacagaggatttgatagtcctactaatgtgacttgaaggacacttgaacacccactaacttttaaattcgaatggctaagaaccaaattcatatatggaaacacttcagatatatatgatagcagcactgtcttacttgatttcaattcctgtcctcttacctgagatgaggactgcatgtttctactttgtgttaaaacagccgcatactcatttgaaatgtgtccctgttcctctaggatgttgctgactataagtcgaaaggaaagtttgatggtgcaaagggtcctgctaaagttgcccggaaaaaggtggaagaggaagatgaagaagaggaggaggaagaagaggaggaggaggaggaggaggatgaataaagaaactgtttatctgtctccttgtgaatacttagagtaggggagcgccgtaattgacacatctcttatttgagaagtgtctgttgccctcattaggtttaattacaaaatttgatcacgatcatattgtagtctctcaaagtgctctagaaattgtcagtggtttacatgaagtggccatgggtgtctggagcaccctgaaactgtatcaaagttgtacatatttccaaacatttttaaaatgaaaaggcactctcgtgttctcctcactctgtgcactttgctgttggtgtgacaaggcatttaaagatgtttctggcattttctttttatttgtaaggtggtggtaactatggttattggctagaaatcctgagttttcaactgtatatatctatagtttgtaaaaagaacaaaacaaccgagacaaacccttgatgctccttgctcggcgttgaggctgtggggaagatgccttttgggagaggctgtagctcagggcgtgcactgtgaggctggacctgttgactctgcagggggcatccatttagcttcaggttgtcttgtttctgtatatagtgacatagcattctgctgccatcttagctgtggacaaaggggggtcagctggcatgagaatattttttttttttaagtgcggtagtttttaaactgtttgtttttaaacaaactatagaactcttcattgtcagcaaagcaaagagtcactgcatcaatgaaagttcaagaacctcctgtacttaaacacgattcgcaacgttctgttattttttttgtatgtttagaatgctgaaatgtttttgaagttaaataaacagtattacatttttaaaactcttctctattataacagtcaatttctgactcacagcagtgaacaaacccccactccattgtatttggagactggcctccctataaatgtggtagcttcttttattactcagtggccagctcacttagggctgagatgaaggagagggctacttgaagctactgtgtgattttgtttgtgtctgagtggcattcagatgaagtctggaggagttaggagaacgacataggcaaggttcagcagccttccaaggtataggaaggtgggtgattaggactgaggctatctaggtttaacttttgtcccacctccaccccctattttgtggggccaaatgcattgctaaacagcaatttcagagtgtatggtgtgtcaaaaattaaggccttattgtttttctctttcacccctaccccccgtgctcctggcacatatcacattatttgtggtgcccaacatttggggtcttgagcctgctgctggtctcctggatgccagtgagggtatgtgggatggggtggtggggtaggggacggtatcctttttttgctcctacttggaaacaccaaacaccccaaggaagatgataggctccatcttgggccacctgagctatagggcaggctaatggaatcaaccatttctgagcactaaatgtatcatgaaaagttgaatggcctgctcataagtttagctcattcactggaaatgtagattgatgttcaatgttaaactggaaggagcttggtttgtgtgtcagtggttatattagtgggtagtgtaacattttatccaggttggggtgaggggagatggccacagtagcaagtggtgacactaaataccattttgaaggctgatgtgtatatacatcattactgtccgtagcaatgaaggatacagtactgtgttgtgggtgagtgttgctattgcccagcattaatatttgggtgtgtatgtttgaggctatgaaacacgcaggagtgtttttgtgctattaattttaagagaaagcagctttttcttaaaattcactgttgagaaacttgcatgtctggaggcggtgtcctctccgccctgtcgggtcctggatgagtacgagttatggtcacggtcacagcctgatctcttatgtgttcatagccattcgctctcccatcagaactgtttgtcctgaatgtgttcctctagttctagaaaatgaccactaatttaaaaaactcggttgtgaggtttgcccagaggcacttgttccagaatttcccctcctgcttcagccatgtccttgtcacttggcattctaagctaaagctttagcttcccaattcgtgatgtgctaggccaagattcgggagctgttgccagcctcgtcaaatatggaagagaaacaacctgcggtcaaaagggagtgatttgttaagtggtgcgcgtctatctcataactagatgtaccaaccagggaagggccaaggatggaaaggggtaacttttgtgcttccaaagtagctaagcagaagtgggggagcagtttagccagatgatctttgattaggcaaacattgagttttaaagaggctgtcaagttgaggccacttggtccattagctggggcagcaagatcactactcaacgttttcacactgtggcaagattgctcttctagtggaataatgccctagtttctctgagatgatgtaagtggcatgatgttacctaaggcttaggcttagcttgatttctgggcccactgtctgtgttcttaagatgccaacctgttgctttttttttttttttcccccatttaaaaggatagtacctactccctctaaccacctcaccccattcttgaatgacattttatccttcggaaagaacaaggctgtgatgtagtgactattgtctgtgtctcctgtgtgtgtctgttcttgtcacaaatgtatttggggacgttggatgcattcattttctgtaataaagtttcttaatcactcttcccaaaaagtaa

SEQ ID NO: 53 - DNA, 199644 bp, Homo sapiens
gcggcagtagctgtagcagcttcagcgaagccggagatgggcagagagcgcgcgcggcgcagcagctccagattcactgctctcccctgcagctccccgcgcccccgccgctgtcgctgcctcggtgtcccccagccccagtcgcgctcttaggacagcgccgccaccgccgcctggccctgcctgcctcctgcgccgcgcagccctcgcgagcgccccggatggcgctttacccctaggaccggtgagtaggcgggagagtgcagggggtcgggcgtcaaagcttggcgcggagagaacatcttttggtttgggaggcaccccaaaccagctgctgtgattccccgtcctccaggcagagggtccagggagggtgttgctctgtggtccccaaggggatgtttgatttcaactccacctgctggcaacctgaacccctctccgtcttggggacagctgcctgcagctcgcagtcccgcctcaccttccagcccccaggctcccacactagcagcagtagatggccccgaccctctggtcaccccaaacagggtcatctctactgttactgtccctgcgttcccaccttatgccagtgcacaaacgcccctatctgccacccttcacccgatctcgcgctgacaaagccttctccacaaagtcctccctgacccaccttctctcctttcccaaagcctggctctcgagcccgactgtcccgtcctattccttcccagggtgaatggtccttagtgaattctgacctcattccctctacacaatggtgcctgtccagattttctgacagtcacctcaggaaattgacacagacacgctgtgatcctggtttctgtacagttactttgtgtgttactcagcacctgggctgttaagggtattatcaagcgtgaaaaaataaagacaaaaaccaaaccctttggaaacaaactttttgttattgttgttttaaagcgcagaactatttgcattgcttaggtttgttctgttcattgagaggcgtcttagctgagtacaggaaatacacctattttacctgttcctgcggaattggtcttacttccaggttaagaacggaggacttgcctaggtggtgaatctctttcagcaacaacactatcaaaagctcagcaactcttgaggataagaagctttttcttgaaggagatgagagtagcaccaaacttaccctttaaaatcttctttgaaattgcaataagccaaagctcttatttttctttaggtgtagtggctaaaagagcgatataggaggattagaaaacattgtaccaagaagctcctgcactatttgggtgcttccagagttgtgtagtatcttagcaccagacggtattgctgtagaagttttcttagaacagtagtcgtttcttctgaaaccatgtttaccgttttattatttctagttggagtgcgagaaaataaagagttgtgttcgatgaatgaatatgagcaagggggatggagtgaacatcgggaggggtcatttaaataataaaatttgtgctctcaatttctcatgtattgaaatcttaaaaacaaaactaccccacaaaatttatggtttaatattttagagaaatgatgaaaaggcattcatttcaacatggcattgtactccatggaacccttggtcacagggcttgtgttctaagcaatacggataagaatatccagaaataaatgttaggaactttaaaaggtgccccactgaggcatgcagtgtgtcaatataaatttcctggtattattatcactataatttgaggggaatataaattaaagtgccattcttgctcttgcagttggtggagagagatgtatgcttcatcaccttaaaggagcaagtctcaggctacataagaaataggaagggaaagttgagccatcatctagggaatttgttagttaatattgccttaataccttctccaatgtcaggaatttttgttggtttgttttcattcaaactgtatctgagattttatttcccttttgtgtaagacataggcagaaatgcactgagcaagtccactgacaaggggtggttttaagtaaatgtggatagccgcattaaaagtcaagaggggctgtgaataatgagtttattgttggttttctaaatttgaaaattttagttggttatatttagggcttgactgagaacattcaaagctgttctcatttgggtaacattagggtgactactatgcacagtatatccaacagtaattaatctgtatcagaatcgatacatcccaaattgaaagcaaggagtaatactttgatcagttattgcccataattatgttaatgataaattaaagtcaatgtattctaatataattccaattaacatgaaaatattaacaaggtctcagaattatctatgagaatccaaataactagtctgccaaaaattttggcaagaatttctataaagaattatggtgagctgaaagtcaagaagatctgccaggatttaatgtcattggcattagtaagaaaggctaaacagttaaatataatgtatggggaggtaaggcacaccaatattggaatggcatatctttgagtaccattgaactgtatcttataatgctcataattatatgccacctagaggatgacgggtttaagtatttgcaatgttaaatataaattaaacattataaagagatatttaaaattatggaaattatatagattattccatcaacaagttgccattggttgaatgttccatgtgaaaccatgttttgccttgtgtgtgatgaagagaaagaatggttaaggaagagaaagctgcaggaagggagagatagagagaaaggcttcaaccccttggagactggcttaaattctttaatcaaattaaggtaactaaatatgagttctattattttggtatttagttaccttatttgattctttaatcaaataaggtaactaaataaaagttctattatttggtattattttggtatttggaatagcaattgttttcccacttgaattttaggatatgactccttaattatagcaataataatacaagttttttaaaataaagccttttattccttttatttagtaaaatctgagcatcagaggcaaaccattttgtgtaatccaattgatgaattgaactaaataaaattctagacaaatttacaaaaataccttaaaaaaagcacacatatttacacctcacacatacctaaaattataataatagataaagagctaaacaatttagtgtcttatgaaggcaagaggattcagtcaagagataaccacatacaatatttttatactctaatatatatttcttgtattttctttttcattgcggtggatgtattattacgtttttataagtatttgcatttttatttataaattcatgtctctatattataaaatgcaaattttataaattcaaataacccccaaattacacttgtaagtatcaaattattacaaaaatgttcataattttgctttctatcttgcattcaggagggagtatttagcagaacgcattcttaggagcaaatatgtaaaatgaatatttcaaaataagcatgatgattcaaccaaagttttacaacaatgctataaagtgatactctcataaactctaatgtacaattaaaattcctaacagaaacatttaaattctgtgatttttacctgtgactgattgtgtaaaattcaattttattaatttagctgcaaatggaatgctcggcattcttaatagaaagattcacggaattcagatgttgattagaaatatagagaacattccatttctgttactctactaatgacttgctcaaagtttcaaagtagttaatagaaacagaattcaaatcctgttctcctgattccatgctgtatttgtctttctataaaataaaaacattttccacttcttttattttaagatgttaataaaggagaagtcagtattaatgttaaagaaatctgaaaataaaatgaaataaaaggtctgtgcttcttcaaggaccatctcaatgcctagacttctaacacaccatagttaaaggtaatcagtcaaccagactttttcattcactcccaccttcaggttaaagcttgggaaatattcaaaaattaaactgcaactagcccacctaaaaatcttttaacatttttgcataatttttattagaaattcctcacttatgcagtgtaaggtttttcatgttaatagcatgtcatggacacttccatataagcttttatagacaattgactgaaaaatattcctaaaataacagattttagtttctgtaagcaaaatgcacttacagtttcatctccatgctgattcaatatttatgtcatcacagagaaggtttcgtatccatatgtttatttatttttaaatttttacctccatagactgtgaataactcaggtggtcagggaaggtaaatttgtttcacaaagtttcaagcccacagatgaaaatcctggcacttttagctttctcttcactgatagccagagggatcaatggaagtgaatgactaaatcaataggaaaccatcatcattactgcgtaaaaaaataagctctaaactgtattcttggttatggtggctcatcaccatcatttcatctaggaagaataacatggtgacatattttgatatctccattacattttctggaacaacactatattatctaaacgtgcttggactgatgtaaactaggggaaccagtgatcttgcactgctgggtggctgattcaaaagctgaggcattgatcttaggcattggtcttcttatagcacatcaagatgcaaatttggatgagaggaaaactacacttctaaggctcccctgacatagtttctttggagtgcaattcagcctctctttattgagggcctatggggcaagaactgaagtgatgatggcaggcacaagagtaagtatgatttaagctctgacctcaagcagcttagagtttaagtggagaagccagtaagaacaaatagaaaggagtgatgagacaccagctgctttaacctagggatgtcaccttggtattaaacaagggtgtccaggaaaaactcaaaaagaccaaaaaagaaaatctgttttgtgtaacatggatctaggcatgctgtggctaaggcttgacaacaaaaattatttagttccttaaaaaaagcaagtttccattgctttctatactaattttaactctgacagagttttttgttgttgttgttgttgttttgttttttttggacaatgcaggaacctattagtagtatgaacacaggtagtcccaaactaacaaattcagtggttgattcagtccttggaggtcatagggtaatcttttaatggaaatgtaactaagtatatacttttaaagtaagtaggaaatgcttaccttttaagaaacttaaatcttcaaggaatattcacagagaagtacaagcggaggatgcagggaaggaggttatgaacaatatgtgtaatagctatcctataatcaaaagtttaaaaaccactttagtaagttagacaaccttaaaaggtatttgtaattatctatgttttatttactctgatgaatgtttattgaacagttgcaattcagtgatagaaaaggaagatgacatatagttgggatgataaaatatagactcattaagtaatttgggagaagtatatggcagcatttaaataatacgtattacatgtcatctgacctagaacacggactggacaattacttttatagccaggtaaagtttataatatatatgttattgaaaaaaataatggctccaaacagcttctgaaggtacctgaattatactatagtaggaatagcttacgcccatgaaggatctggttaatttatgttcaatattggtttaccaagagaaaaaaataaggtcttcaatttttacatgagagggaaaaatatacctcctaacttgttgactgttttatgaatactttacaactttatgttttcatgacattcgttgtgtgaagaaagtgtctgagttacatgggtaatatgattagagagcttcaaggaaaaatggggaaatctttgacatgagatgagctacaagacataggtgttagtgataacgatgtttcactgccctgacctgtagagagccaactgagctatttcactagtcaattcctgctgactttcaagggtcctaaaaggtctgagactaatttaacccactaagttaagtatgagtgactggttgtactccttgttttgaagaggctgcatgaaggcagtcaatccaacttgtcctatttgtcttcaccaacagcttaattgtgtttgtctgtctgcactgaatggttaagcaagagttacagaaatgggagtgggaaagacatctggaggtgttgacaggtattgcatgggaaatgcagaaactgagaccatctcctgatatttccagtagtttttttgcttttgttaaggtgaatatagatcaaatcatggtcagagctttctggtgtgggatggcagatctggcagagagttaaatttaaggcacttgcaacagttgaatgagccactttttcatgtaaaggtgagatggcactggagagctgggcaagctacaagctggaatatactctttctattttataagcgaggttcataggacccctttttacctttgttcgtcattgaatctgagttggtacaccccaaaatgaaatagtatgccagacagtcataaggtcttcaggatcaggagttcagttttgacaagagcccagtagcaagctaatagctgcttttcaaatgaggtgtacctggtacgtgtatatcctgtatgttaaggaggtgatctgtccaaaatcccaaagggctcctgtgaatggaagctgcttacgttttcctggggctccaattagaaaaatcattagtcacagaaactggtagctcacaggttaattagggatgtgggaccccaaatatagagagaaggccacagcctactaacacagtgtgttggtttctgcttcattcaaaagatgctgatattttggaccagctaatatagaagtccaagtagaatttccaagtgaggaacacaccatctccaatgcccaaatgtcccaataaggtgctgaacattgtttttgtttgttggggatgaagagacagcagtttttctttgactaccagaaggattaaacattgtgaatctgctcatttagtcccaagaaactttatttgacaatcagaaccctgaattttgtcagaatttatcagctgccgtggttgatagaagtgtgataacaccacagtcaatttccattgcaatggaagcttctaactggctgattaacaggacatcatctgtatagtgaaagctttgcaccatggagagtagggacacttatgctgacttatgtactactgatggcaaatggcagaggaatgttggtacccctgggagtaacctgtagtaatgtgggaggttactacaaatgtatattggtggctatgttgtgacttgatctttgtcctcagaagccagtggtatagaaaagctggtactggcacagtccaagacaggataccaagagtttaatctgtgcaatggattcagttacatgaatagttgggattatgggattaacaacttgattcagttggtgataatccattccaagcttctagctctcattacactgtttcactggtcatacagtgctgttgtattaaaacactgcatctcttagcacccatgttcccttcaagtctgtaatcaaggctgtgattttctttcctctttttcttcttattgtttttgttggaccatctgggaggaaatagagaacaagaccagaaagtgatttatgtgtccctttagcacttcactacatttggcctttcccaattgtgataatctccccaggcacttaactgatgatgaagtataagcacttaatatattaattactatacaatcggatatagaaaatacaacagtacatggaattggcccaaagggctccattcatgagatgatgttaacttgcctttctcactgtgaacactgcttaaactccattagctaaatcagacaatcttttctttctataaatccagttaaaaacatgacttaggtgtccacatcccaatatcctaaaagtctgattcccttattttcctgaaattccccaacattcttggataggtgcatatgtcatttgatacccattgggaatagagataccctgacttctagtaatatttctctttaaataagctgagattatgggagaaggggacagaagaatcagagggtaagggaggagagagacttcatatgtattatcccagtttcaatgatattgcagtggctcatggcataaccaaattaacttagaatattgttgtccagccaatactctatattgggagcaggactcctgtggctggcaccatctatttcatccttggggatcctttgactcagtagccacagatacattgctgtttttctagggtatggggtttgtgacctctggctgactcagtcttggctcacacaatggtgactttaaggcatccaccttaatttggggcattagctgccgcaatatcttatatctcttaagttctcccagtttcagcatcaaggatagggaagtttctctgcacagtgttgataacctcaagaatttacctaggtttctttgggtctctttctcaattttctagtgggtcaattttatcagaattctagactcaatccaggccattaagagcccaaatactagtcaatgcctcatctgtggttttccacaggagtttttctgtctcagaaaaatctcctcaagaggagtaaagcttccttatagcagcaaagtcccactgcaaaaacctttgatagattttctcattacttccaagtggatctaaggttggcacgaaggcgagatttagctgtaagtcaacacagcatttgccatgattccttgagaagcagtatgatccataaccccctcctttccattgtgagccaaaattctaatgattcacctggtttctggctacagatttcccttttcacactcaatatatgtacacattactctttactattgtctgaaagagggtagaagcttctgcctacccagtgcaaatcttagtattagttgttacagtgctgcaggtctgagactggactcgattccagtctggaattctcagacaaggaactcgttccatttagaggaaaattctggcatctgtattttacctatttttgttatttagcttgcaatgacctccttgattcctcctcattaaaaggcaaagaagtgaaggactgtctatcgcccagtggcccatataatttgcaaacatctttgttactgattcttacagacttctctcaaatatttatcttcctgaaatttttcaacattcttggatgagtgtgtatatcctttgatacttattggggatatggacccttagttatgtttctgtgtaaataagcgaggtcgtggtacagggacagagaggaatcagagagcagggaaggagagagacttcatatgtactataagtttcaagtgatgtggtggtggttcatggcataacccaattaacttggaatatttaataggcctgcagggctctcatcttttctcttccagaaagccatgactttgtcagcatcccatcctcatcactaacattataaaaatctctgaagggtctgagatttttctctgctcacaacttaacatgaaagtctgccacagttgaatggatgctggtagaaaacaatagactcctaggtcagagatgaaggacaatttatttttcacagcaatagcagtagcaaaaatatcaacattttggtcctgttccctgggtcccaatttccacaaggcaacatgaagtatacacattacaaacaaaaaggccctcaatttaaggaatgtcacccctttataatgggcagtgaacatgcctctctttgttccagaagatactatttctatccaaggctgtctgctttacaaacatgttcttaaaacagttcaaaacaaaagcagtcaatgattctttcataagatgtgcaaaatgtgaaagacccatggaaaattgtctcccagtagtgacaaaagacttcaataagtgactgtttggataggcttcttatctgtggtatgatatatgttcatccttgctatttcctactgatggaatgcattaaacttttgttatctgagattgatgaacctttcactaagatagaaaataagaaggaagcttttggaacaaatatattgtatttaagctgcaatattagagtctaaattagtaatttctgactataatctatatagattacagcatagggcgtgttaaagaattgggaatttctatgtcaggaagtaaaaatgtgagcctaaaccacaaaatatattaagcatatactttgtgtaattataatgtattgtaaatcaaaatcattaagcaaaaatgtgttattacatatttcccatggccataatatttctccaatgctttatagtttgaagggtgtccaaattttcctaaataatcaaaagaaaaaggtgcaatgctgctttaatatgtttaattttttcaagactgagcataattgtcatcttctctaataggcatctcctatacactaggcttggacacatgcctttctttgtattaacacaatggcaggtttatttgtaccattttatgcctttacaacatcatattggccttatatatttatgtttccctgactggattactctgaaattaaaacttgttgcttattactcttcgtactcctagtgcctacctccccaactgaagcatggtgagtatccaataaatgctagtagagatgaactgaaagtaacagtgtctgttaatgttgaatttactttcagatattccagacaattatgtcccatgatgaataactgaatggaagatgtatagctgaaataatttataaaatttcttaatgaccattgttttacttatagtcatgtaaatattcatatcctgatactcattcccagttttgagacatcctgaaacatttcaaattttgcatttatagtgaaactttaagattttatatcgcttttatacttttagacattgaagagagcctcacaaaattaaatgtaagactttggttaattatcaaaaggtttggagtcactgatttatattatacagaatttacttctattctaaccctgcattagaaatttcaaagcatctcgcctttcttctttttcaaagaggtagactgaagatgaatacatgtccctttctctgccctgatgcacagatgttctttctttatttctttgtcatagtttttttctctctctcttgcgttcagatagatgtctgctgctcatatctacctttgcggtttctgtcaccaccccacctaatcattattgttgttatcgccagtgctgccaaccctgaaatctggtgtacttctccccttcctcttttctcaaattttccaatttcttctgactcttattgcttactcatattctaaaaacaacaaaaacatcaacaaaaggactgtctctaagggacagctgccctttccttctgtgcagtgaacttgaaggatcagataaagtgatgggttctctggcttttattctttatttgttggttattcaagggctggctgtgtcttcacttcacttcaagggctgtatttttctgctttttttccagagccattttggaaatttaagaattctaaattcttggattttcattagccaatgttttgctgttttcttcataaaaaaacaggtttttgtaatttttttgtccctacattgccttgttatttaatagcaacattaacatgtgaataccttagaacttataaaatatgtgtgtcatttcaaggaataaaaaggttggagtgaatcaaacacaagacagatatgtttttatgggaagaatggaaggtcaagaaatgactggcttgcttggagtatgccagtggcaatcttgtgcagaagaaaagaggaagatatcaaacaacagaaaaacaaagaaattctgtagagagaagaaggggcaaagtagaagttctagaaaaatagagacaaatatttacctatattataatagggcttcatggaaacactgcgttacatggaaaaaaaaacacagagctgtaaccagatataactgggttcaaattcttacctgtttattgagttaactgttcgactggtacaaaatcactgtggttttggccagtatttttaatggcaaaggaatgcttaattaaacattgagtaatgtttaatgtttttaattaaacaaagacttaatatcaactatttagctgagagattaaagtcaaatttcttagtatatctgagactctttttcctattacataaaaattttgcttaattattttgaatatggaattggataatatgtagaaatctttgaaacactgactggcactgtaaattctaattcaataaatgttacatcttctccatacttaagaatttaagaagacataatcatttcagtttgtaacaaataaaatgagcctatttcccaaatagacaattagcaagtgacaattggataatccaattcgataatcagcaactaggagaactttggaactttcagaatattatataataatgcaggaagaagcatataatgagcacggaagagctaattagaatcatactttccatgataatatgaagtaatcacttagaaaagaagttatctattttaataattattcagtcacagtggtataaaattttttccacaagaattaaaactcatgaacaggaggagttcttcttttaaccaggatgaacaaaactggaaagactatcaatcccaccatcacaaaacaaagccagaggaactacaaaaccataacttttgttaaacctgttgtaaaaccgagttcaccaggcaaacaaatatctaggttttcaggaaatgataggttcctccactgagaaacgagtcatggggatagtgtcatatgtggcagagaatagaataggacctggctgtcatacaagcgatgatagaaattattattatctaaattatctaacaagaaattctgtaaaaagctaaaatcattacaaattgccaaagactgactgacagtttagaaactctggtaatccctgacgcaagggtagtttgatgtcacccattggggcttatatgtggacttccactaggtacgtatgagaaatattggaagcagggtggggacaggagggagcctcttggtaatacaggtgcagagtaagggattggctgccacttcagataaagcacaaaatcccagtctattcaagctcgcatcccacatcctaagcacaaggctagaggaatgtgaagtctttggcatcctgaagatcaactcttgactagagtaactcaatgccccaaacgaatggcttcagaatagcaaaagtacactctgtttctaggtataaatgattggcatcattcccaattattttgcacttgatatttgacatttaattgacaaattataagatatacaaaaatttaaagaaagaaaaacgattgtcaaaagaagtcaagcaatgaacaaaaccagacttagggatgatccaggagttgaaattatcaaacagggactatgactaatgtattaaagaacctaataggaaaaagtggacaatctgcatgaaaggatggagaattatggcataaaaattgaaagagcaggaaagagcaaaatgaaggtgagaagtgaaaggaaatattatcacagatcacaaattctgcaataagtggataaatttaccaacaacaatcccaaatatggtgcagctaagaacagagtttcagaatccaagaagcgaaattgatcaaactgaaaggataaaaagataaatccacaactatgggtttttctgatgaccagaactcctctgtctgtagttgatagaatgagtcgaaatcagtaactatatagaaggcctgaacaacatcctcaaacagtttgacataaatgataattatagaatactccacccaataacagcagaacatggaagaaaatacttacaaaatacacatcataaaggactgatatgcaggatatataaagaattctcacaattcaatgatcaaaaccatataacccaataaaacaagttgcaaaatatttgaacagacattttaacaatggagatacatggtaggcaaaaaaagtagtgaaaagatgttcaacactggtaattactaagaaaattaaaaaaattaaaatcagagtaagatatcactgtagacctattagagcaaaatgaaaacagaacaaacaaacaaaatcatgaccttaccaagtccgagtgaaaatgtggagcagttggaacactggtacattgctggaagggatgcaaaatagtactgcaattttggaaactgtttaatagttccttataaagttaaaaatacaaatatcatatgacccagcaatacaatttctaggtatttactcaagtagaatgaacatgtgtttctacatacaaagttataatgaatatttaagtgtgaatgaatacccatacttgccaaaaactagaaacaacctaagtgtccatcaactgctgaataagtaacaaactggtatattcatacaatgacatactacttagcaataaaaaggattgaactactgcccagtgaaaaaatacactcaaaaggctacatgctgcacaattacatttatacaacattaaaaaaataaaaacgtaggaacagaaaacatatcagtggtttcgaagggttagggtgggaagttgaggctgattttaaaatgacaagaagtaagattttggaggtgatggaactgtgctatatctggatatacactggtggtttgtaggcctttgtcaaaattcatagaacttgccactttaaaaagattaataatctgtttgcaaatcatatttcagtaaacctgatttttaaaaaatcatgattggaagaatgagagaagtcccattaggtaggtctacatgttaggcactttctaacagtgcctagagatggttatttcacatatttttaattccttgcaatttgaacatttgagtgtatgtgtgtaaacaacctaattttggtaaataacattttgcattattccaaagtattgacacacatctatattaatgaaatctttattaaatccaatcatcttaatctaaacttaaccttgaagagttattgggaaaggattttgagacagattagtagataaaaaaaactataatttagagaggttgcatggtttgctggtgctattaagcattgtagtcagactagtaaacatatactgggataacttacctttaagtagagttagggtgactgccccccaagatcacggcccagtgtagcaaactggtctagtaaaagattatctgcccacaactggacagtaattacttaacaaatagtgtatccttcaatagagcaacagaatatttattccctagcaatttataaggaagtatacctttgacctgctccatctactagtcatcaaaaacttagttatattgattagtacattttgaagaattgactattgctctaaggaaattggccccaaatttaaatactttacttctacttttaagtctttttaaatatatttttcctagtaatttatttctcagtatattttacaaaattcttgatggagaagaattttaaaacaaaactagtactttacttcaattggtttgagaaacactcattcccaggcattcaaactaactaaataaaaatgacaactgaaagatctgtagccaatgtggcctatggctttccagtttgcagttcttcctttaaatattctaaacttgagacctgtgtaccaagactgcattattctcaccttttgcagaactgatgtacctatgttatgttttcagtttacattgagctctgtggaacatattgttacatttaaaataggacttttaaaaaaaatccagtttattacataatacagagtccttttatgataatctacaggagaaatgtttctcacactttgtttcccggaggagtcgtacttattttgttactgattttattgaatgagcctctttttaatggctgctaggaagctcagtgtcaactttctatccctaatgactatggagagactatgatatgcctttttaaattaagtgacttaatttatgaatgttgttgtttaattttatgtttccaaccttattcagtcagtaatttttttcgcataatacatgttaacttttaataaagtaaaggacactagaaagaaagacaagtagtaaggaaagaaaagaaaggaaggattactcaaatatgcttgtatactacatattaaatatctgagtaactctagagtacattacttctttaaattttactctcctagatacctagttgaaaaatattctttgaaaatataactttgaaaattttaatgttaagaatacctgcagtagggggaaatttaatactattgtctttacgtgaaagtaggcagtaaaattcacccatatttccttttcagaactccctgttcttaaccaggttatgtaaactgggagtcccttcattattatctctatccatgtggtctcacagtgtttcaggctcctgatttaagcctggccctgtctataggcaggctgtgtaaccagagagataacagcatcctactgagataatatgcttttattcctaatggcaacctgaggagtagaggaacagtacgtgttattagagcaattgtaagaaaacttcaggccagatttgcatcctgttcaactcggcatgacggtttttgacggttttttgattcccggaaagaagttcctaggctgctaaccaggaaaacaatccacgctattaagaacaactacatgtggtttccagctctctacaatgagagttgaaattctgtataattaattacaccttatgcagataaaaagaaaggaagcgtaaaagcaaaccactctgctagtgaaagtatgaaaaaatattaaaagcttatttgttatcagtagtttcataaccactgccaagctttgttctaagattttgaatatattggattgactttcactgaataaagagtaattgtaatacttttcagcttgtgagaccttacatctaagtctcactgagaactttttgatcactaattaaagctgctaaacagttagtgtacttctattgaatagaagcattttcatgattgatgagacagagccaccattaaaatggggtacagcaatccacagatagaataaaattacttataaagggaaatgactccacattcaattgaaacagcaggtccagaaaacatgtaagaaacaattaattatataggctgaaaattgtccaaatccctggaaaactgtccaaggtcagtttcccttcaccctaaaattattttcctgaggcacataaaaattttattgacatagaccagttgtataaatagcacagaatatgttagacagctaattttttcaaactaaacaattatatagacaagctgtcttctttcataaatttgtcttctgatataccaaaatataaatattcatacacactcaaattcaaacacatatttgttcttatgtacatacaaatacaaattagcaaatatgtaaacacacatacaaatacactcacacacaaatgcacatatacatatatatgcttacatataaatacacacattcataaatatatacacaaatacacacacacacatattcatcctaaacttacttaaacaccctaaattaagaaaaaaaccctccaaaatttaaaaaaaggcataaagacatttaacttaggaagggaaaccataggacaaacaagaagacagaaaatataagccctatacagtgctggataagcagggtcaaactgacttcccattggtagcactttttcagtattctcttcttatttccatcttagttcttgatcttcatatcttttggctcattcctccagcacatcacccttctgatgaagcaggcacagaagcagaggcaacctctgtaccaacttgggaagaggtagagctacatcatcattagaaggagtagaggagcattttatcattataactattactgaaagataattgcctatgaggttatggttaagcactgtaaccctattacctacttatactgtccctgttttatttagaattatatccaataaccaatatgaaatcaaactggcggagaaaaaaaaagcagaaaaaataaacaataaagcaataccaaaatggaccataaagtataattcatgtaaggagcagtacatgttcttacattattttttaaattattgtctttatttaacaatttctattgaactagtgtgtaaatatttcagtgcaagataaatgccctagattaggaaatgaatcaatcagcatgaatccatttgagaagcaacggaacagaatggttctttatcacacacttactacaataagggcaatttaaatatgtgcttagaagaccaccacctacatccttataccctaaattatgcctctccagaccccaaacttatccctgcaagaccccagagggcttgtttaacaggtgcaaagaatgctaccaaagttcttaactggaggtgaaaaaaggaaattagccatgatttctcttgtttttcaacttttaactttgtaagaaagatcagttttggaacaatggcctattacaaagcagaagcatgagaatagtggtttgggaactacaaggtatcagttgtttggataagaggagataagcaaatgatttaaataagagaacataggcaaattagctacaattttctaaaagctctgataaaagagggacaaaaagtcatcaattcaattaattcacttaaggtcatgaagttactaaagagaagaaatctttattagaaaaaatgatataattaccttctgtaatagattatgtcctctccataaaaccaaaatgcactattacacatatgaggagagggagggagggaaagaggaaatgaggaaaaaagagagatgaagagagaaggacaaagtcagagagagagaagagatcctatttattctgggagcattactgaattactattattggtatgacaaaaaagtgcataaatgcattgaaaacaaattatttactcccctgtttcttttcttggaacagtaaatgtcactctatatttagacttgaatttcacactcttcatctcatcttcctttgccacccataaccttattttctcttatatcttattcaatttccttttatctcttaatacatgcatacaacacatttaatttcttccatttttaagaggtaagtttggaaatattggcccatagttttgaagatcaatgtaatatttacccaggagaacttcaaaagatatcttaattttaatattataattaaaatataataaaatattatatttattatactaatataatattatattaaaatataatattatatttattatactaataaatataatttattatactaataaatataacatatttattatactaatataatataatattataattaaaatataatataatttatttattatactaatataatataatacatataatatattatatgtattatattaatataatatattatgtttattatattaatataatataatacattatgtttattatattaatataatataatacattatgtttattatattaatataatataatacattatgtttattatattaatataatataatacattatgtttattatattaatataatataatacattatgtttattatattaatataatataatacattatgtttattatattaatataatataatacagtattataattaaaatataatataatatttaataataatattatgaaagttctcatctgcaaaagaatacttttgattttagatttcttatatattttgagccaaaacctttatacttcagaatcgagattctatataaatactaaatagcttaatatttaaaacataattttcatccaagatgttctttaaaataatatttgagttaattttgtaaggttctaagcagatttccatgctgcaagagtaacaaattatgaagagtaaatatatatctgaaatttgctattataattaaataaaaccaagagcaatgttaatctgatacattgagtctgttcatggtttgcataatcgtgatggtgcagatgattattagacataaatgctaagtaattcacataaatgactatcagtagaattacttggttaaactaactttttgggttttgtttcttcccattttgtcagtagggcctttagcggtggtaacttccccataacatgtacatttaatcatgattgttattaactcaaatataacataatgtaaattgtttcttccttacagaaccttaagtttctttcactggagagctcttcagttcatccatgaagctgagtcccagattaaaaaccattgctgtggtttgtctgtattttggtgtatcaaagcagacaaaagaaaaggaaagcacctccaatccatcttaataatcatcccaccttcctttctgctttcatatgacatttatttaaaccaagctatagctgtgcttctcaaaccttacagtccatgtgaatcacctgaagatattattaaaatgcagattcttattcaatagatctgggttgggatgggagatttctaacaaactcttaagtaaactcctactctggaaaccacactttgacaagcaagggtctgtaaaactagaaagctagaggccttttagttcatggctcttaaccaagagcctgcgaatctctgggacatttatccacaggttttaggattctatgagtcccaagaaataaatgcaaaattttatatgtatgtgggtatgggcatttttttattttctggagagttaacagttattagcctttgtaagaggcttatgaagacctaattaaaataagtgggtagtgattgaatcagtcccatttttagatgagtaaactaaggtctaaggaagctaaattatctgcgaggttcacagagtttgttacaaacctaggaattgcatccaggtttctggtgcctaatccaggggctttgattgtactagactgtctttcaaactttgatttgagagaaataagtgtaataattcagtaaataaatttaataatgaaagaacaaataagcaagtgaacacattcatgcatatgatcctttgaagagaaagcataagaatatttggcctggattaaagaagaaactgatggtattgatatttaatgactttgatatggatgaagttggggaacagcaaatactggaaaaaggggcagcaaaaatggaatttaaagattaacccttgagactaatctttttctggataaaactctgcaaatgcttagtcattagtcattagtgtgaaaaaaaaatttttttgaatgttaaaaaagaaaaaaagaccctttttatcttctctgcagagaaatgtacttataaacaatatcatattttcattagccaattatacctaattgtgaatacaaaatggcacaagcacaagttcttaaaataattactgcagtgatgagtgaggtgaatgtgacagtgattgatttgtaataccagtgaaatgtgcacagaaatactggctaagactttaagctgggctatgattctgaaggtattagaagtttccagacaagtgagctaacttgagcctactatagacacctgaaacatacacctaatccctgcatcttcactgcaggtgtgtggtgccttgaacagagagtgatgcttcggagcgttgccacaaggtcaatggctcctaagtaagatgtataagatgacaacagacaacttcaggtaaaagaaatacaaaatatgtaattacaacacttttaggaaggcatgagtttccatttaatttccaattatggaatcaaatcagaagaagagtaaagttttcaaaagagaggttcagaacggttgcacatattcaccagagaggatcttctgtcgtatctgggtcagacgaattcactgcaatcttggaatctgaaacatgagtaatattagaaaactgaggccatctcaggcttctattagcagaacatctggctaaccaaaacaagccaaaacccatttttaattcttcttctttgccgttatgcgttaaaactataaagtgaatttgaaaaagaatgtgggagactatgaggaaaatatagggtaacttcctttaaattttttctattatgcttttaaaaaatgttaagaattcagaagaaatttggcatttctagaaaagcagttctcttccagaatggtagctggggaaaaatatgtccaatatgtttcccaccagctgccagagatatatttaaaatgcaaatctgactaggtccaatctattcttcaacatccatcaatgacttttaattgatatcaggatagtgtttgaatagctttaaatggctttgaacactttcttaatctagttcttgtttatgtcacaaatctcatttttcactggtccccagtttctactttaagctttggtgatactgacctgaatgaccttctttgcaccatctacatgaaaatgtggctcttctttagcttatgctttcattctgcacagaatatcctctttggcctggttaattaaccaaaaactcaggtgtcacctcttccaggaaaacttccccaaacaaccagcctggaataatcaagcctcccctcaatgcttcaatatttctaccttagcacttaatgtattattctgaaattatgttagtgaacctgcccttctttctgcattgaataatctctaagagtagatgcatgactttccttttggtacttctatcactaagcttagtgatgggcacataatttacgctcagcagatgtttattcaattgaactgaacatcattcagttatatatatgtatacacacacacccacacacacacgtatatgccattagtgaaaaccaagcaatggagtgcaattagtgccaactatgtggaatgcaggcatgagacaagagaggaacttcacagtcctcagagtatgtttatggtgataaacaacaatcacgttcgtgcttactacctatactacctactctccattagctcctcaccaatttataaaaatgcctgtaagtttctactgagcctattattttgtcttcgttttacactgtgcacccgctatctcatttttcttcattctgtctcttgaacttggcaagttttttcccacttcaggcctgtgcatgtgatttttttgtgcctggattgctcttcatttatccaggtctcaactcaagcattacctcctcctcacaggggcttcctcagtcaccgtatcataagtagccaaacccgtactttcctattatttataacatctgaaaatctctcatgttgcttattatctatcttctctgctagcagtaagatagcagaggacagagaccttatctatctttttctttactatgtctccttcatctacaagagtccaagcatttagcaatgagcaataagttgtgtagacgtaatgaaatgaataaatacttcctttccatgtggggttttcttataaagtgtttctacaagactttcttggcttaaaatatgttagaagcccatgtctcttggactttaaattcaaactatttttttttctgtctctttccttctctttcttgcttgcttttttactttctttccttcttgtttcaagtatttattaggctctcattacatgttaagtagcgataactaatttatcataccatgtatgtgacctatgacattatataaaatttttaaatttctgacttgttctgaatattgaatgctatattgtttgcagtgattataagtgattgtctttgttatcccactgcctaaccaagtgccagtgcttagttgtttaaatggtccatctagttgagaaccatttagaagaacaaaacacattctatttgaggcactgaaaatttcaactcaggcctacaataaattcatttatttatccatcaactcactagtgcagtcatgtggtctaaaaagagcactgcttattagctagtattccacaagtgaaaaggcataagagtgcaaaaccatggtgcattcctagaactagcaatcctcgatattcttggagaataaagctggaagtagaaaagggaatgaagaagtagaaggtcatgtgacattcagaaggatcagatcaaaaaacacctttcacgacaggcaattgagccggcattttattttgtcggtgatcctactctgtagtatcctggcaatcaagtagagggttggagtgactaaacccagataccacagttcaaagaaaagagatggggagagcaagaacagtgcagtgtggatagaggggaatctatgtaaaaaggtacctgttttggaggtagcattattagagcttgaatgatggaatgtgggcattgaaggccaaggagaaatctaggatgaatccctggatttggcttagtggtaacattcaccaagacactggaagatggccaagtttgttgaagttgatgttatagcagtttctttgtacttggcctttttatcacttttatttgtttctactattgtttaaagggtttaatgagagggtgggaaaggaagaggaattgatgcactagaattctcagatttgagcctacatgtgtctttacctgtgactgcccgccccctttcctcatcatcagctgccccatctcttatttgttctgcttttctctaggctgggccagtgtccctcccggtttatgcctttccccagtttttctctcctgtgacccatcttgcaaaacacgactttgtacatgtatttacacatcagtgtcttccccatctagtagactgccaacttcttgaggacagggtttatgtgtccacaaagcagccagcagaatgcctgatacacaataaaatattttatatattgaattcttatttaagtgttctgaagctaagaaattcagagtgatggattttctattactcaagttcttccctactgtgcttggtagaatacatgatttataacttacatgtaaatttcataagctttgtgtaaataattcaaaattaaatgtaatcttttactgttccctgaatgtaaacagacatctactcatattaaggtaaatgattttatctatggatttccttccaacatcccatttctatgcaggaaaataatgacagtcttttagagctactggcagtgtggtatggagaaattttacaaaaccagctgactgccctttaactggccctgaaatggacttgtgaggtgatacatttagctgttctggacactagtttttccttcataaaagcatatgtctaagggcatttccagctccaaaattctttgatctaagtgtttttattttcccttgttgaatttctatttaggacattaaacaatctgttgatatatctacagtcaccatttctgcctcctgttaatcccgatgagtctcctcttgttacggcctaaaccttttatggaaaaatattattgaagggtagtgttttttctgttattgttctaatacagaaataagagaattacaattattatttgtagtaagttatgtagtcagcacatttttgttctctctcatgtttttgcaactaatgatgcttttctcctgaactttatcatcaaattgtaccaatgttattttcaagtacttgcctctggaatagaaaccatcctataactttcagttatttccagactctctgctcagttcactcccccaccatcccgacatccctaggttcatcctggtcaggtcagtgagaactggatgccaagctgtgcctgcagtcaccagagcctcccacagcctctgggcaggcatggttatgtctataggggcatcatcacaaccagcaactatggacatggaggcaagtatcagaaaccctaaccttaaatataactaagggaattcccagataagtgttagaaacaatgtctgcatcttgttgcttcgtattttaactattgttttttcttggtgaacaagtagcagatagttttccagtttttcaattttattattaaaaatttaaaacacatggagaatttaaaagaatttaaaatgtgcccactacctaaattctgtaactaccattatattacatttgttctgtgctggaatatacatctaattattcctgtaaattcgtttattatgcatagtaaattgcagtacacttcccctgtatactccagcatgcatattataaactagagatcaatattttacagctgttttttttagttatttaatgtagacttgaaagatggatattctagagatgaatcaaatcttagatacaatgaagccccaaaccctccttttttggtcttgtattagcccgttgggtttaagtgtattagtccattgagttttatagatgtattaacccattgaattctcacaacacctctgtgagatacttcccattattctgttcatttcacacataagaaaattagagtttagagcaggtaattattaagacttaatttattaagcttcctttgtgccgataaactatgtacttagcatttaaaagcttctataatggtggttatctgccatcagtctctggaccaatgggtttcttgactaaatttttatgagtgtggcaaaataaaatacattttacctgtggtgagtattacataaatttagatttgatcaattcacaagattgtcgtttattcttttttttggtctcactctgtcgcccaggctggagtgcggtggcgcgatctcggctcactgcaagctccgcctcccgggttcatgccattctcctgcctcagcctcccgagtagctgggactacaggcgcccaccaccacgcccggctaattttttgtatttttagtagagacggggtttcaccgtgttagccaggatggtcttgatctcctgacctcgtgatcctctcgcctcgggtcccaaagtgctgggattacaggcgtgagccaccgcgcccagacgattgttgtttattctaagggtataactgttatacattatttgatgtcaaatgacattgtttttgttaagttatagttacaatagatggcagtcatacttatttgtttggttggttggttgtgtttgttttactgctcttactgggaaaatgccaatattattttatttgaacattttctgtctataaaatccccaaatctgagaactgttgatttatactagaagtacattattaagtgtcttacacatttaacttctcattgaagaaaattaacaaaattataattattagttattcaagagcacaattgttgtgaatgattaatcttctttgaatagcatattattttttaatagttggaaagaatgctcccacaggggctttttgtaatctcgaaggacgtaagtcagaccatctccaaggtgcctcctctgacacttgactctcttatattcatataagtcataggaaaatcaatatcagtaaaataataatcttttaaaaaccaacacattgctatctgatcagatcaaatctgatcaacagttgctagtctttacaagttcaggtttcagccaccttgaaccatcttgtggcctttgactttatttgattttgttggccttagcatcactttggctcagggtcacactttcaaaagtaatgcttgatttaaaatatatgtaacagtaactgtatttacatgtgtatttgggtaagtggttgcgagtgagatgaaagaacaaaaataccataggcattataactgacaaaatttttgtacatgtcccacattcaaaaaaattaatacatatgtgtacaaatgaaagcctttattctgggtgatttttccattacctataatttgcctctaaattgaaagagtgattccttgagcaaagatagcatgacctaaataattgtccttaaacctgactgtgattcttcattgaaatttcagaatttaatcatttaacttttgttggcacaaagagacagaactaaatagcaaacccatttgcatttacaattgctcagatttgaggggaaatattccaaaaatccatatcctttgaaaagctctgccatgcctgataaactaaagtaaacacaaaacatacaaataaacaaattgtattttctagcagtgctgctgaatcaaatatgtaacttattttcttcttatattatttgatatctgtattgacacagaatctccaaaccagcaaaccagtaataattgaaactcttagactagaaactggaatcttgatccacagtttattctgtgcttttttttccccctgatttaaacacagctgaaattacattatttagagtcacaatctgtgctgtcttcataataaaaattattttttataaatactctttttaattccctaattatcatattcaatgagtcatatgaattttaagtaatcttttattatgctaggtatgagagtactgtataaattaatcattttaattaagtaatgatgacaggcttagtgtaagtgaatttacactgtttattttaacattaattactgctgatacatacagccttatatgttctacccatcatataaatatttaaaaatgcttgatatgccaggtgactgatttcatttgctaaagttcgataaaatatggggagtcaatctaatttgggtgacagtgaaaggggtggagattgaccaggctcactgaacaggagaatgtcaggatttagggagttaaacatgccacagatgaatccttcagcaggacaagatgggccaaattgattgatctgccattatactgagggggcaaaccaagaggtgagaattgaaaagcaaaggcaaataatgctggattaaaatgactggtggaaatgtcagagcaggagctaaagaaccagcaacaatcagaccagaagaaagaaaagtgggtattagagaaaagcaagagctgaaataagcaagttgaagtataagggaataagagaaactctgaaagtgccagacaaaatttggccagactgtcatatgctatcccagctagattttgttttatgttgttccatgtgccacatacatctagtttctgacattatcatctaatataaccattttgttgattcctagataattttcaatgactctctttattaaaaatgaattttaaaccagacactttaagtgtttaaattacctaagtatcccaagactgacaagtaagcagttgtcatccaagatagcaaatactattgaaatttgactggtgaggcacaaagcagaggaagtgggggagtagcccctgcatgtgactgtgtagttcctgtagagaaaagggtgcttggatgggaaaagctggggctgaaactcagcttgagatgcaagccaagctttgtggcctggtcaccctggggaagttatcaccatgctgcaagacttcagaggaggcatctcctttcgtagtttgcccattcctggcgggtacttttttgcagtttgcctaaggcagcttaatgcagtatgggtgcctcgaggaggaggacagctagttgaacctcaaagaggccacccaggtataaaatgcaccatgaggtagggtataattttcagctttccaaatacatcaatctgaacttgctaaagaaatgagagtaaatcagtagattcagcttttgagcagctcacattctttctttgtatgtatatatgtggcttaaaagattccttcagtgtcttatttcatgtggaatagtattcagatcccttgataagctctacagcagtgtctttcaaagttgttttttttttttaactaggacccaaaaggggaaataatgtttatataccatgacccagtacacagatatgcacacacacacacacacacacacccctgaagcaatcattttatgaaaattattttctgaacgtatgcaatgcactttgatttttcttattcttttctgttctatttcatttaagaaaattgttgcatgtcactgaattgatttcaaggccaacaaattgatcacagaccaatttgaaaaatattaacctacaactccatttaacatgactctaaggtttttggaacttgttgctccctctgccttaaactgtccattcagatatctctgcaggaaaggctccttcctttctaagtttctactcaaatgccattgcttcaaagaagcttggacttaccacccatcctgaagacctacaccctaactctatggacaatgattttcttcacttatttgttaacttgtgtatttcatgccccttcccacatgtgaacatacaagctttgtaagagaagagagcccatcttcttcactgctgctccccacaaattctggcaacatggcaagtgattaatgaagatatatgttttatctatcatatatgtacatctgttccaaaattccaaaatattattttacagtggaaaagaccatttttattcaatctgggaagtgttgtcagcagattattgtgctttcctctaaaggaatgctacatttgaaaaaattatcagagtgacagaaattaatcatgtattttgagtttagtggcaaccaaaagaacatctccttaataatgcaatacaccctagtgactagaaaactttatctctgaaactgtacactttctcctttctaccatgcttaaatggcaaatccaagctctatttggtcttcacttttcattaaacagagcagaacccaagttttatatgacctgaagctcatatggtttggagccccattgaagaataggaaattacaaatacaacatgtcctcacagtgtcaccgaatggaaatgaaaatgttatggagaaatggtaagaaccagtagtgttatccaattatagtagaaatgcctcagttatgcaaattttataagtatgtgtgaccctctcaggcctctctcagaagccacgaaaatagctatatttaagcttcattggcttcacaggacatttgcctctgcttctaggtatacatttagttacaaaatagttttctttttcctgaaataaagtacaattgttacaatttctgttttctgagttgcaatcttatttctttcttcttgagattgctaacaaattacttcaataagaactgtggatatttcacaaatcttacttcatacacttaaaaaccaaaattttggttttgttcctgagatagttaattacattcattgtatatgtactttgtgattttagtttcagaaaggaaatgcatttctcaattacagatggcaggagcctcactctcctccatcctccctgccttccctactctagcccctgacaccactataagaataaaacaagggttacgatagaaaaacaaaaacaaacataggtaatatgtgagaaaatataagatgacttaagacaggcaacaagaattaagaaagatttcctgaaatctctagggcatcagtagatgatttgtagaggatgtattagttttctattcctgctataacaaattgccagaaacttggtagcttaaagcaaggtaagcttattatcttacagttatctaagtcagaagtccaactcaggtcttactgggataaatcaagatgttagcagagttatatctctttctagaagcttttgaggaaaatttgtttccttgacttttctatcttctagacgctgcctgcattctttggctcatggttcttcctccatttttcaaagtcagcaagtttcattgccctgacccttcttctatagatacgttcctctgaccacagcaagtaaagggtctctatttttagagacccatgtgattatattgggccctccagaaaatccaggatatcacttgatcttaaggtttttaacttaatcatatctgcaaagtctctttagccatataaggtaacatattcacagctttcagggattcccacccagacatcttctgggggatggggaggttcattctgcctgtcagagtgggtaagtggaatgataagtgctagggagataaatttgatgaaaatgagcagtaacattggaaatcattacatgcctaccactgttactcaatgggaagtgtttgtagcttgagcttgagaagagaactttcctgtgtaagatgtaaggaaggattgacaaagagaagcaaggtttccaaattggacaaaaggataaatggtactcccattcatgaagttggggctagaaggagagaataatggagagtgaattcatattgtcatattgatttaagttcctatgatacttaatgctacatctgggaggagatgagtgtattctcatggaacggaagcgaagaaaagagatcggcagtggatgctttgattagcatgtgctcactgattcatcaaatgttcctggacacgtcctaagtgccagttgtgggaaatgagagggggggaactgaccaagtacaattggaactgattcaaagtctgattttcctgagtggtgcatctgcagtaaaaccaggtgtggaagagcaggaatgctatagtcagcttgtctgcatttgaatcctgattctactaccttctacttgggtaaccttcaggaaattatttactctcactgtgcttcactctcctttcttctgggatagttataataataaaaatgttttcttcatagttttgttgtgagttcctacatgtaaaattatttgaatagtgcctgacacatattaaataaatactacttataaatatgaaaagacaagggaaaattatggaatggatcctcttgaagtaagggtttgattggtctaagtcagaaagtaatggataggaagaagaggcggacatagagtcatcaaatcatctcttccttccaaggttgtagccttctgggtgctgtcctctggaatccttagttctcaggctgcttttctggagtctctttctaagaattatgcaagctagcaacattcagtctcctggcatgtcaatcatcaaaatgccaaaacacatgctgctcactgataaaattcagtgtttaaatagaagactaaaaacatttatacacaatttacacatctctttctaataaaggaagtatatcttagtcctgtccttcttgagtgggtaaacaactctttcttacatcttccacatctcctatgaggccatcctgtttcaaaggcgagggccaaggtaaactatcagagagaggtttgaaaagaggtggttggttttaatactcatccatttgtattagcatgagaataaatgagagatctaccagactcccatgttggccccaaaatttacagcgtctggagtgagaaatacaaattggacaatagttttgacttttcctcctctttagactctgttttgcttatcttaattatttcttttgtgttttgagcatctctgttattttcattcacagaaaagagagaacaagaaatttggaataattataacaagatgataatgaaagggtgaagttcgtgatatatgggattagctaacgtggactaaatagttactatgtgtcaggcagcgtaaaatatgctatctgtcatttattcctcataatcattctacagggcagatataatcctcatcttaaaaattagaaaactgaaaaataaaataacccactttgtagaagtgggtctaccagaattctctgctcacaaggcatctcgaaggccatgtgcaaacagggttgcaaggaatgggtgcctatgttcatttcacatctctcctctgctcatatgcatgctccatcaccacactagatttcaaaacacactttaaaagatatagttattaagaatttcaagatggcagcagcagagtatttaatgaagtgtaggacccttctgagagcagggacctgtgtgaatgcacaggtcacacacccatcagtctgtctctgtgtttaccccaacctaatttgagttaaaattcaatagtttaagatgttaaaatcaccattttaaaaattttgaacagaaatagggttctgtttaccatcattccatttaattaaaaatgcaatgcctgtttagtttgtagtttagtttttcagtcatgagcaactgctctcttcattatctaacccagtgcttttcaagcgattctaacagaagagttgttttcctctcaattcattaccaactgatatttttgtgaaatacaaaaccacacagttggatatcttgctcttgtcaaattgctttaaaagtatttaaatgcctatcctctctttctgaactaatctcaatgggacttggaaataaatagtttacataccacactttaagtagcattgatctcagagatatcctatgattgcattttaattatacagattattttttaatgttaatctcagtaagaaactgcttagaaagattacctcagagtcttttaattcatttatggatgatgcagggatatgtagctgtcaagtctctttttctttttctttttacattacaatgcagtttacttaatttattttgacaactacttctaattacttaacgtaacacattatatggtaataaaaacacttaataatgtaagacctcattgctatttcagatcaactgagtgatgtgtgcatatattgtccaggcatttgtggcgtggatcatgtctctctctctctctgtgtgtgtgtgtgtgtgtattggggcaatttcttcagataaatttttggattctccaatgtgaagagattaaattccacgtggaatgtgaaaaaaatgagtagtaaatattgccaattctcagctctgaaaaaaaatggctaaacattattttaggttacattatatactatatattatacctaatttacatacctggcctttgtggggcatgcttttatagggcactagattatcatgtctctttttcatttttaccctatgaaatagtaataaaggatttttaaaaacttgattcttgataatatagatactgttacatgactgacttgaaattctttttgaaaacaataaaataggccaggcatggtggtttacatccataatctcagcatttagaggctgaggtgagaggattgcttgaagccaagagttcaaaaccagcttggacaacatagtgagaccccaactctaaaaaaaaatgaagaaaatttgctgggcatggtggtgtgtgcctgtgctcccagctactcaagagacagaggtgggaggattgtttgagcccaggaagtcaagattgcagtaagctgagattctgccactgcactccagccttggcaacagagcaagatcccatctctaaaaaaaattagtaataaataaaactataaaataatagtaaaattggtaaactggaaatttgcaaatcaatattatatattaaatatgtgattaaatacatgatttgcaaaccaatattatatattaaatacatgagtaaatataataaaatattacatattaaatacatgattaaatacaaggaatctaattccttggattagaattctggtggtaaagagcaagcatccagacccacttgatgtctctgaaaaaggactgctggttttccacaatctttgagaattgtggttggattgggaagtatattagttccttcttaagctgctatgaagaaatacccaagcctgggtcatttatatagaaaagaggtttaattgattcacagttctgcatggctggggaggcctcaggaaacttacaatcatggtggaaggggaagcaagcacatccttcttcacatgatggaaggaaggagaagtgctgagcaaaagggggaaaaccccttataaaaccatcagatctcatgagaactcactcactatcatgacaagagcagcatgtgggtaactgcccccaagactcaattacttctcactgagtcccttccacaacaggtagggattatggaaattataattccaggtgacatttgagtggtgacacagtcaaaccatatcagaaagtgttactaaaaagaactgaaatgtctggccaatattgtcactctttctttccatgatatttattctctgctgagttccctgcattttattccctaattctttcaccccatagcttcttggaaaatgcatcacaaggttccaagtatttagcaatttctgttattcattaagcacagtttattttcctcaactcccaattgattaagtcaaggcagaaagaaatagaaagttggaaagccaaatctcatgtgctccctaacctggccaggttgtggctcaaagaaaataggattaggaaggagaacatcagagaattttccaatggaactaacttggcttcactacagatactcagatgtcaagtgccagaaagatgttggggaaatgactacactataattaaaagtttctagttttttggctattttactaatcaagatactttttgaaacattaagaaaaaaaatctgaaaaaaaaatttgtcaacttttcttcatgaaggtggtgtggagagaagaatagaagggaaagcttagaaagcaagtaaatatttaataaggtcaaaacatttaaaatataaaaataaagtcttgaaaataatattgtgtcttcaccttactgtttttttttgtcttcattcaatcaccatccagccatgcacaccacaaagcccaatcatcactgaaaatataccaaaaggaaagtaattttaaaattatttttaatgcaagtactgaatcagactaattagcaaacctttatcctggtctactgagaaagatgtcaaaataattcgtattttcatcacaataaaattaaataattttatacttattcttcagggttattttagatttttaggattttacatgtctaagaagcattaaagcaaggcattttttagttcatttggtcatttcacttacttttgtaatttagaaactttaaatctattgtatccaaaatactattagaactatgactacattaaatggaagaaggaagtctttctattttcaatgaaaaaaaactccaacaactgaacctgagcctgaaccattcaaacttaagaaaataaatttataggcctggtgcagtggctcatgcctgtaatcccagcactttgggaggccgaggcaggtggattatgaggtcaggagatggagaccctcctggctagcacggtgaaaacccgtctctactaaaaatacaaaaaagttagccgggcatggtggcaagcacctatagtcccagctacttgggaggctgaggcaggagaatggtgtgaacccgggaggcgtagtttgcagtgagccgagatcgcaccactccactccagcctgggcaacagagcgagactccatctctaaataaataaataaatttattaacaaacatatttaaataaataatcattgcagcactggccaaaatatcatgtgttatatgttttttagcaattttgcaaggttcttatggaaagctattcggtatttgcttggctaaactagtcagataaattgtatataatatttatttatagtattaaatttttggtttagggaaattgtgaaattatatttgtgaacataatactatatgagatataaaataaataaatcaggtaaatcacacatacttctaatttttggatctgtttaatcttgctaaataaagcacaggatgtcataaggtgttgcaatagagtgttgttgtggtgagtgagatgacaagaaaactaaatcttccactgtttcaaggtcagtttcatcaaatgaccatatttcttaaggtgtttttggcccagggattttgtccttttaagtcaagatgaggggacagatccattcactccttcaatcaactcttctttactaagtctttactctgagctgggtattgtgcccagtgctggggttataacaaaaatgaaagagatagatataggttggtccttatggaccatacagtatgacagctgtttactgtagtattgggcacttttaccccaagaccaagtccacatgctagtgtgtaatgtgaaatatgctctatagaattcatttattcactcattcatgtatttaagtcagcaatttttgagtaactattatgatccaaacactctgctaaaccttttgactacaaagataaaagaaaagaaaaatccttctgcacttaaaggatttacagtctaaataaaagggaaacacacatgaccattaaaattaaaaacaaaggatataaaacatgaatacaatgaatatcataatgcaatgtagcagatagattcaaatgtgaaacaatccagcatacttgaagttggaagtttaggcagaaatattgatatcagcacatggaagagccctaaccacatattaccttataaacttgtttgcagtcctaatccctttgtatttcagtacttcatatgtctgaaagagcgagaaaaaaatagtgcatatatcacaaggtttaaaagtgagcattaaatgtaataatataggtaatgttcttataagagtgcctgacacatattacatactaaagaaatattagtggtcattttcatttttatcctttctgattttgtgtttgtgatttccttttcttcattagatttccaaggattctttaaattaattttcattatatcaataattatgccccttgatttagtaatgaaatacattgttttattggttataccaacaaacaggaaaaatacgaagatattgtttaatatttccaaattcattaaattctgctcttatttaatactgtatttttccttctgattaattgatttataaattatgagtggtctgcttagtgcattgatttttcattcttatttaataatgaaaacatttaatgttacacatttgcctttgcatatagctttagtgatgtgatataattttgatgtgcagcatccttctgctcagtaatttatgaatacatgtgactatacttttaatttttatttgacccaataactaggataataatttaaatctcgagttaatggctgtttggggtttgttttttttctttacgtttttcctgtttgaaaaccattaagttaatttcaaattttagtgtatctttgtcaaagattatatttagtatatgcaatatctgctttggtaatttatttagattttaaaaaaatcttctctttttttcctttttttttaactttattgttcaagggtaaatgtgcaggcttgttacctaggtaaacatgcatcatgggggtttgttgtaccggttgtttctttatggtgtggtctgttttcagttacacagactatagataattgttttttgttttcgtttttgtttttgttttctatttctttttctttttttttttttttcctagagatagggttctgccatgttggccaggatagtctcaaactccaggcctcaagtgatctgcctgccttggcctcccacagtgctgggattaaaggtgtgagccactgaccctggccggactctagacatttgaaaagaaatttaccactctattacataaagtttagtgtacagttattctatttctaatataatttattatttgtcttctatgttgaaacaatttatcaaaatatcaaaataatatttgaagtagtatatcaaagtcttgcattttagtcttgcatttgaagtcttcttctatttctatctagcttaagttctacttttaaaaaagaatttatattttagatatgttgagtttctgctgctacttgaagtttcatgcttgttataccttcgttatatattctctttttctgcataaaatgacaatttgtatctaatttaatgctttctgccttggactctatcttgtctaagactaaaataatgatcaatatctgctttcaacttttcaaatacccacatatccttatttcccattgagtggggtagaaaaagacaaatagaatctggttagtctctatggcaaagtcatacatatgagatctagaaacatttttcttttgccaagggcattaaaatggcaggtggagaatcagtactacaaacaggcatatctgcttttagttttcttttattaattgtttatgtaacttatactagactgctcatgatcaataaaacatgcaggaagttacaagacctttttccatgactatcactaattcagtcagggtattagtagtgaagaagaaaacacaatctcaatataagcaaatatacctagtatccaacaaaataagctctcagctgggtgtggtggcatgtgcctgtagtcccaggtacttgcgaggatgaagcaggaggatcgcttgagcccaggagttcgagtaggcagagctatgatcgcaccacatccagcccggatgacaaagcgagactccatctttaaaggaaaaaataaaaaaaaaaacctaagcttttaaaattagtcatctaatgaaccactgaatacgataattatgtcttacatatttacaatatacactctctgacttaacgatggtctgacttgggatttttaaatttaagatggcataaaggcacatgcattcagtagaaaccgtactgcaagtacccacacaacaattttagttttcactgttagtgttcaataacttacatgagatatccaatactttattataaaataggcattgtgttagatgattttgcctactctaggctaataaaagtgttctggcaaagcaagctagaatgtttggtaggttagttgtttaaatgcatttttaaatcatgacattttcaatttataaagggtttattgggacataatcccatcagaaattaagggacatctgtatgtaattcttaattgtggataataataataaaagagaggttggatagatgaaaacagctacatttcatgttttactatcaaccttttatttttctcatgcttcaatacctagaagagtggtaaaatattgcagtttgagtgtctacttctttattttatatctaacattaggaagtgctaaagtgtggaaaaccagacaattctggaatgcagagggaggagagaaagctccagtaagctacatgcttcagacataggcactgaataataaagaaacagaaagaaatatagaaactgaattgctaaggcacttttattgccactcctaagaaactcaacattatcagcagtagtaatggccatcatttatacatgttgattttataaacttattttttttaaagttctaaattgctctctctccactccctaaagctggattaaaacctattgcttccaaatgctgaattaaggaaattctgtgccacaatttttgctacagaaaattagtgtgagcacagaacgaagagcaatcttatatgcataggagcctgctgttggagaaagctcaataagagacatcaggaggtttggcttcttttcagaggacttaggaagttttgatacctaaatgatataacataagactaacttttgaagtaagtgctaaaactatttatatatactagacaattttctcaagatttgtcctttttgtctcttagactctcactaaaactccgtcatcaagttgtaattcacacatgtagacaagccttcagcctctccaaacatttttaaaatctgtaaattcaaaacatttaaaaagaagacacatgatctcatctggactgctgcttgatcttgtttgatattcttcagcactctactttttataacgggtcaatagcagacgggcggtaactgatctccttatttcagagctgaaaacacaaggcactttgcgttgggtgcagttctattctgttatgctactcccgtttgtcagtaggtaaaaacttttcccattccccagaaggcagtacttctatgaatagttgctttagacaagcattcattgttcaaagggtttgattcctcactgagcaaaagctacagcattataaagatgccagttgaaatttttttaagcttgaattttttaaagctagaaaggaaccctcactgttggggaagtcatgaaagaaaaccccttttcacaagccctggaacaagtggattaagagagtaagagtaaaagtgcaaagactgggaacctggctttattccaaaaaaaaaaaaaaaaaagccagaaaaaagccacagttagaagtaattgaacactttggaaatccctttgaagacctaatgcagtagaattttttgaaatgaataaaagctaaatgcataataatttcaggtaaaaaaatacaaacgaatgtttgaagaaccaaataataaatttataaatgtttaacgcagcgggacctagcagtaccaacctttgataatgtatggtaagcattagcaatgttgttacttggaaaagacaaattaaaaacctggcaatcttacctcatgttgttttgtactttgtatacttggcttggtttatagtgatgatattatctgtactgattatacttgttcagtagaattttgtacacttgcaaatggaatttttagacacaagaaacaaggtacaaaaattgcctaactacaaaaatttctccctcttttatattgggactaatgatatgttaaacaatctgatgtatcactttagaaaaacagtaatggcagttgcatttgccaggaaaatgttacaatagattttagctctcttaatagaacataaaatattagtttttaatatcttgctatatgtggtgtttttaaataaaaaggcatagaaatcattgatatttgaagaatgttgatataaaataatctgtgtggaggataatgtaggttgtgaactaaaacggaaaaagccccaagagtgtatatcacactaaagaagagtgtattttctgctaaatggagtatagaatgttgtgcatttagtacataggacatatgcttgcaatcctcccctaaatatcccagtggtttctttgtgcaagttttctttagactcatttctccatcttgatctgtgctgactccacgtgaggtcagtcagagaataatgttagtccaaccacttgtgtgcacacctgcatacacacataccagaaagttaatgttgttttactttaaagcagtgattttactctggaccatgtgtatgtggcagaaggatgatagtgacttgtacataagcatctacagaggaggaataactgatatgtatggtggagtttgacagaatcctggatcaggaaaaataacaatcttaaggttggaggagatttttaaaatcatcttgaccagctatccatttcattacatcattcctcactctgaggctcatttctaactggtgttaccttggaagatgactaatttttagtgcttgttttgaatttagtttgtggaatgatttctcagcttgccccataatatctactctgtacagaaaaatgttatccctttttctttgcaaagtgtgaatataaagcaatgaggctgtttttcttttatgagtcatatccggtctctgaaaacagttcctaaattggagttgccaaaatatttcatgtcatggaagcatggttagaataggcttatcaaggtgaattttctgaatggtatttcagtacttatttttatagtctcatagctctataatcacatgttgaatgggattttaatactaaaaaagaggatacataaaaacacattgtgtctattatctgcatagaacaatcgcctactttctttattaatagatcttattttgtgaaagctacaccttacaaaattttatcttgttctcacctaattatctaaacacaaggaatgatcctgctctgaattaaacctttccatttagtgtcaaactgaacagatgcaaactcacttatggggagccatcctttggaaataaactctttaattcaaaaaatatctaatattagaatattccacagaatatgaacacctacttaaattcatttcgagtaccaaagaatatttcagtaataacatttacatactaaattaaacttaattatacagcataaaacatttataaccattaaatacagaacaattattttgaattgttaagtgcttccaacatcattgacataatacattttttgaaataatgatgtaaccatttaagtaaatttttatattttattcacattaaagtttatctgtaacattaagcataacttttttcttttctctctctctttttttttttgacatggagtctctctctgtcacccaggctggagcacagttgcgctatctgagctcactgcaacctctgcctcccaggctcaagcaattctcctgcctcagcctccccagtagctggggttacaggtgcccaccaccacacccagctaatttttgtatttttttgtagagacaggttttcaccatgttagccaggctgttctcaaactcctaacctcaagtgatctgcctgcctgggcctcccaaagtgctgggattacaggcgtgagccatggcacctggccagcatacttaacctttacagaggcatttttagctggacatttacagcatttaaaggatggaattcaattaataaaaaagactttttataacattgaaacagtgagtttaagagagtaaatctgttgccattttagttagttttgacaaagcaaatattataaatggccaaatacataagcctgttattacacattaaaatgtatcctatatttaatgagcattaaaattgaagtttactagtaattccatgggatattattatgaagttataagaataggagagaacttatagtttatttctgtctcattttaggatcttcctattatggcacatgaattttaatcgactttataatggtgtcattgaagcagagtctatgatattatcattctagtatttaactacatctccccttaagaatgattttatcacccattattctttaaacctctcaagatacttcttaggctctgttctctctggagttgtgtaaattctaataatcataacatatattattatcttagaagtcattaagtcttctcttctttatttgtttttagtattcctagtttctcatgggtatagttttacaaacgctttcattctttgtatcagttttcatttcatatttgcctttcccaaaaatgcatcaaactgcttccttttttattttcttgtttcccatggggttggtaaactccttcttaaaaccttacagtagacttatgcaaagtctcatggaatttttaatgctttttatatttttttctgattttattttgttaaactgatctccactatgattctaagatctttttcctcttagactcatgtagctgcccatctaagccttgtaagtcctgttcttcattcaagtggtgtctagctacttttcattgttagcattatttatactgtaattctttcctctctggtgctaattacccaatcacaataatcatcagcaaactcagaaagctcttaatctctcctgttttatgtagagggattctcccagagtacttctttcctgaggaggcttaagagaaaaactgaaccaatgccactactgacttacagaaaacagaagcagaattacatattattttgtcttatctgatccatactttggaagtcaattcgatctttaccattcccatggattggcttaattaacaatattttattttataactataccagggtttgtatagtatatgatactattcaaagaaatacctaatgcagatgacgggttgatgggtgcagcaaagcaccatggcacgtatatacctatgtagcaaacctgcatgttctgcatgtgtatctcagaacttaaactgtaataatgaaaaaaagaaaaaaatctgaaaatatatataaaatatttaaagctagaaagtaacaaatagaaatcaaaatagtaatataattattaaaactataggaaggaaaaagatataggaagtaaatgagtgaactaaatctttactctctatagctgagagtcaaccaatgatattcaagttgataaaccaagaaaatatcagtaaaatcatgttatttggagttatctatgtaaataattgaatgagaaaacaaacatttaacctctggaaaacttgtttaggaatgcaaaagaacagagaagggaactttgctttttgttttatgtcattctctaatattatgtttttttccccatgcatgtgtatctattgacatttttagataaatatgatagatagataaatagatatatagataataggaagggagggaggataggatggagagaggaaaacctacatacctagggtttaacactgcatagtgaaatttcagaagatttttttcttctttatacctttttgtatggcttggatattttacaatgagtaggtaatgtttttataaaaataagaggaaaataaactgtttcccctttgtaaaaaaagaaaatcttaaattaaaacaaagatcaacaacaaaacaacaacaaaacaacaaaaagatcaaaaacaacaaaaaagtgccttcagttaaatgatctcttttaatactggagagaaaaagagttaaagtagctggcctataatccattcacttactttctgaggaaacagaaatgggggtgttgctggaatgatgtggagcagggaatttggtgtaatttccttgtgaaaagataatgactaaacctcctcgtaaatgaactaatagtattagaagaaaaagataccttatctatgaaatactcttagcaggatgttcctggtttaaggttgcttataaaacatcaatccagaatctgtggatttatggaaaatgagaaatataaaagctggctgacaatttagggtgtattaggccattcttgccttgctataaacaccagaggctgggtaattcttaagaaaataggtttaattggctcacggttctgtatgttttacaggaagtatggtgccaacatctgctcagcttctggggaggcctcaggaagcttacaatcatggcagaaggcaaagggggaacaagcgcatcacatggcaaaagcaggaacaagggagagagtatggggggcacactttacaacaatcagatctcatgtgaactcagagtgaaagctcggttattaccaagggaatagctcaagccattcaggggcattcgggggcatgatccagacacctcccaccaggacccacctccaacactggggattacatttcaacatgagatttaggcacagacaaatatcctaactctatcatggggtatgaaatgtaaatatttaataacttatgcttcactgttttgtgagatagatgaaggcaatgaagcattgcagggtcatggatggataaagttactggatctagtgagtacataaagtgggaagcaaaaagttttatctttggagacgtaatttggtgaaggatcctgaagatgccacctataccctgcgcaccaggcagatgcaccaaagtatctcagccaatttcattgagattcagactggcaaggagcttatggtaaagtctttataattgaattaaaaacttaagtaattgtttctgttatttaaactcactggaaaagcttcaaaatgagacaatgatttgaatgaaccagtagtctcttggttacactattagggataatagatatccccatcgatctagaacttataatgtcacaattgctaccaaagttcacaggacagttagtgtaaggaaatccagaactactcacattggggtagaacaattacctcatttttgctagctcaggattaaccattagtggataagttgcttgttcacactggctttctgtgataaagaactcatcctgcacctattattaatgttattaccatggtattcaaccaatagtctcatatcttcatcagaaacttgttacctatgagtttagtactgagacccagcctgggtctccctgctgagaaggagaactgaatgaggggcatagagagtatagtaatggatcatgtggaaaatgatgtgttttctttgagcattcatcaccccatactggcaatgtacaaagagaatgtgactgacttgcaggtgcatagtaaagacagcaaagaaaaaaatgagggggctgatggcgtcattagagcaaggagctcttagagtcttctcattcccatgggagaacttggcacaaaacctctacttggaagtaacttttctttggctcccagcacacacacactgatctacattgaaaaaaatacaaacataaaagtagctcttatatagaaaagtgggtggatctttaatcagtttgatttgtcctctattcttggcttatttgtaagtagcttctattcaaaccattctttatctttatctttcaccttaatacacacacatgcatgcatgtgcacacacacgcaaacacacatacacacaccattcaattttctccccacctcagcctgcattagctattctagaactgaatgtcgaagaaatctgttgagaaagctgctgtgctagccaaagcaatgaagaattattttatgtgtatgaagaaatattgtagcatagaaaagtacatctcaaaatatgttcttagattgctacaacacaatactctaaacagtaaaaatgaaaattcccttgcttcactccacatttggggtagggaccaagaaatctatatttttagtacatgttccatgtgaattttaagaacaatgattagtagaaagaacactagattagatgtttctggaagagttactagtgtcacgtcgtaactcttcttcttcctgtctaggtagacttggccaaattataaaaatattctgagacttagtttccttattgtaagataaggcaattaaactgaattcccatggtggggcagtcaaggtcgaactaataaaattcactgtctagttgttcagtatgaatgttttgaaatgaactagccatacaaacaatgctctcttaaggatttgcctttcaatttttcctctccttgcatgctctgagaagcctcctgtagccacaggagcaagaacacttggaaaaaatatgtttattgagaagattgccaatggttacaaattcctggcaacttgctcagttctctaagtaattggccatgtggctactccatctaatatgatgggatgtgaccagtatgttaataagtacaatattgttctatctctttaagctccaagtctgtgaactttctcgggaatttatatgcaatttgaagaaatgtgaattaaaaaaaattgttagcatttgctttgtttttcataacatttcctcctttgggatatgtatgtagacaacagctacaaaactgctatagatctattactttgaatttttaattacaagctatatgcctaatatactttattagaaagtttggtcctctatgacataaataacaaaattgataggaaattctcagtgaaaatacttaacagttatgatctgcaagataacagaaaggaatagattgttgtcgcaagataatggttgctgactgtgagataagtgtcaaggcaaagtcattccaaagtctggccatttatcaaaaatgaacattgaagaaaagtaggatacatttatcaagcaactgttttagtacaaacattttatttttcttttcctagctaatctatgatttagatgctgtcatttcacttgccaggtatttgtgcagctaaatgactcaggtcaccactgcattgtttagagttacacaaccctgatttttgagtggttattgtgtttatcccaataactaccttatagtaaggaaatagttaagaaagttaattgattgggctctgttttagtttcttttttctttctatttagaattttgcttattctcatctgtttctttaaagtgatttagtatggttcacattaaaatgcacatttaatacatttgtatatcaatataatattgatataggatagaaatttaaataaaaatctagaactaaggggaatgataatcagaattattttattataagcattatgattctaacaagtatactgattgctctacacattgtcctctgtgacagatgtggcttatttaaccacaagtatgatattatcatttggtactgacagggctattgtcatccgaagccatttattcctgtcaccactcataaattactgtaaaaaagaggccactgttctcctaatttaacatgttcttccacattccaaccatgatggtgattttgtaatccatttgtcttcttaaagcaataggaccataggccaacttcctcaaatggaaagcaagcccccaataattagtaagctgatagagtacataaaaatctttgtataactcatacaaatatatgtactttatttccagaactacttgggaaaggcattacttgcggaatagacatagtaaagattttcctcgttctcctccctgaatattcagagaaactgtgtgtggtatacctcttccagaatcttgcctaattcctggatcttgcacactcaattttttcagttgtaggagaggctgaatttttaaaaatgaacatcatggaccctaaaatatggtttacctaaaagctttatattcttcattactttcttaattcattcatgtgttcagccaaaacttattgaatagctgccatgtgcagagtattgtatattgttaaggttaaaaaatatagatcaataaggcatgacctctccattgaggaattcctagcttaaaggatattgatatatatgtatacatatatatatatttatatatttattaggctatggatacataaactcattaggctatgaatatatatatatatgaatatatacatatatgttgtatacgcacatactcatgtttaggtaataataagtaatcattacaactgggaacatatgtttgaggtagggttgaggggcaagtgaagaatgtccagaaacttaatacaactttagaatataaaagaccttgtgtactttgtcaagaagtttgaattttatcctgtatgaaacagaaagattttaaacagaaaacagaagtgctttaaacataggaatgacggagtcacacctgatcgtatcagaggcatcatgaaagcataaaatattggaagtgggaagtctttgctacactttaaataagagttagtggttgcttgaaaaagcaaaggggagtagaggtgatgagaagggcattgagtatgcaagagaccagattgacaggtcttggtaaattatttagggatataagaggaaaaaatgactcaaggatgactctgatgcttttagcttttagcttggaagtatagaattgtggttggaagtatagaattgtggttgtgtttcttttttaaaaaagaaaaaaagaaccaacttcgtgtggagactataaagctagtttttctaccttttattttatcagtatgtccttgggcaatttcctcaaattttgtgcctaaatattcttacttataaaatatgtaatacgtatgtttacttcataggattgttgtgatgattaatgagttagtacatgtaaagctcttaaaatggtgtctggagtataataggtgttgaatgaatgtttcttttttattattactataatgtcactattatcatacatcatttttatcattataattatgcattatctgaattaatgaattccaacagaaaagatgattttgaagaaaatataatgaatccaactttggattaatcattttagtcatccagatagaagtgacaagtttgaaatgcagttctggaaagaggggacagctagtgtatatatttggaaatcaaccatgtacaggtcatatttgaggccatgaaatagcttggcttgcccaagaggaaagtataagaaaagaaaaaaagacagtaatattgagaaacaaaacaatcctcctagaaataacaatacttaaggaatgagtagaagatggtcctcgtagtagtctgaagatcagagatatactagaagaccatgcaaagacgggtgagttaaccaaaaatacccaatatgaagatgaagaaaactgcattgtcaaattctataataatagtatgactcagcctaaagaatgttagttggaattctacaaataattgttatgaatgaagcaattaatttgataattgagacatcattggtgacatagcaaactatttttatccttcctctatcgcattgattagcatctgaataaattgaaaaataaatgtgagacttaaagcagtttaagtagtgttaggtatgaacttcagatttcagtgggctaagctgttactagagaaacgaggaaagttatgctttggtaaaaatataattgtagataatatcttctcttaaaatgagttatatgccacctaaacttgctatccttcatgccattgtgaaaatagtgtttgtaaattttgtccatgggctgaggaaagaagctacccatatatggagaacctaagaaaatgaactggagaaaaaaagaagtaaaattgtgaagtcagataaactgtctggaaacaagcatgttaaaatccaaagactttttgtacgcagataataaccaattaaaaatataaagaaaataggattctatttacagaaacaaatgtaaaatatgatagttaagaatcattgaccgggcgcagtggcttacgcctgtcattccagcactttgggaggccgaggctggcggatcacgaggtcagaagttcaagactagcctggccaacatagtgaaaccccatctctactaaaaatacaaaaattagctgggcatggtggcacgtgcctgtaatcccagctactcgggaggcacaggcaggagcattgcttgaaccgggacgctggtggcggaggttgcagtgagccgagatcgcgccactgaactccagcctgggctacagagcatgactccatctcaaaaaaaaaaaagtaaagacaagaaaagaatcatcttaccaagaaatgaatgagatctacaatattttgctgggcttaatggaatgagtaatcagattgccaaatgagaagattggaaaaaatcttagtgacaagatttttaaaaatatagttaatttaattttaataaaaatctcaatagaatacctttaggaaatttaaaaatcaattttaaaattcagagaagtgaataatttttggtaagataatttcaaggaagattagtaagtagctaaacagaacaaactattatttttttatttttttattttttattttatttttttgagatggagtctcaaggctctgtcgcccaggctggagtgcagtggtgcgatcttggctcactgcaacatccacctcccaggttcaagcgattctccaacctcagcctccctagtagccgaactacaggcgcgcgccaccatgcccagctaatttttttgtatttttagtagagatggggtttcgccgtgttagccaggatggtctcaatatctggacctcgtaacttaccctcctcggcctctcaaagtgctgggattacaggcgtgagccaccgcacccagctaacagagcaaattattaaaacacagctaaaaaaacacacaaaataattaaaacagagatcaaagaaaaaaatataatgggcacaattcatgaataaattataaattattcattattttacaaacaatagtgaatgaattacagaatatttaacttccttaataataaaaatatgcaaacaaaaagcacttgagaaatattatcttaccttgttgatgagctgataagtgaggggacacctatcctagtatgtttgataaaaataattacatacttaaaatgtttacattctttgtcccagaattgatatttctgtgaagctatttgaacaacattgaaatacagaaaaaagacatttatttaaatacatttattaaagcattatttgtaatcacaaaatattgggaaccttataaatgtcccacaaaatgagaaaagttaactatggcaaaccatattatgtaatactatacaagccttaaaattgtaattatgcctgtaattccagcactttgggaggccaaggtggcaggatcgcttgagctcaggagtacgagaccagcctgggcaacacggggaaactccatctctacagaaaatacaaaaagttagctgggcatggtgtggcacacctgtagtcccagcaacttgggaggctgaagtgggaggattgcttgagcctggggagcagaggttacagtgagccgagattgtgccactgcactccagcctgagcgacagaggaaaaccccatctcaaaaaaaaattaattaattaatttaattaagttagaattacatggaaaatcattattataaaattttgaataaaaacttgaatgtgaaaatatgtatgcagtttaacttacaaaccagaatgtatatgtatatgtataatatatcctagattctctttcaatcatttttctcttgggatctgaattatgcattgctttgctaaggatgcagtaatctaaatagaaacattgaagcatatgtaagtaggggcttatcagatagatgttagtcttctcgcttaaatttagcatatatatttaatattactgcatgacaaaataaatatgagcactctcaaaatgagttgatgaaaagtgacattaaaacaatctcagtctatcaaggtagctaatgcatattggataaaaattctttgaaatctaattttgcattttatgaacaaattgaaagtaaagaaatttcagatgtagtagaggactttttagaattaggatggaattctgacagcagatgtgtctgcagttggaaattgactgcaggtcagaggtgctgttctgcagcagcagtcattaaaacagctcctgtaagtgaggaagtatgtggggctatctctgggagcaatttacctcagataggatttgttctagttgtctggtaagggatagtatgttctgggaggtagttattatggagaggataaagctgaaaaatatgatgcaaaaattaagaatttataacaatgtttacacatttgcccagatataataactattaattttctgcctctattattcattctgattaatgatcacagataaaataattctggaagtaaaaaaattggtttgcccatggcaaatcaattattttaaaaatgaagcttaaatgtcgttttagtgaagagtataaagagcaatgggctgcaaatctgaatacctggaagctatggcagtttaaccattactacatcaacaaaggagcaagactcacggcatttttaaaaattgtcactaagatctcttctatccctaaacatctatgaccaaaattttaacaacagccaatcaataattatataaatgataatagttaatatttaaaattaaaatttaagtttttttttcttttgtagagacagggttccactatgttacccaggctggtctcaaactcctgggctcaagcaatgctctcatctcagcttcccaaagtacttggattataggcgtgagccaccacacccagcccaataatagttaattttatttattgtgactattaaactagatgtggtgcaaaatgctctctatgaattattctttttaatacttgcaatgacttcatgaaatacattctataggctgggttcctaggcaatatagtaagaccttatctctatttaagaagaaaagaaaagaaataggttctattatagactccatttcttaatgagaaactaggggtttagagatgttaattaacttgctgaggtcatatagctgcaagtagcagagtcaagattcaaacccaattgactataaatcccagactcagaaccactacactaccctctctccatatctcttatcttatttcgtaccaccttatttctaagcagtcagagcataggaatgactgattataaatatggaaaatgtgcattaaaaacactaatgatgtaaaaaattgtatctttctcctattattctctgcatcactttgtagattgcatcacaaatatatctttgtcaaatacactgaaagagcatttttttcctctctatatactcacttgtcggaatctttaaaaacaaaacaagggagaggatcatgtttaaaattactattccataaaattactagtccataatgatgtccacaattcactaagcttggcacgtacctctatggggtatgcacatggttatttttataatgcctttgtgttccatgaatttttgccttattcagatagaaaaaggcaacttttttttctatctgaataatgaagttcactggttaattcattagtgaaagaagattttttaaagtttgtcattttgtgctatattttaactgaagtactttgatgttaataaaaattgcacaaacatagctatgtaaagtttatagttactctaagcatgagtaaatgtggctaatggatactttctagtatattgagcagatagtaattatgcaccatacataaagccttatttgacaggcatatgtcagagccagcatatgtagggcactggagttacagagaagaagcagacactcctcctacctttaggagtctttccatctagctggagagatacacatgaacaaacaatcagaaaacagaacaaatgctctgacttgcaatgtgagcacagggaacaccacgttatttctacctggatatagtgggaggatggaaatcagatgtctcacagagaagaagagatttgaactgtcattagaagaaacattggccaggtgtggtggctcatgcccgtaatctcagcactttggggggccaagacaggtggatcacaaggtcaggtgtttgagaccagcctggtcaatatggtgaaacctcatctctactaaaaatacaaaaattagccaggcgtggtgacacacccctgtagtcccagctactcgggaggctgaggcagaatagtcgcttgaacccaggaggctgaggttgcagtgagctgagattatgccactgcactccagcttgggagacagagtgagactccgtctcaaaaaaaaaaaaaaaaagcattgaaaagataaaggatggtattactgataaacatgcaacgcaagtaaaggcctaaaggccagtgagtgtgtagtattcaataggatataggataagcaggtctaaatatcaagagtgaggtcaggttgagaaatggattgaacattatcagtatcttgctattaattaaaatctttgcacagcatgagaagcagagctagaagaatagaggcttgaaagggcgatggggaacagaaacattaaaggcgcgagatgctaatgaggggcccaagatggtgctttaacaaattgtttccctccttataaattgttctatatccagtgctgcctctcattagctgtgtaaccttgtacaaccctcatcctgacacaacatctgtcatctgtggaatgaagaaagactcattcattcattcccaacttgaatccccacaggtagtaatggagttttcaaactaaactaaaattccatttagattttcagtattacaaaataacagtataactacggcttgtttactgatttaaaatcttttaaaatttagggcctgcaattaaaataataaaaaatatctactagtgagaaggttgcaaaccattagcccagatgattccagttctaaaaacctgttattttattatctcaccgaatattagcagtagttggtttttaacataaaatttgtactgcaccaaacaatatccacagtgtccccatccctgagaatgcagcctgcctggcagctgcacgtggcctattagcacagccgtttacataaaatttgatgatgtctgttttctttggtttgttaaaaaataaaacacagcatttacaagcagagctagaagaatagggtcttgcaatgactttcttcccagtcatttcttgggaagaaagcaaatggtataatgaaagtaatattgagtttggacatgaatttcctgaagaagccaagtttattaatatatagttaggagtcagatttttgtttaataataaggctcttggaagaaactaaaattagtcttctggcatgtcccttttcttctttgttaaagggataggatcataactgctctcacttcatacttcatggacatttcctaaagaatattttggagtctcattgttcttttgaacattaggttcaaaaataaggtcatttaaaagcaatatggtcacctatataactatagtttttagaagaaaaattacctttatctctaaaactttgctgttacaatcaaatattgtcactgtataaaatataggcaataaagtaattagatggttttagttttaatttaattattgttttttttaagagacagggtctcattctgtctcccaggctggagtgctgtggtatgaacacagctcacttcatcctggaactcctgggttcaagtgatctttctgcctcagcctcctgagtagcaaggactgcaagctcacgccaccatggccagcgaattttttttttttaattctttgtagagacagaggtctcactgtgttgcccaggctcattagaaactcctggcctcaagcaacccttccaccttggcctcccaaagcactgggattacaggcatgagccagcacactgggcctgattttagtttttaggcaatacacctatgtattatatagatgtgtgtgtgcgtgtgtgtgtaggtgtgtgtgtgtatttctgctttgtcagttactagcagaaagctactatagcacataaatcagaaatacaacaaaaagtttgttgtgttaggagccaagtttgaaactaataatagtgaagactttaaacagtaggagaaaaatcaaagtttcacattccctttgcatacatcagaaacaaagccttcgaccagggtttgataccaagaaaacttgagaaaccatggaatcctaaattttaattttgtaccatttcatatttagcatctgtaagaaaatgatggaaattttgtgcttcagaaatgaatctcactttcctgacaaatatatatgtatatatactagttcttcttcttgcaaaagcaggtttgacatatatacaaactcaagttacttatgtataactttttatttccttaacttttaataattcattcatttcattatattttgaaaggaaaattatacggacttggatcttcttataatatgaatgtataactgaatctaatggaaattagtacacattttaaacctttagatgtttaaaactgcctgtcttattcaggctagtgcttcatcagctgaaattagtatcagccgattccttaaattttatgtcaacttaagttcactgaccgatttgacaatgggtcaatgaaagaggcctgtaggattctaaagtttaatacatacataagtaaaagaatgacatttcttttcccctcgtacatgttttgcagtaggtattaacaaatatttatatccccaaatagcctgttgttagagtgggctttgttcttccacctcttaaaacataccagaaaggatagttacacaagctgcattgtccagactatgtcaccagcctattatttactataaataatgaaatgactgggcaagtggtctgaagtgagctgtgactcagggcagtcagtttctctgtgggtaacatatccatggaattcagaaatagcccagattttcaggccctttctttaggagctgatactacataaagaatgcttgcatgtttgcattttctacaccaaatggtactttataacttgatgtcaagatttaaggaaatataggaagactattttgggctgggatataaaggaggaaatattaatagtgattattaagatatctttacacaatgttaaggactgcaagttcacttgatagacagccttgctggtaatctgggaattacctgagggctttcaagtggctattgaattaatttatattgctttgtgaatataaattgcagccttccttcatccaaggagacaaatatccacatgctttttgagttttcacctaaaatatttaggcccattaaaataatttatttagcatttcgccatgtgagataaaactgacaaagccatctgatttctttcatttgaaaatggaactgctgagaacaacatatatacttggcattggcttcataagtataaagtaaataatttaaattattgtcaatgtattatactgtttgatatatagaaatataaatattaaactcctaatgaaattcaaagttaacataggcatgttgtaacactgttttatgtttgcagtgttatttcctctgggcagttgacatgtttctaagagtagttatttagttctcaaatataccacatgaactgctcggctgcaaatgttgttggccttgttttacaaactggaacacttttttgaagtttatatatcagataaacaaatagactgtaataaggaaactttgattattagttcactgatggctctcttcattattttatgaatatgcaaaatttttatcagagcaatatgctcaaaagcataaaaccattatataatacaaaaagtctagtaaaggaacacttccattccctccccagcccttgccttcccccagattgacacctcagagacacaatactcacaaatacacaaatgcagacatggttctggtataattttcttatgatgctgtgacttcattaatcaatgctattgttgtttttgactttgtgttatggtaatgaggttaggatcctcacagttgctcccccaccaacacacacacatacacatcccttttacccaatctcataaactaagaatattagaaactttagtcagtttatatattattaggattgtgtaggtactcatttttgatctaaattctctactattctttcttatacaacttcatgttgttcttggagttaataatttctttttctttattaatgtgcatggttttctacgtaactgttcctatttttccatagtttatccaaactatcaaaagccttttaatgtaatttttaaaaactcaaaattatctggtaatctatcggcttcttccccctcctctcaccttgtaaaatctcctgctggagctctccaccctttttccatctggattgattgttctttagtctcagcaagcagtgatcattctgtagattccctacagctctttgttggctggattattgttttctgagttctctttctgggttttctctcttgcttttttggagcatatcctacaataacgtctgaaagaacacatgaaaatacactttggagtctttatgtgatatcaactttaatctatcctcattctaacctcacactcaactaataatgtagtcaatgcttaatagccagtgttttgtggttaagaatattcctttggttgttcctttttatgtgatctgcctccacatcaactttatagtctccattatttgctctttatccctagcgttccgaaatttcaaggtgctgcacactgtaagagtttctttacaacgttactttcttaggtattcagtgagcacttgcagtcatgatcttagttattttgttcgtgtttattaaaataatttttaacttgtttcctctgtgttctatttccgggatgcatatgaatgagatgttggaccttcagaattgactctacttgttttaattttttcattacaactttctccctttcaattttttctacattccgggagatttcctcaactgtgtttttcaaattttctactggaattttaattttggttatatttccatgagctttttcttgctctctggctgctctggcttcatataattctgcttttgtttcagagatacatcttcttttatagctcagatattcaatacacctttcctcttatgaaccttcttacagtgtgcttgctttgatctctttctttcatattagtcttcttttttttttttttttttttttttttttttgagacggagcctcgctctgtcccacaggctggagtgcagtggcgcgatcttggctcactgcaagctccgcctcctggattcgcgccattctcctgcctcagcctcccgagtagctgggactacaggcacatgccactacgcccggctaattttctgtatttttagtagagacagggtttcaccgtgttagccaggatggtctctgtctcctgacctcgtgatgagcccgactcggcctcccaaagtgctgggattacaggcctgagccaccgcacccggcccatattagagtcttaaccaaatttttcatgatcgttaattaggcattcataattaaacaaaggtcaaacaaaactaattgaagctctttatgcattaggtgcaatttgctagatatatttcatttaccgtgattaatcagtgagttggtcttttttcattgggagacatcaatatttaggcttttgcttctccttgcccctgccgccaaccattctgtttctgaaaagaagactccttaatcttcttatttaaacatatattcctgtggctagagttttgggctcaaagagtcccaccatttcattttcagatccttgctgccttcctgtatttggctctgatctgcactttatttctttactcctcttcatacgtgcccatgttcagaggcaccatgttttaatttctcttgaaaatagatattcaagattttttccctgtacattttcaaaggtggggaagggagactaggaaacaccagatttatatgcattccttcgaccaaccttccattttcaacaactttaaatttccacaacactcagtgccttcaaatactgagctttttggacaccacagctatattgactagtttcttgtcactctccctctctctaggtatttaggtggcatctgaagtcagttactactctcgaagttaagtcagttactattctttcatttgctttctgattcctcctgaaattgttgaaatctttcaggtgctgatattcctctctgtttcccattccccttgagtatttaaagacatattattcctttacagtcattttggtaaggttgttgaaaggcaagaaaataaatgcatgagattaatatatcatttttaatggaatattgttttattagtcttctcgatattggcatcaccagtttgtcttctaatgtatgagacaaaatgtttctgaggacatttaggataataatcctattgttctacaatatgtttctagtgtaaaaaacatcacctccatcagaaaaagcaacataatcggaactgaaaactttcatattttttaatagttttgtgaaaaaaataagaactctactacaatgttagctatcaaagtccattggcaggacaatgatgtattttaatagcataggaaaaactacttgctaaatttaataaactctaagaaaataaaagtttactaggggaaaataaaaatggatatagctttaaaaaaatggaaaacaataatgattctcaccaaaaatattgtctttgcctttacaacaatgtatctgacaatattattgctttgtacttgaagaagtagaataaactcaggacattaaatatcaaaagaaatacaaattcatatatatttgtgactttgcactttttaagaagttatatttgaacaaatcatgatgaataaaatattcatcaaaccagtattcaacattttatttttgctagtttctatgatctatttctcagtagttctcacaaataaagcttaattgtgtttctaaaaaaaaagccagaaagaatgacataataattttttcaatggttatttgtaagaggatataaaagtgtagctataaataacttctttaataattgtctagaatctaggacttattttagtagactttacataagaggagtgaagagatcaataaaatgaaattttaaggtacatttttctatgccttaggcaatttagtgaaagaagaaagaactgaagtgaagcaaagacgaaaatgtctttgcctacttattaaatgtatgtatactctgcctatttcaaaactgaatttgaagtaaggtattacaaataaaacactatattgggaaaattatgataaaaataaggtatttaaatgttccaatgatgattaaaatgtaaataactcatttattcaaactttaatatttgaaaaatcatgtcttgaccatgtaccttcttccatttcaatccacagtccttcctaaagtggtcatatccagttccatggtttaaaatgaatgccatctgtatgccatttgtgcctaaatttgtatcatcagccttggtatatctccttatttcaaaatgcatatatctaactgtcaacttgagatgttcttgggtatgtctattatacatctcaaaaatggcaagtccagattcgaactcttatttcattggtaaacatatttcttatttgaagaattagcaacaacatgtaccctgtttattgaaagcacaatcttgagattaatttataatatcacattttcattcattatgcacatgcaacacatcataaaatcttaccagcaataacaccaaaaattgtttgaaatctgtctattctctccatctccattgctaaaatcctattcacactaggatttatttttactagttataatatctgtaaaatatttcatgaaagaaacataaaaagtatatgtaaagtttaaggaatatttttcaatgaatatttaacatcataaataaaacaatatcaataattttgaggctccttaaatgctaattaaattgccatccatttcttgcaatgattcacatgttcttcattttcttactttttaaaaagtattctttcacacacaaacacacacccttcttggataatacattttttagttttgattgtctttgaatttttcttaaatgaagtagtattgtatatatttttctgcaatttactcctttctctccacatcttgattgtagattcacctatgctgatacgtctatttgtagttcatttgtttttattgttctacattaggcaattgtcttactatcttacaatgtatatataaattctaatatgggtaaatatttgaatggcttccaagatgatggttgtggttttttgatgtttcattgttgtccttctggattaaaaacaatgctactacaaacattctggtaatagtctattgtaagtatgtgcgagaggttctacaaagtacatatttagagtagaagaacaaagttgagatttccacatgttcaaatgcaatagattatgccaaactattaagtgtttgtgctgatttacactcacattagcaatagttgaacattacactttctccattccctcaccaatactcattattgtctctgacttttaatttttgtccgtctgtggagtataaggaggcatctttttgttattataaatttttgttttcctgattgctaatgcagttgagcaatttttctttacttaatggctgtttatatttcctttcctctgaaatgtacatttggtcatttaaacataattttattgattgttttgtaattattgatctggagaaattctgtattctcaacactatagtcatttgtttaatccacttttataaataccttcttccagttcaggtcttgactttttactctttttatggcatattcagttaataaaatatttattttaagtaaatatatcaatattttccttttgagtttggattttttttattattctttagcagaaatttttcaacccttgaagtgcggtgatatttttctatattgtcctctaaagcttttaaaatttgcctttcacattgaaatatttaatacctcttaaaacaagctttgaaaatgacacatgtagagatttactttcactttttttttcaaacaatatccagatcccggcaccttaaatagtatactatttcctgatgatcagcagtataacaaatagagagattccatacatgagtgggtctattttaaaactatttctgccattggctatttgcctattccaaataccacattgtctgaattatataacaatagcttcataatatgtctttgatgttttgtatagcaaatttcttcatctgatacttgagtcttggctagtgttgtcccttatttagcagagagtcttggctagtgttgtccctttattcttctatatgcattttaaaaattagttttcaattttcttaaaatctttaaacaattacattgaacctatctactattttttggagaaattgcatcgttaatatattcagcctttccactcaaaaacatgttatacttctccaactctaacttactggggatttctttaatgtcttttagtaaattgttatcattttctcaagaaagagctttgtgcattgggtttacctacttatttgtttatttgtttctagatactttatgttcttggctacattaaccataagggatatattttctggttgcttcatttagaaatgagagttcttcaaaaatttttttagctggaaaatgacagtagctttttaactgggttctctgttttacttttgtctccctatagtccattctccttactatcacacactgaacattttatatttccttattctttgatgtgtttgtgacctatcctttctcaccagaattcagttttctaagagtagaaactttgtgttttcttatcaacactgaatcaccagtgtctaaaacaaagtgggcacttaaaaaacttgaatgaatgaatgaagaggtgagtcacatgtattaatatttctgaatgtgtaagtcaagataagggctctgtctttctcacaaatagatagattgtattggctaataattaatcagcataggccaaaattttggagttgcaaaacaaagactatttataagtagcagataatattaaaaggactgctgtccatttacttattctattctgttctctggatgcattgacttacaagttatcattgaacatagcatagaatgatattgttgatcacaggtcacctagttctacctttcatccaatgttctagcctctctattgcatctttcttgagtgccagctttcttgagtgttaagagttccacttaaaccccttcagcagctggcatcacaccctcttctcagatttccattccattgtcaagtacagttcgtcatactgaactaagctctgcttctcttgagttaccatttattgatctgagctttgactgccagatcctccacattaaaaagaaataaataaaaaagaaattcaccctcttttagcataataacccttcaaatattttaagtactgcgttcgatataatagcatttctcttatttaatctaagcatctgtttattttcatgcatgtattctttcatctattcttgatgactatttcttgagtgtcttccagactatttcttgagtgtcttccttgtgtcaagcatagaaaaggtgaacattaataatttgagaaaacattccttctcacatgtcattatatgataactccctgagttaggtcttaacctttcagaatgtacttgtcaattgagtagatatttagttgagatttggggcgtcttcttaattctagccataacaatgaactatttttaacaagaaggcgcttaggaactttgaaaattaaaacagagagagagatagactaaagtgacttatcacactaaaagtcagactgtctagaagatcatatctctttatttccttttaacaactaaaataattttaagttgattctccaaagaattccatcaaagagaagatcttaaatttcctggaaagaccatctggcactttttataagtgttatgttgttttttaagctacagaaagcgctctaagaagaaagcattttgggataaaaactaaaacaaaaaatttcagttttcaattttgtcccaaatcactcttgtcaattacaaatatatatctaaatatcccaggtttatctctaattctattaaagctagagcttaaatgacttaccttaaagttgactggtagtttttcagagtgtgaagttaattttctcacacacacgtttgtgactgactgtgcgaatactcagttattagcaaattagcaacacagtaaatgtgtctcatagaaattagactaaggggactagctgtatatgagccataaaacctataaatcttgtggacaagatcttgacatacaaattagaaatagaaattattttgaagccttggatactgatagttgcattacttagcacactatggtcttcagtcccaacttctcattactgattcccatttgtatgtcttcactctccacagacatttactctaatgtttgatatacatccctgtttatatatataacccttgcaaaatatactatgtttcgtgtgtgtctattatttaattattttatataaaggatattatgatgcaccaagtgtcataaagtattgttttgttcagtttcttgttttactgaataatttctatccacattgctaaatgtatgtatttcccagtttgactatttgaaaggacttatcaggctccacagaacatattcgcataaggcttttatttaaatttttttaaaaatacagtacagcaaaagaaaaagtgtataagcaaacattagagattccaaagatatgccatgtacagggcactatttctggcatagctcaaaggatgtcttagtccatttgggctgctacaacaaaatagcatactgtgtagcttataaacaataagaatgtatttcttatggttcaggaggctaagaatttctagatcaagatgccagcagagttgatgtctataatctataagggccctcttccctcatagatggcagcttctaactgcgtccttgcatggtgaaagagactagctagctctttgtggtctcttttataagggcactaatgatattcccaagcgtagagcactcacaatctaatcacctttccaagaccgcaccttctaataccattatcttgaagtttaggatttcaacatttttggaggacacaaacattcaaactatggcaaaatataagttccctgggaagcctttctttgtctttttggctaaataaacaagccaggtttgtcaaaccccagtggactagatgcagtcataaggaaaaaaacttaccctggaggttctcaacacatcataaattcaacttcccttatcttggccaagggtcaaatgcaaacactcaatgccctggaaatatagagtttttcagcatagttataaattaattctatctccacaatgtactctacttcattgcttctaattgctttatagtagttcatgccttgcatccctcaagtattatttagtcgttcctctggaaatggatacccagctttccaactgacacaaacaacattgttatgtttattggtaaatatcctcttgtgggcctatatgaaagtttctctgtgaaaattggatgtaaaattacttattcatcagtaggacaattgtataatttatcctccacactaaactaattttaagaatggaagagggtattattaataattatgccatgacaacatcatgaaccagagcctgggtaaaccaaggcatagagtactctgaatcacaggctgcacatattcacgttaacactaaccagacttttctccagaccgcataaatgtacctgtctacacactttattgccaacactttgtgttttcagatttccaattttgaaatttgacatgtgcagtgttccttccgtttgcatttatatccacatatttgctagctatgcagtctacctttcttttaatttctgattcaaagctttggtttatttttcctgcttatcaatttgttgtcagctttacacctagcagttattttccttcagtttgtcccctattcattaactttgtcttttaccagaaattcttaattttgatatagtgaatcaactcatttctcatctttaaattatactatatgtaatgcttaagaaatacttccccatcttaaagtcacaaagatattctcctgtattttccttcttaaagtcacaaagatattctcctatattttcttccattagctgtatgattttccctttcataatcaggaatatactggactttaattttgtaatcaatatgaaataggaacccaagtttatttttttcttcatatcaaaaatctggctttgaccacagagttcttgcctttgtgtgtaatccttaatcttaactaagaactcattatctaccatgcacctttgcattttctcagttagttaatattttccactgcttggcctctcttttttgtcctcacactaaaggaagatactgtctgaactaaggtattaaaaggcacaggatgatatcaggaccctgctgtcacagagaataggtttcctgcaattcaggagtgtgcagcctgccaattttcggttagcacctgtgcctcctatatagtcagtggaacacatgccatctcaacacatggggatcagcaaggagacaaacgttacgcatatgggtgaagaccagttcttagcttttgttcttcctgttgtacttgtttttaaaaatctagacctggtttttagataaagaaaatgacattcttacagagccaaaaaggaaattcaagagttgccttattttggattattggaatatttttgttatctcttttatctctattattggcttattacctaaagttatttgttggtgttgctttcagatttgtggtgtatatttttaacttatcatagtctacctccaagtaacatagcactctacatatgtcatgcaaacactgcaacagtaggtttatattttccccacaaatttttttttttttttttttttttgagacagactctcactctgttaccaggctggagtgcagtggcatgatctcagctcactgcaacctctgcctcctgggttcaagcaattatcctgcctcagcctcctgagtagctaggactacaggcgcgtgccacaatgcccagctaatttttgtagttttagtagagacggggtttcaccatgttggtcaggatggtctcgatctcttgacctcatgatccgcccacctcggcctcccaaagtgctggaattacatgcgtgagccaccacgtccggccttccccacaaatctttgtgctattatcatacattttacctctaaatatgttacgtagaagttgtaaaccccataatatagtttttagttttgctctaaacagtaaatgttctgatatagagaaaacactttttctgcttttaaccacatgtttaccatttccagtgcttatcactctttggcatagatccatgtttccacaaggatcatttcttctgaagggcttcctttaacatatctggtaatagaggcctgctaatgtttattagctcttgtatgtgtctgagaaagtctttatttttcaaagacattttcactggctatgcaattctgtttttcagtactttaatgatgtttccctgctgtcgtttggcttccattgtttctgatgagaaatatgctgtcattcttatctttatttcctatattacataatatgtcttcttctttggctgctttgagaaatatctaatgtaaatgacaagttgatggatgcagcaaaccaacaaggcacatgtatagctatgtaacaaacctccacgttgtgcacatgtaccctagaacttaaagtataataaaacataaaaaatataaatataaaataaaaaaataaaatgttcttatttcatttttaaagcaattttattatgatatgctgtggtatagtttcctaatgcttcttgtgcttggagtttactgaacttcttggttctttaaatttatagctttcatcaaatttgaacaattttaaacttttgtttatttaaacacttttgtcttctttctcccaatttttaggactcctattattacctgtatgtggtttgacatttccccatagctgtatgattctctgtttgtttgttttgtgtgtgtgtgtgtgtgtgtgtgtgtgtgtgtgtgtgcgtgcgcgcgcgtgctccatattggatagtttctattgtattatcatcagtttcactagtctgtctctgcagggtctaatatgtggttaatttcatttattgtatttcttaatttcataaattatagttttatatttagaattgaaaatgagtctttcaaaaatactcttcatgtcccagaccttttgctaccttcttgtagtctatatctaagtattgcttaactgcttatttttccaattccttgcatgactggctattttttaaatgaatgtcatatattgtgaattttaccttgatggatcctggttatttttgtgtatctctaaaattttttagctttgttattgggcacagctaagttacttataaacagctttgaccatttccttttgaggactgtttttggttttattaggtaaaatcagagcagccttaattcaaggattaattttgatcccattactcttctacatactcttcttgatgttccatgaattatgagaattgtttactctctttgatcggaatacaaactataactattcctggccatatgtgagatctgaagggttgctccttttcttcattttggtagttttgtttcatcatggttagttttcatacacacatttgctgattaatactcagctaaatagccaaggagattcttctgcatatatctagagacttactgtggaactatctggatactttcccctgagaattctaccctgctagcctccttgagttcctaacatttgtcttctcaactctggcaggcaatcaggctccacctggtgtccctttccctgagctgcagcctaaaatctccaacctgtcaggaatctggggaagttatagggcttgtttgcatctcctttctcaaagaacgtgtgctgccagacaaccaacctttaaaattgttgtttgatgtatttgctttcctacttcttcttgttattgtcacagctagaaggtagatctgatccatattcctgcattgtgaccaaaaagtacaacaataatctgagttactaacagtatacatcgatctcaccccagagtaagatggggagctgaactaagctttcagcatattgacaggaggcatgaacgcctttctatccaataacttgtattgaaatactgccctaccaacacaaagaagtaaccaggctatgagtggagaaaaaaggaatcataacagcgcttttaagctataaaagtgtggcctctaaatccacaatacccatatggcattgcattattagtgcaaggtaagtacagtttaaggtagaaataatttttatgtataatgacgaatatttggtaatcacagaaagaacaatgcactaggacaataaatcaaacataagcctgtataattctgaaaagaacctgaaaacatggttgtattataggaagacttgacaaaaatacaaagatatgaggagattttaacacacttctataaaattatgaaaaaccccccaaattaataagtttgaacaatacaagtaccaatggacatatagagtgcttacggcccataagaaagagttaacattattttcaagcatgtgtatatgaaagatacatacaattttttgggggatgaaccaaaaagatagtatcaataaatttcaaaaattagcatcttgtatatactttttctgaacacagtcaataaaaaagtacttttggaaataaatttgtaaagtcaattgtttatgaattaaggaagaaatcacagtagagatttaaaatattttttgtgagatattaatttttgaaaaaaattcttgatgtagttaaaacaatacttatagactacaatttatatattttaaaagtagatgaaagtgttcaattttataagcaacaggaaataattatatcaactcataattatatcaactcaaattttactatttatatagtaaaataaaactgaaatttaaaaactaaaataaaacatatatttgacatgatcatcaagacaaaaactgatgctaagtaaaagatacacatctctggtaagattgagcagaaaggaaaaggaaaagcaaaataaacaatattaagaatgaaaaagcgatgcaactatagtcataacagatcaactttaaatcacagagacagtatgaaatagacaattattaaaaaaaagttactacaataatagtcatacacaccccaacagacacactcattggtcatatttgtatgtaatttaaacacctaaagtaaaaagatgttaatttattataagatattgaattaaaataaatgcaggagtccataggattacacaaacaaagggaaagtatgagagaaagggaagcatttaaaatttgaatgccgctaacaaaagtagaagaaatttgtaatatctaatgcaatagtaattgattcaggcaagaatcatcaataaatgttaaagccattgagaatatattctggtggggaggaggctatttaccccatctcaaatatcaccctgcagattactttttaattgcaatgggaaatatgtacactgacatcttatagatcactttcttaagcaagtgatgtaacttcaccaactgaaggagagcctgacattatttgactctcatgcaaataaaaaaccaaatagttcaaagcgttatttacgtattcttcccataaatgtttaacctaaatttaaccatgagaaggttaaatactgaatttgaaatattttacaaaataaattagaatattattttctaaaaattcaatttttcagaaaccaaaggaaggaagaactcataaattcattgggacccttctgtattaaagaagactaatgagtcaataacaacgcatgaatcttcattatcatatcttggatcataaaagaaatcagttttatcttagacacaagtgaaaatattgcatatgagccccatattatgtgatatgcaattatcattgcctttatgggtatgacaatggtattgcagtcaggtagaggaatgccctttttctaagaacattttgaaatatatagctgagaaatgtcataatacttgcaatgtattttcagatagttaaggagagaaacggactgagtgagaaagagagagagtgagagcacaaatctgtggcaaaatgttaacaattgaaactagttgaagggtttgtaggtgatctttgcaatactgctgcaatctcctcatcaatttggaaattttccatttaaaaagttggtaaggaggggctttgccaagtccagatggtattacaagcaagttttattgaatctttaaggattttgagcgagaaaatattttcagaaataaagtttccatactaattttataatgtgagcataatcttgaaactctattagatcaggacagtttgagaaattcaaattttagtatactactatcaacatagatacaaaaatgatatttgataaaatattgtcaaattacaaccaatagtgcaattaaaaatagtatactatgacaaagtagggtgtatcccaaatggacaataatactttaacagtaaaaaattgattgatctatttatcagattaatagattagagaaaaaccttgtaatcaacgaaaatttccagaatattttgacaatatcgatctaaacagcaggtaaaatgaatgaattagagctgtataaatctttatgggaatatccctgaaacataatactgagtgcaccagtcaattggagaatgatacttatcctatgatacacttgtgtgaaattcaaaaataaagaaaaatctatattatgtattctgatagatatattcacaacaagtatattaaaaaagaatgttgagagtatattccctaaataaaatattataatggcttcctataactcctaagattaatatcagattctttactacagactctaggaatctgcatcatctgatttttgctgacatttctagaatggtcaaatattatacttcttctagctgtctgctccagcttcacctgacttcttcattcatacacttgaatgtgtcttgtcacaactcacaatcgagactttgcatatgtcatttcctctttctggagtattttagctctattcttcctcttaaataacttatctttcagctctcatcccatattcaggagatgcgaggtcaaattccgtcatttttctttataacatttcataccattctttcccttttctttttttggaaacagggtcttgctctgtctcccagactggaatgcagtggcacaatcacagctcaacctcctgggctaaaacaatcctcccacctcaacctcctgagtagttaggacttcaggtgcatgccaccatgcctggctaattaaaaaattttaaaaaaatcatagagacagagtcttgctatgtttcccaggctggtctcaaagtcctgggctcaagcaatcctcctgccttggcctcctaaagtattgaaattacaggcatgagccaccttacccagcctctattccttcctttgagagcactatttcagttgttatttctcattgacttatgaggttttgtgattagtatctatcctcccattaggcttgttctccccacataaaatcagatatggcatctattttgctaagcatcatacccctagtaccttgcacagttcttgacacattaaaggtgcctaccaaatatttactaaattggtgaatgaattggcaaagtcgtttctttcataggattctcttattttgatcatgatcctgttgaaatagctttctcttgataattccacactttcatttatcttttccctgtgactaatgcagtttgatgtggtttgggcatctctacctgagtgacaggatatagatactatgattgacagtatcctctagaagtatgggcattgaagcatttaagaccagaggaaagggatatgctaatcttggcaatatatatcaacatatgttaagaaattacattgaagagttaataaattaaattgtattaagaagtagaatatttaacagaaaatatccctgcaacaaaaattagaatttaaatatgtatttctccatgcccatattatttatgagcaaataatcatcacttttccaggcataaaaatggcctcaaagttattgcatgaatatggatccacatacacacacaaaatgaacttttaaaatattaccaagaaccttacacacaccatcttcatctgtgtaatagtccttcagaggaaggtatacattactgttacaatgtttacaaatgaataaattaagggacagaggagttgaaaaactttccccaggttatacagcagcagagtcaaaaataaaatccacatctgtatgactactgaaccctaatttggtgcattgcgagccaaggatatgaaagttttgctgaaattaatgaggctggaatgtatatgtcatgttttaatctaagtcagtgtttcttcaaatttgatgctgctctgtgaaagattccaaaatcaaacaagttttggatacgctgcatgtcatattcaatagtcctcccttatttgtggtttcagttacctgtggtcctcagtgatctgaaaagattacatgaaaaattccagaaataaacaactcacaggttttaaattgtgtgctgttctgagtagcatgatgaaatctcatgccatccctttgtctagtgtattcatgctgtgttggtcattttgtagctagctggcttggttatcagaccttgtcacagtatctcagtgcttatgttcaagtaacctttcttttacttaataatggccccaaagcacaaggatgctggctatttggatatggcaaagagaacacataaagcactttctttaatgaaaaagtgaaagttctgtactaaataaggaaatttaaaaaatcgtatgctgaggttgcaacctatgatgagaatgactctgctatccatgaaattgtgaagaaggaaaaagtaattcatgcagagcatatattgggttggtactatcagtggtttcaggaatccattggggtcttggaatgtatctctcatggataagtagaaactactgtactcaaaaagttctgacaatgttttttaataaagaaatagcttttttattgcttaacccagcacttctaaaaacatacctgaatagggaagctattcttggaaacttccaggctagagggaactacaaagtttttttcttcatttttttttctaatgcaaacctgtgtcctaggaagacaagtttttgttgttgtcattgttgttgttatttcaataggtttttggggaacaggtggtgtttggttacatgaataaattctttagcggtgatttctgagattttggtgcacccatctcctgagcagtgtacacggtacccaaagtgtagcacaattttgatagcactccatgtcctttctcacctcatgcttctgctcaggctcttcttttggcctggaacacctacgtcctcttcgtgatatgtggtaaattcttatttacacactagtttaaatgtcacatcatctgtgaagccatctattaacccttcaatcacatgcccatatatacagaataagcactaatgagctataatttcataaaataatgtgaatgatccctcacctttaaagagcatctcctatgtttaaacccagctctaaacattgcaaatctcatttcttaatacttacaataattacttattattatctaatttccctccagttcacatatcagttctcagattctctttccaggaaactcctctatggagatgattacattgcctgattgactcctttcctcaactttcgcttgaatacattcaactaggcttgccccaccattcaccatagcttttcctgtctaacataccaacagctgctacattaatgaattcagacaaagtatcagtcctcatttatttaaattatcagcagcatttgacaaagttagtccctttttagaagttcaaacccattcttcacttttctttcaggatgctgtcatttctggtttgctttgtacatcactggcaattttttttatggtttactttgccggttcttctcatctttacaatttctatatgttgtcctgccccagcctttggccagtaattccattggtgatttcatcaaatttcatgttgggcattatggctaagaggacagacctttgcaccaggctgtctggctttgaattacagctcaactagtttgttagatgtgtaaccatgggctagcgatctatctctacctttctatgtctacctctcttttacctcatcggtaaaaatagggattatagcagtacctcagtcatagaactgttgtcatattacatgatgtgatgtttgtaaagagcataatgtccagcaatatatgtttttgctgatattacctataatctaatgactcataaaacctatctagctgggatttctgctacaaacttgtgaatcatatatccaactacctatacaatgtctctacttggaagtctaatatatatctcaaatttattatatatagaatggaaagtcttatcatcactcttaaaccaggcaagcttagtaaatggcaactacatccagttgcagatgcaaaaagactcggatgcttccttgattcctttctctcagaccatcaatccatctgtcaaatctagattgttctgaattgaagttttccagaatcttgctacttctcacctcaatcattctaatccaaccccccaggatccctcatctcaataattgtactagtttactgcctttctgtggactatattcaacatagcagagtggttattttaaaatataagtcagctcatatctctcctctgcttctaggcttctgtgactttttacctcactgattaaaatctggagttcttacacaggtttataagaatttacctaatctgtcccatcactcccttaatctatctaatcttgtctacaagtttcacttctttaagtccactctcactgctctggtcccctcacaggtcctgtgggaatctagacatggttttctctcagcctccttgtgcttgccattcctctgtctagtgtgttagtgtctaaggcatgtgtgtgtgtgtgtgtgtgtgtcttattctttcagatctttacttaaaattcaccttcccaaggcctttgcctactctattgaaaattgcaactccactctaccccagcccctttttctccttacttttttcactggagctcaaaatgatctagcacaatatggtttttattcgtttcttgttttttcaactcttccttccagaacataagctcaatgaggggaggaatttttatttcatctgttcactgaatatctctggtgttagagcacccagcacatattaggcacttaagcaacagtcatagaatgaattccttcccataagggataaagaaagtgaagctcacagagacaaatcattttccacgactatccaaaatttacccaagggatccaaagtcaaagcacagaattagaagacacaggtcagcatctaggctacacatactgaaggaatatgtaattcatagaagataataatagaatagccaaatgcatactcttcttctcactagaagggatttccctgagaaaaggagcagttttagtcgtctttataaccctggcacctaatatagtgtgggaatcacagcagcagcggtgtgctggagccagctccccaagctcagaagagtgggttgtgtgctctcttccaatcctgctttttgcgacatatgtaggtagcttggaattggccttactgagaatatttacaccatggaaattagcaaacaagtcagggtttattaaatatgtacctgaaaagcactgcaaagaagatagttaaaaatatatatattgttgtatgagtgaatgaattcatgagtaaaatgtatgaggtagatattatagtctgaggcatcttttagcatacagatgctgtagataaggtgaaaacgtaaaaactgttgatcgataactttcaatgaacattacaaaaacaaacaataacaaataaaatctttgatataggacatagttcaatttcttactccatgagctctatttagatagagctctctgtcttccctatgggataataaaaaatacggctcaaatttcctcctaagtatagtaacccacataatgtatattcactttgtattttatcattatgtgtctgtgaatatacataatttttccactagacaagtccttcttaaatatttttaaatcatcatttattttaagaaagtcaccttcatataaaaaggcaaagatacaaaaaaatatgcatacaatttccagaggagcacagaccttcaaaataccgtgccacccttgctcccaccccaaccaacaggctccaggttaagaactctgcacttgaagtagaggattctagggtcaggctatttgtctaagttattgcctattcccagcatgtgtctgacatactgacacttaaaaaaagaaaacaaagaaaaaaaaataagacttgcagattgaataaatggatggaatgaatagttattttagttgcttcttagatcttctctttccctaaacacctccaattttgtcaactactttttataaagcatgattttcagaacctataacttctggatctccctcctctgacactcaatgttcttgattttggagaaagtcaaactactgccacattcccccaaactcaaatacagagttattgttgtagtttaagattcaagtaatgttccaggcaacatttctttaatcactcacgatccacagtgatctttcatttagctaaaactctagattcttttcacctaaaagactatagctagctccttctatcattctattgccctagtggacttttaaatttaactccatatttttaccattaaattccattgtcagtttcagccactgttctagcctgtgaagctctttggaaattacataacatagttgtcccagttagagtcattcccaaatgtattcaatatgtcttatgtgtcatcaaatagttcattaaaaattactttaagaataatagaagccagggacctcctgcagttttacagtgagccattaatcaatactgtttggtaggaaagatctatcacctacagattcaacaaactgcttaactattcaacccacatttattcatcctatccacaaggaaatcttaggaaatttcaaatgtgctgttgaaatccaggggatttagatgaggcatggtactgtctgttactgtaacttttccctgagatactgttgtatacacctcctttgtgctctcataaaattttgtgcatgtctctgtcatagtctttaccaaaatgtaccctaattttcttttgcatctgtcttctcaagtactgtgaagtccttgaagaattaatctgtgcatcctttatctctgtattatcagaaccttatgtgtaatagttaataaatatttgtcaaacagatgagtaaataataggagtctcatattttaccttaggatgtgaaaatctgtataaagttcacaattttctctggacttattctaggaagcaaatcactaaagatgattcacaacaatttgggagaacagaggagccatttcatttctttgtgcctcacttacaacattcttactattttaactttatgcacatatggaatgtgtgacttgattttataacagaaagacatttttatccttcttaagctaaaactgtacatgctattctgattatttctgttttcctccttttatgctaaaactgtacatgctattatgattatttctgttttcctcctttatatgtaaccttttgtatttctttttaaaaggtcagaaacagtatctcattaacacttcagaaaaatagttgccaatgtttccattcatagacctcatacttggagtgtctcctttaaaattatatgaaaatgataaaatgccacaaaatcacagtgttcctgaatatttatgcaatcttctatataaaatttacttcagactttctgctgcttgcctgatagtaataaatttattagtgtatttagaatataaaatgtcatcattttatgcctgccttttgatggccagacactcatcaatttttttccaaagccagatttctataaggagacactcatcgataaaatatccagtgttcctgcacagaggttgagtaattagtttctaccacagactgaaaaactcaatgtatggagaacaaaataaccttgtacattatgtgcaatctttattaattgaactttaagctagctcttgagatttttatgcagtctgcaacaaaaaggtcaatggaatggcaatgaatcctcttgtatttattagttcattttgcaaatgctaacattgggtgagaattgattcgatttgtttgtgatccagtaccaaaggggtattattcattaagatttacatggaaaataacatacccaagggaaatcagaaggaacatttgcaatagcaatggtcttactagaggttgaccatgattttcatttcacaccatttcttaaaattatcaaaaagtgtcctcaaaggaattattacttggaatttaacacacacacacaccaacacacacacacacacacacacacacacacacacacacacacacacatataatatttaaaatgctgttctaggctccaaagttacaacataaataaaacagtcaatgtcctcaaaaatctcacaatctaatgagaaaacagaaatttgagaattcattcattatagtacaaggtaaagtaaaggaaatactttgatgtcaatatgaaattatctatgggagtacagaggatttaaagatgaaactttataaagtgagaaagatttcacttttgtcttagatgattagaagaatttcacatgttttaatagagatattaatcaaaagccaaaatatggacaagaactctggagatagctaaagaaatttacaattttgggaaatggagaacagagctgtatgactgaggtatggtgaggagtgatgatcgataagccaagaagtgaagacgcaggttagaatttgaagaaccccctttcttttccatgttaagttgtcaggtagtgaggtactactgaacagtttgacctttggaatgggttgagttaaacctgagtgtctatgttttagaaagttatcatttgtgacaacacaccgttgtaaaatctgtagttttcctaatatatgtgaagatactcttggctgtgacaatgtattaaaaggaagggaaagatacattaaaagttagaattaggacttagtgtttgaatgaaaatggaagtttaggaggcatcaggattaaagacggcatcaagatttctacttagtacattgcatacatgtgtaatcaagtgtgaattattaaacaaaactagatacttcatatctcgttatgtaactactacttaatatttttaacctaagtgttcttaattctgcaaagaattctaaatttaaaatgcctaagtaatctttttcagttcatgcaaatatatatgtgtgggcatgtttgtgtgggtgtcttgttttactaaaatatcttcaagaataatgtttgagggaaaaaaatattaagaacataaaaatgggccaggtgcggtggctcatgcccataatcccagcactttgggaggccaaggtgggtggatcacctgaggtcaggagttcaagaccagcctggccaacatgatgaaaccccatctctactaaaaatacaaaaacttagccagatgtgttgtgggggctggggggtgcctgtaatcccagctactcaggaggctgaggcaggagaatcacctgaacctgggaggtgaaggctgcagtgagctgagatggcactactgcactccagcctgggcaaacaagagtgaaactgtcttaaaaaaaaaagaacataaaaatgtacattttaccctcatgttcaattatttcattaaggaggtcacaagtttcctccttgaggaggcggggaaatcttcattcttttacatactccaattctggagacaagatttcattatgttgcccaggctggagtgcagtggtgcaatcacagctcactgcaaccttgacctcttgggctccagctatcctcccatctcagcctcctcagtagctggaatgacaggtatgcaccaccacgcccagctattttttttttttttttactagagacaaggtcttgctatgctgcacaggctcatattctccctttctacctggtcaatgtcaccaggaatttatatcattttatcctatgattattagaatatgtttatatatgaagatatatttaatagttacttatttcatttgatatcacatatggatatgtatgcacgtgtgtgtaaaaatatgtgtgtaaagtctcaaaaaataatcagaggttatttcaataaaacacaataaaactttcctgatttgtcatgacaattgtatgcagatataaactttctaatatcacatctttatatggaagtaggtaacaatgttattgagagatcgttgtttatttcttaaaaattatgtgcgctaatgtaaatgttcatatgtagatgtaggtatttaaaagatggcatatattataaacatatttattacaatgacaagtaagaacaatatatcagaaattttacatataaatacagcactaaatttacctgagtttaaaaaaaaaagattattaggtcattgccattaatttaaaataataattatgttttgtttttactgagataattttctaattcttacttccttttccttttatttgagtccttggatctgtaattgccttgaatttttttggccaataaaattttcatgtcaggtgcttctctaagaggtgttataaattttttctctcaaagctgacccaaatgggccatgagttcacttttgagacacattttgctacaatacagtcatcttgtcttagagttatatgtgtaaacagccttaagcctataactttacttaaaatcacatatgattcattggatttgaagttcaagcttcttaattttctttttttaatcagctttttcaggttgaaaaatcttaagctccagatgtagttgagtttgatacccacatcaaatatcatgtagaaattgcgtgttttacccctgtataccaaatttgaaaagaaaacatcttcccattataccagagagaatagtttaaacttagtttcctctcatgcatcatgctacactggaatgtgtgacatgctgtgccaatagacattacatatggaaacaggagagaactttgaagagctgacagaaggctagagtgactaaagcagactgtacaaagccaagagagtggtaggcaggtccagacttccttggtcttgggctatgggaaaatagcagtcagaaatagactttcaggacttcagcatcagctaagtgaataaggaatggccaaatgcttgaatggggagtaggggaggagaccagtgcatatttcaacaatattatcatgtgacagcattatttaagatgattttaagttcagtcagggcaaatacacacacacaaacatatacgcgcgtgtgtgtatatgcatatgtatgtattttctagacactttccttcttcctctttgtcctaaatttccatctctcaggtgaacagaattcttattctgccttctttatattcaagaactcaacactacagcatcccaccgttacctcaactactctccttacccaaattaaagttaaatctatgaggagtgtgttaatttcctaaggctgccataataaataaccacaaactgggtggcttcaaacaacaaacatttattctttcacaattctggaggctagaagtccaaactgaaggtgtcgatagtgtcaggctttctccgatggctccaaaaagaatcatttcttgctccctctatcttctggtggttgctagcaagtttcttggtttgtggcagcttaactacaatctctgtttcttctttaatagacttctttctgtgagtctgtgtgtctccaaagctctctcatatcaccagtcattggatttagggcctaaccctgtccagtgtgattttcatctttttctttccatcttttctttattgacgtatatttgatggatgaaaattgtataaataagatatacagcatgcttttgatatacatatacatagtaaaataattactataataaagttaattggtggatccatcttaacttgattgcactggcaaatgatgtatttcccaataaggtcccattcacaggtaccaggggttaagacttcaacatgtcttttaggggtgccataattcaatgcacaacaggcggctaatctcagctaagtgtttagaaggacaaccacattatctgattaaatcaatttacataaaagtcagaataacactgcctttctaaagaagtttataacacaaatgtactgaataatgtacacactgttaagggtaagagcattcctagtaactgctttctatccagagctttcaactttccaccttcagtaaactcaaggccaaggttatatttctctacccatttgccagagtagatcagctacgaaatgaaaaggatacttaagcagaaaatttaggttgtgtatgttatttcctttttctttagtaatgttttcacttttagagtaaatattttaatattatttgaccaaattatatgaaaaatggcttgatactttattttaattttcccatgttaagatgaatttagatctgcatatttgccatacatggtccatatatgaaggatagatataaaatatatgaaggacattgatgaaaaatgttggcagtagaaaactacccaagtgtaaattattttttttgttttgtttgtttgtttgagacggagtctcgccctgtcgcccaggctggagtgcagtggtgtgatctcggctcaccgcaatctccgctttccaggttcatgccattctcctgcctcagcctcccgagtagctgggattacaggcgcctgccatcacgcccggcacattttttgtgttttcagtagagacggagtttcaccatcttgcccaggctgatcttgaattcctgacctcgtgatctacccgcctcagcctcccaaagtgctgggattacaggcatgagccaccgcgcctggccacacaagtgtaaattattttgtgtagttttctacacaaaatagaaggcaggtacagattttttggcaggtacagattttattttttccaaaatacattctaagtgtttattagaagaacaaataagaacaaagataaagagtcatctcgaggcttcgtatcaggcaatctgggttcttccgtgcttacttagagtcagatttattcatagtggtggaatgctcacgcctctaaggaataagttcagaagaatgtggtacttttatttaggctattaaaatcctgaaattcaagttttaaaatgattcaaaaggagataaatctgttttaaaacaaaatgcatttctttgtatgcagtgagtcagagtactgctttgtggtaaattgccttatgttctgaacaatataatgtatttcatttttaataactcagtttatttgtaaaccatgtattattaacacatagctcaaactattgtatttaatatagaaattgcagttaaaattggagtggactctttttctttcccagaacattcattgtttgaggagaatttaacaaggcattttgatttttaaaaatccctcatcagtgtaagcacacctttaaaataaaaatcatattattctaaattcaattgccatagcataaaatagctatttaatatttttgctaggactagtatgtcttctttgttgattacaaaatacatactatgctaaattttatcatttgattattgatttcccaagagccttttgtctaaatgaaaagctgtgtcttaagttttctaattaaaatttatagtgatagaattatttttcatgcagttaatttatactcaagaagagttttaacagttatttaaataatgataagtttctatagtttttttattcagttgttttgaacactctggagctgatctgttatttttcacagcatgattcccaaacatctgcaacaaattcctctaaaaattaggaacattgttagatatggaaattcaggatcttacccgtacctattatcagcatctctggaaatatacttcataaatatctgtttctaataagccattagatgattcttatgcctattaaattttaagaacccagtgttaaagagaacaaaccagtgtatcctaacttttctgacattagtgatctctagactttgtagtacattgggataacctgttcaatgaatgtcagcttcttgtagaagaagtcatccaggggtcaggaaagagagaaagcctgaactgcctcttactacccctagagttctggagttctgggagcctgactgaagatagcaggcagcatgtatggagctatgtcaatgagaatgagcccaagataaatcatcacaatccatcaacccttccttccttccttccttccttccttccttcatcttcttaatgcttcctctatttttgtcagaagaattgggagggagggttattgggagaagagcaacagcatatcaaaaccctgctttatcttatcttgacgtcatttaacactcttaaaaatatgtgcttttaaaaggaagtattcaatttttttcttgttattgccatagacaaaaaattaataaaggggtatgaagtgtcaccaactgtctgaccctggcctactttcccaatcccagttccaagaggcatgtacttcttggtgggtgtgactgttatacaatctttggctgactttacctcttatctcctatcttcagatccttcttcctgggaggattttaacatgtaagatgaggaattaaaacaccatctgaataagtatgaagtgcattgcagtctttggaagcaacatgcagaacttaacccaaaccttattctatccatcagaagctcccaggctactgactggtctgtctctcccaggcctgttacaagaaaagtcatggcttatcattcatcggtttaattattccaagacccccttagagctagagaaatgaagagatggagtgcttaaacttgattgatttgattgaaagacacaaagtatcaaaccatttttcagacatatgtctcagtgaaattaaaaaataaaaaaattcattttggtttaaaccagaatttggtaaactacagcactttatgtatgtctgccttcatattacaaaagcagagtgaagctgatgcaacataaattgtataatatatgcgtacctataggacatctttgaatttgcctcctggcctacaatgcctaaaatgtttaccatatggatctctagggcatagctttgctaacctctggtctaaatgaaaacattcatgatttattttctccagcatctgaaggcaaaatatgcatccaccgtattccataaaaaattattcatacatgtcttaaaacttgcatattttattttctaacccccagcataagacaaccataaatgtgtaggaacaacagccttagccccaacaaccacaacagcacctaacataatagggattccataaatgttttgattaaataagtctttaaaaatatatgtacattctgcattttatttacgatatactgtctctctattttagaacaaatttcattttctccaatctttgaataaaatagatgctttaggaagaatgtacaaggagatttctagtactgcttaaagctcaggagaagaagctcaagaatttgtcctgaagtgtgcaagttttaaaagaacaaagcagctttcccttccccgaaatacatgttgaaaatatttctatcgataaagtatatgtataaatttggacaaatctatgtcaaacatctattataaccattactaatctgtattccaagcataagtgtattttaagttcttaagacattgatgtttgtcaatggtcctaagtgttactaattctgtcgcctccagcaactcagcatgtagaacagactatatcattcaaggctagccttctacagaacatccaaccctgttcaactcacgaggatctacatcctattcactttaactatagagtcaagacagatcattcaagtgagctaagtgagagagaaggaataagaagaaagcacaacccttgaaagatttcagataatgaaaataaacaagagctgtagaagtaagtacaaatcatgcacgtctctcatggccactttttttttttttttgtcagatattgcaaagctatggacctggggagatgacctttaaatcatctagctcagaatttgttccacaataaaaagcttaagaaatgtccattatttccctcccttcttctcattcattctcacttggctttgttcttttcagtctaggattcttattcatatttctacctaatgtaaagagccaaccaacattttttggactgtgaggggaaaattttcttttccatgtacatttatgaaaaagaaattatttagagccaaatcatcccatgttgtatgcaagaggcagacacatcacaccaagaatgagactctggaatcaatctgtctgggttccagtccagctgtaccacttacaagctgaatgaccttggacaaattgcttaacctctctgtgcatcacatttctcatctctaaaactggaatagtactacttcataagctcgttgacaggactgaatgagaacatatatgtatagaacccttaaaattgtgcctgtatatagtgaacactcttttatcactacgtgttattattattagcgttaatgagaatcaagctctcagcatgacccaggggttctccagctcaccttcactgccttgtgcatgtcttccattacactctctaccactctgttccacagaggccaatatgatattagtcctaaaatgacattatccttgttatgcttatctttgctcatgctgaagtgccttgtcgttattcagtattcactttgcataacctattttccattaagcttccaccttgcaaaatagaatgccactacattgtacccgaagccagacacacacacaccgttcatttgtacacacacagttcatttgtacacacacagttcatttctctttttccccttccacttctagattgtgaagatttcaagggcagagagagagtgttaggaacccttatggccataacccctaccaactctctgttacatagaagacatttagaaaatgtatgttgaattaaaaaaagcttaaagaccagtcataaaattttgatttcataaaattctacttaaagtatagccacaggatttggctccatgacctcttttggcagcaatgctcacttattatcataaacagcacatagtacttgtcattatttttcaaaattcaatgtcctttaatgtcatctggtcagctgaattaagaagcttgcttctattaatggaattcagttttcaatatatctgaggtgtttctaacaacaccattcagagttctctgaagcttctttttaaataaataatgctccatttggtcatttctttgttcttttatatttatagattgtatagtgtttttcttaatcatttgcactaactttaattcaacagcaactgaaaacaattatataaaactagtgtgtctccatattcttcatctttggtgaatttttccccaaatttactaaagtatcttgcataaagatctatattttattatttaaactgacccttctctacaaaaaaattactcaacaatgattcaaaaatgatgactcaatgatgcatttgtgtttgtgaaatgaccatactaatgaattggatttaatactttattcaaatatatcaaatgtattgcaaatccaaacacttatttccaccaaacctaacaaccaccattgtctctcaattcaaggacagtaatagcctttgaactggctactgcttccaggcttgcccctctattgtcaacagaacagttgaagtgatcatttaaaattgtattcagatcatgctagttccaagccaaaaccttctcgtatccattgcactataaagtctaactctttacaatggcctttgaggcccatcaagacctgctgctgcctggctgtcttacccttcccctcacacccagagcactatgggtgtgaggggaactatagctacaggtatactggggtgtttttcttttttgtttgaacatgcagtgcttgttactgtcgtgggactttgcactttgtgtctactctccttgtaatgctagatcttgaatataaggctgagtcattgtcttcaactcatacatgacctccttcatgaaatcttccttttctggctgcttctcttcagtgggcctttccatcaggtgctggcaactctcagtcagttctttctcagctctgtctcttctaatggccttgctaattcagcctgcccttgatcttggtgctcagattcctcagagtctctactacttttctcttctgacatctggttaaagctgcgagcctcataaacgtttttggctgagccattttgctcatagaaggcccatttatccccctcaacttattatccatattgcatgatagctaaaggaaacttgggattgcaaagtgaatctgtcatgccacagggcctccttgactgctacttgggatccacatgttagcttgggattactcagcacagtaatgtcctccaaaacttgaaagcaaaaaccctgagcatcccctcaacttaattaagaatttcaaaagatacatcccctagaggattggcctcgacaagctgggaagaaaaaacaagagcggtggcagccacttttctctaccattgagctctttctctccacctattctggcatttctcaaaagaatgcctgaaggcttttttcctattgtgcattttttaagggtatcattctgttgccaaggctggagtgcagtggcatgatcatctataacctcaaactcctgggctcaagcaatcttcccacatcagcttcctgagtagctgggactacaggtatgcacaaatgtgcctatttatttatttatttatttattttttgtagaaacagggtctaattatgttagccaaactggtcttgaactcctgcccttaagaggtcctcctgcctgggcctcccaaagtactgggattacaggcatgagcgactgtgcttggcctgttctttctacatgatttgaaactcctttatacaaaattccatgcaaacccagtcatttatatttgttggcaaacattgagatgaaaagtaaaaacacttagtgaatcatcttaatgtttcatctttaagttactaagcatctgggtcttggcaaaacatccaaataataaactcacccatcaagcctggtcttgatatagaggaagaaactgaagggctttctaaagactgatgttaaactatacattaaaataatgctttaaataacagaaattgagtgtctctttcccacctctaccccacggcaggcagatgccttatcattgtaggcagaaagacatgtagaaaagcaaaagagaaaaacgtactatcattatttgactggcttggacacaaatatagggaatggagaaaatgattttctccctatacataatagaaaaagggagatagagataataaaaactaagttcaaataaatcattatcaacaaaagtaatcaaaagagtagctcaattacttaagtgtgatttattcagcatgctgagccattaaattataaccatgatttgggaaacacacacacacacacacacacacacacacacacacacacacacaaatctgagttaccaaatagataaaagaactcaggccacttcctggccctcattatttgctctcattctagaaataattctaaatccttgatttttctgacttctcagccaaggtctttttgaaagcaccgaatcagatgttggatggtaaaaacaaaaacaagaaaacactggtacaatgaattcaaatgttgtgacagcaaatagtaatatatatatgtatatatgacagatgtttgggagccaatatatatggatgtctatgcctcttctctagtttttatttagtgattattttgatcttttatgtgcagaattataaccaatacactgcatactttatatgcaatattgtgtttgtggttttactcatttaacaatcctaagacagctatacacagtttcaacaaagaaattcatttactctataaagcattttattattttttctaattgggacttctaatagtattgaaagtagatagttaagcagaatagtcttacaaacaacatccggaagccatgtgcaagtgaagattgtaataagaaagaggagacactttgaagtcaggtttggatttgacccacggctaccaatacctcccagcttcttaatatgtaccagttatctgagttatcagaaccttttaaaatgaggaaactaaaacctaccttacaataatgctttcataattatatgacaatcacacacacccacaaaaacactaaacaaatgttacaaaatatagacaaatttcttcatttacaatgtcttatgcatttgagaaaaagaacaattaggtgatatttgactttttaaagacaagacagatccatttcttcatacttgtattatctttaaatgtgtttgaatccaatatcaaaatataagggtgaaaaggtactaaattcagtggaaaattaaattatttttctttcaagcatagtccaaggctatgtagaaatccacaaagaaatcagattgaattttgttttaaaatctactgctttaggaaagaaaaaaaatgcaagtgtttgagggacataaaatcagaacataacgttgtttgtgtgtgtgcgcaagcgtgtgtgcatgggtgtatgtaatgagaacaagatgcttaacaagtattttcggttagttctaagtgtaagaagccccttgggtctgtcctatagcaaaaatgcatttttttgacgggataagcttatgtaacatacttctggtggcattatcttaaagagaaaactgaatctgccctttataatactttaagttattccatagtttaaagatatttgttcttgattgggcaaaacatccaaataatagcatttacctctgtttatattaatcatgtatgttggctgacacacatcaccattaaaatgacagatgtttaggcaaatcatcgaattatttgatctttatatttctaagcattcagatagttgtatacatccagatgatttagcaactttttttgtttgtttttttgtgacatgggcacaatttattctgtaaatgggaaactttaaatatatttgattatcgagatatcttatactcactttcttagagtttcaactataacctagaacattcattctttttaatgatatttcccttattatatattgtaaccatttaactattcaataacttttttttgagacagagtcttgctctgtcactgaggctggagtgcagtggtgtgatctcggatcattgcaacttccatttccgaggttcaagcgattctcctgcctcagcctccccagtagctggaattacaagtgcctgctaccacacccagctaatttttgtatttttagtagagacggggtttcaccatgttggccaagctggtcttgaactcctgacctcaagtgattcacccgtctcggcctcccaaagtgctgggagtacaggcatgagacattgcgcccgaccatcaataacatttttgtaaaatttaacagaaatcgggctgggtgcggtggctcacgcctgtaatcccagcactttgggaggccgaggcgggcggatcacgtcaggagatcaagaccatcctggctaacacggtgaaaccccacctctactaaaaatacaaaaaaaattagccgggcgtggtggcgggcgcctgtagtcccagctactcaggaggctgaggccggagaatgtcgtgaaccagggaggcggtgcttgcagtaagccgagatcatgccactgcactccagcctgggccacagagcgagactccatctcaaaaaaaaaaaaaaaaaatttaacagaaatcacaaatagatatcaacaaagaacacaataatacagaaagatttatgtttttagcatgcattatttcttttggatttcttttggttatctagctacatatagagtacatccagtgcatttaactaacatactactttatttctctttctcatcagatttagaatgtaataactcaaggatttgataatacagtgaagtagtataacaactgtctacgtgcttcccatgatatgttctctatattgtaagtatatatttactttctcaatctagcttgattgtgggagaaatgtgttcacttagaacttatagatgatttatattgtttcagaaaattttgaactaaaactcatccaagttacagaataatttcagaaggttagcttctatgaggagatcttttataaacttagttttaacattctatcaaagttaaagttaaaaataattttctgtcatggtaggtaggataatacatccatcatgtctaatcatattttaaaataaatcttacagttaataatcttaaaatttctatattcttttgtttcctagaaaaaagtaaaaaaaattagacatggaaaattttatgttctcaatataatttgcaatctaattttgaattttggtcaatttctttttatattagttatcttttgaaaatgggttttaatttggggtagataatgcctgtaccaataaatcattcttacatatgaatataagaatatatttactatatatattcatatatgtaatttatttaataagttaaataaaaaaagaaaagtagtctttgtacagatatgaacctcttactgttcatttcacatgattaaaaaataaggaaggaggtagaattctgggatactgtgctttgtttttgagttaagaaatactacaaagcaataagtgttactcatgtcaatgagaaagaaataaaacagcccaatcccttttccttggatgaaagcaagctatggactggagcccatcatgaatcagtagtgtccctacaatttaaggcatgtttagggtgtcaggagatgctgttccctaacaacacctaataccgtcagacctagaatcgcttctcaagccttactctctattctctccagcacttgttttgctgaagctcctgtctgagaatataaagctgtcagagaattgcaggtggtggtggataggttattaacatccctgtttcagaactctgaatgcattgtgacacaaaatatgatttaatacatattttatagcagtgctatctaataaaactataatgtgaactgcatatgttatttaaatttttctcatggccacattttttaaaaagtaaaaataagcaggtgaaatgagtcttaatgatatattttatttatttagccctgtacattccaaatatagttattttaacatatgactaatgtaaagaaaagaatgagacaatttgcattctttttttctcactaagtccttgaaatccagtgtgtacttatagcacatctcaattcagatactaaagttttgttgaatatacttgatctatacttagacttcataaaatttacagttggaaaagtagattcacaaacccaaattgtcctacaaacatttaaaagtgttccaataactaaatcaagtgtcagtttttaaatttaaattgataatcatctcatcaatgacactagctgtatttcaagtgctcagctgtctcatgtggctggtagtttccatactggaaactctgctccaggtgaccgctgatataatgcttcggttctgctacctaatgaattttgaaggccaacttcagaccacatcaaaggagcacatgactttaaaatttcaatgacagaaaaagtcaaaccctaaacttattacttaaaatggatttttacagaaccccatgtttatgagaaattatagagaagaaaatataccaaatgtgtacttctaagctatatacatgttggaatttgggggctttttgtttgcttccatgtacttgctttgttgtaactaaaggaatttgctgatcacagccctcctcattacaatgagtaaatcaatagaaaaaaaatctaacatttaaaaaaattgttccatcaaacacattcttaaaagaatgaaaatataggcatcagacttgtaaatcatgtatctgataaaagatttgtatccataatatataaaaaactcttaaaacgtaataagaaagtaaatctaattttcctggtaaaatatctgagctttaccaaagaagatgtatggatgactaataagaatatgagaagatgttcactaaggagatacaaatgaaagccacagtaagatgccagaacatacctgttaaaaatgaataaatgaattaaaaatctaacaatatcaaatattcataagcatgcagagccacagagactgtcattcattactttcattactgttggcaattcaaaatggtacagtcactttggaatgtacaagtttcctatgaagttaaatgcttacttaatatatgatccagtgatcccattcataagtatttacccaagtgaattgaaaaacatttttgacacaaaaaaacaatatgggaatatttacagaaaatttgatttcaattgccaaaatgtggaaataactaatatgttgtcttcagctggtaaatgaatgaacagactgtggtaaatctataaaggggaatactattcaaatatttttaaaaggaaagtattgatttatgcatatcatggatgaacgttttagtgcatcttgctaagtgaaagaagggaagcccaaatgactgcatatttaagatatataattcaatgtatcttaaattctgaaaaagccaaaacatagagatgggaagcagatcagtggttgcccaagttagagatatattgagttggagttataagagggctgactacaaaatcattgattacatgaggaaattttaaaggggggtggaactgtccgtggtgctgaaaaaattactgtgctcatcaaaacccatagaactgtacaacacaatgagtaaattctgcagcatgcacattaaaaaaagaaagaaagaaaacaaataggatgtattatcccaaaatggggtggaaacagtgacaagtgaacctaaccatcttacaaatgtaatatataaacttactgaaggtgatgcagtcaaaggatctagcctatattttggaaaacagtattttgaaaggacaaaatctgcaaagaatgaggctaactctaaaaagaactatacatagacattgtattttagttgatttttttcaaaggagtgcaggttagcaattatgaaagtactttgcatgtatattagggtggaatgcataagtaaataaattatagatattgggagataggtttcacattgctagagaaagaagttataatcagcaaggagagatggctaaaattaaccttgcgttgctagatgagagatgtagatattaatttgtgaatctatttttattttaaaatacatagatacagaaatgggtctacacacataacatttattagctctatctactgaaaagctctagaagcagtgataccacattagcaattagcatgcctcatgcccaaattttagtttcatgctcagtttagaggtttctgtatatacatcataatgcttcaatcttagagtgagcatggaatgtaggaaattcaaatagaattctttatttaaacacaagaaaagtctctgagaatttaagtgacttgcctaggatcagcagtttgtaaaggatggagcatctacatagaacaatcttacttcattcttaatcttaacttgtaccacatcaagaagtctacacgatatggaaatattcttatttgttaaattatttgttttcaatttccagaaataatcaagctctttctcttaatttaaataaaattctggcaaattttatatcattaaaaaactattattcacatttaaattcaaaatttttacctgaaatgtctgtttcctgttgagcttcaaagtcccatctagaggccaggcatggtggctcactcctgtaatcccatcacattgggaggctcaggcaagcaaatcacttgaggtcaagagttcatgaccagcctggccaacacaatgaaaacccatctctactgaaaatacaaaaatcagctggtgtggtggtgcacacctgtagtcccagctactgggaaggctgaggcaggagaatcgcttgagcatgggagttggaggttgcagtgagccaagattgcaccactgcagtccagcctgggcaagagagtaagagtctgtctcaaaaaaaaaaaaaaaaaaagtcctactggactgggaaatcattattgctaatttatttctgttatattggacacacatatgctttcactttaaggaaatcctatgcaagaaccaaaaaaaaaagaactacaaaatatagtcatgcactgcataacattgcaggcaatgattgaccacatgtacatcagtggtcccattagattataatagagctaaacaattcttatctcctaataactttgtagccatcagaacttagtagcacacaactcacatgtttgtgatgatgctggtgtaaacaaacttattgcacttccagttgtataaaagtgtagtacatactgtacaattacataaggtgcataacaatgataataaacaattatgttatagtttatgtatttactatattttatcattatttagagtgtacttctactaatttaaaaaacttaattattaaacagcctcagacaggtctttcaggaggtattccagaagaagggattgttatcataggagatgacaggtccatgcacgttattgcccctgaagacctcccagtgagacaagatatggaggtagaagacagtgatattgatgatcttcaccctgtgtagacctaggctaaggtgtgggtttgtatcttagtttttacaaatttaaaaggtaaaataaaaaacaaaaatatttaaaaataggaaaaaagcttatagaataaggattaaagaaagaaattattttgtacagctatacaatgtgtttgtgttttaagctgtgttattatgaaaaaactcaaagacttaaaaaatattttttaagtctataaagtaaaaaagttacaataagctaatattaaattactgaagacagaaaaacctttttataggtttaatatagcatttgtacagtgtttataaagtctaccgtagtgtacagtaatgtcctaggctttcacatccactcaccactcactcactgactcacccagtgcaacttccagtcctgcaagctccattcatggtaagtgctttatacaggtgtacgattttttatcttgtatacagtatttttactgtaccttttctatgtttagatatacaaataccattgtgttaaaatttcctaaagcattcagtatagtaacatgctataagtttgtagcctagaaacaatagcctaagtgtgtagcaggcaataccatctaggtttgtgtaagtccactctctgatgtttgcacaacaatgaaatcacctaacatcacatttctcagaacatatctccatctttaagtgacacatgactgtatataaagtgttttttacttcaaaataattatgtctcacaaaagcattcatcatgtattttcttaaataacaatgttccctgctgcaattttgttagatttatacatagtatctcagaggaaataaagtcattttataaagccaagctaacctgccatcctttcctttaataccttcatcactatgcccatctgctgcaatttttataagtaagtgtgatctcataatccacacagttttaatatgaagaaaatttatagcatactcttactaatcaataaatcaagctttctccctattgctttccaatcacaatgatgacttctaagggagcttattttattaggtaatttgaaaatactttactaggctatttgaggaacttcttgaatatgagggggttattaacaataaaagaagatacacccaatagagaaacaatttctataccttcaaataatagtatagtaggtataggaggcaaatgcaaaatcagtgtgatccattatatatttaaccctcatttgttatctgttacaatacataaatatgttttgaaaagaatattatcaaatctatttgaattttctaccatatttaatgttcagaattctcattattttatttttttctgatttaaagtccttctaccatcgtagaagtctattttatttgttttgtttgcttgttttgtttttgtttaaaagactattcagaagagttcctttttataagacccactttttcttttttctttctttttttttttttttttttgagatggagtctctctgtgttgcccagactggagtgcagtggtgcgatctcggcccaatgcaaactccgcctcctgggttcacgccattctcctgcctcagcacccccagtagctgggactacaggcgtccgccaccacgcccagctaatttttttttaattttttttttaattttagtagagacggggtttcaccatgttagctaggatggtctcgatctcctgacctcgtgatccgcccgcctcggcctcccaaagtgatgggattacaggcgtgaaccaccgtgcctgggcaagaccacctttttttttttttttttttttttttttttctgtactaagactttctactattctgcctggtgaataacaggtacttaaaatatttgcagttttgacttctaaacaaaataacattaagcacattttttttttcagttaattttaggagtaattggggtagcctggaagaaatcacttatgggagatgctccagagctccactgtttgtgatgaccattcaatatgcaacataaaatgagtcttggtggtgtctcaaatctttctcctccacaaggagaagtagatggagtatagatggatgcacgggtggatagagtaggacaaatagatggaaaaatagttggatttttcttacacataccgtccaatatcttccataccatggacagtattttatccttacttgtttctaggacctaaggaacatagttggtaatacagaatcctgtggaactccaataatttcagagaaaattgaggatacagtatttttaccctctgcacctggaagaacttactgctttattttggtaactaaaaaattaacattaatttacttttgccttgatagtagggtcaaaatcaatgtctatggaagactacctataatagtgactactttaaattcttttctcttcttatcccttataatgatatatccttactttcaacatgcagatataagcagttctaagtctatgcttcaaattacatgctctggggaaagaattagtaaacaaagatgtcaagaaaatctgaatttattattttcaaattgttcttaagttttatttttagagactatcatttccttatagctactctacaaagagacaagaaaacacttcacagtgaactagcccccctaggaaaaacactgtggagtgaatatttatgttatcaagtagttagaataagtagaggcagataaaaataccctaaacttttatttaaaaccatgcatattaaccccgtgggctttcttgctatccttataaagtcaattatcgctctataggtttttgatttttaatttcagtttattttaaactatattgtatctcttcatattaaaaaattaatcttctcttttactttgtatgttccaccattcctttttaattcatgtcacttttgtactctaaacacagtaggatgctaatttaaaatttgtgaccttaaattcatgtcatttaaatcccccaaatgaatataatgattcatccacttttgtgtttgaaatataatctgccttaaaataaatctctatgttgctaaagggtaaaacctagtatatgcctcttgattttatgagagcacaagatcaaatcttcattatatttagagcttacactgaagatggaaagctgctttatatgataaagtgagagaaacttatcagtaagtcttcaagcaggagaagatgagatgcgctgggtagccaagagaattttagtaaagtgatggtctgtgttcaatattagcttgtgcactttgctatgatataacagctctccatctaaaacttctgctaacattgcatgagccttatatgaaattttaggggaaattaaagagactcagtttcacatccaggtcaaagcaatcagagaaaaaggaacatttatggtagttaacacatgaatagaatttggaaatctctagtgcagaagtccaggaccctaagtaatcaggagtgtctagaacccctttaattctcagaaatcttatggggcattggaatttccaatacaatattggatgggtggctggaactctcaaatgcagaaactacactttaggttacttttcttattacacaaacattaaagcaatatttaaaaggtcaatccagtcagaatccaaccaccacagaaattcacagaattatttgcctatgtttccttttatttctaatccgtatgtacacataattttacatggtatagttataattttgttttgattttgtaatcagtgtcaaatcataaacattttaacatgttcattttttgtaggtgcccttataatgactatttgcctaacccttttcttatcttgggtattggattgtacttgagttttcatatatatataaataacacttcaatttaaatatttgtcaaatattttgctttcatcaaataaaaaatggaaataaaaacaagcttatggccgggtacggtggctcacgcctgtaattccagcactttgggaggccgaggccggtggatcacgaggtcaggagatcgagaccatcctgcctaacacggtgaaaccccgtctctactaaaaatacaaaaaaatagctgggcgtggctagctgggcatggtggcgggcgcctgtagtcccagccactcgggaggctgaggcagaagaatggcgtgaacccagaagggggagcttgcagtgagccgagatcgcgccaatccgctccagcctaggagacagccgcgagactcagtctcaaaaaaaaaaaaaaaaaaaaaaaaaaaaaaaaaaaaaagcttatattgtagagctattgtgaggattaaatgcaaaaaaatgcataacaaagattatgcatagtgtcaatttggaccaatttctagaatctaattattgaccaaaggatatgactatatattctttctgaggctgttgaacgaattactaacttccagagtgttcagctggcaaaataataaaaactggctgtcaatatcttaaacaaaaaaacccaatgctgaagtgatcacttattttaaaaagggcaaaatataattgtcaggcacagtctctcagagcagggaagactgctaatattatagagggctttgaggaagagtgtaattcagttactggttgacttccagaggcgtaagtgtattgacgtcatttgtagaactatggttcttcaggtgagaattcctttgattaatcaacttccagaagtgtgttctttgaagtgagtctttttctgattaactgactttaggaagttagggttataactatttggttgacttgcaaatgcatgttcactgagaggcagagccattaattcttcaactttgtgtaaaatcagttctgatagtttctggaactgtcattgattaagcagttttaaaaccacttctggtgactacttgctaccatagctacagaaaaatatcaatcatttcctaggagcgtggggacattttattctccagctatagttgaaataacttatgagaaaaaaatcacagaggaaatgatggaaaatgccaagggcttttcatgaggaagagggggaaataactagaaacttgtttttaatgcaatcttctgcttgagaaatactgtgtcagtatccaacagtgaaacagatgtggaaaggtagtacccattgaaaagaggagtagaactaggatggaaaggtaagcacattttatgtaagttagttaaattgctaaagaaaacttatttcctattttattgtcaagaaattatataattacacattttgtgggatcacaaatgtctgcttattaaacattttagttcataaggctgcttttctttttttcttttttcttttttttttttttttgagacagagtttggctctgtcgcccaggctggagtgcagtggcacaatctcagctcactgcaagctccgcctcccgggttcacaccattctcctgcctcagtctcctgagtagctggaactaaaggcgcctgccaccacgaccggctaatttttctatttttagtagagacagggtttcaccaagttagccaggatggtctcgatcctctgaccttgtgatcagcccacctcggcctcccaaagtgctgggattacaggcgtgagccactgtgcctgaccaaggctgcttttctctaaatccatgcttacatagattagtgattatctttaatttttatttttgtttttttgtttcatttttttgcattttctctctctttaatataaattgtgttcttacttgcttatattccattctagaatggcttctagtctcctcccagaagtctgaccctgccagttctaaatttttttctgactctcatcctcctgaattttgctctcctccatagtcaacaattttgtacgcctccttttctttttttaaatgacattcagtttctgaaatattggcttctctcattatacttccacccccattcttccaccatgcaaaaaataactcttcctctctcttcttttggctaaactttccaaaaagatgtataattttttatttttgaaaaatgtgttagtgacattcgtcctggttaacttattccaaataatgtctctatcttgcattctgtcttactgttctacaacctattccagcaccatcaacagatgactcatttcagcctgacctcatgaaaagagcttgcattctaggttcagacagaataacaagagactcctatttttaccatttgctggctgatgtaatcttacatgagtaatttaagctataggggtctcacctcctttatctgtaaaataggaattctagtacatgggatggtaatgatgatgtaaagaaatcatgtatagaaaacatataaatagcatactctttctacccaggaggagctacataattgttaaatcttgtgtttatttcttattatctcttactatgttgactgttcttccaaattgcataaccaaaagatccatgaggcctaatgtcaaaagctcaatgtctttgtcgtcttatgaggcaagtcagtttatcttatcttgttcatttagggataagaataattccttctctaccttaattacattgtggcaatggcaaattgaaatgtgatattgattacagaagtacttaatcattataataacaataactgttagcattttaaaatctggtattgtctatgtgtaagtcactgtgtcggcacttaataaatgtaagctcagtctttacaattatctaacagggattaatattatttctaatgtttatgtgaggaaactacagctcggcaagatgaagtcgttgggtcaaggatacataggtaggagggaacagggctagaattgaagtcttctgaacctccacctgcaccctcagagccccatgcaacagtgaataatcaaatgcattcagtttcctttcattaaaaatgctacttggccactgcttgaaccatgatccattactacccagctcattttcaaaggatcttgttaactctcctaaaagcattttagagctagatcctgccttcgtttattttcattatagctgctttcttttctatgtcattaattcatgcttctcttttgtaattttactgtcaggttctccaccaagtgctctagggaattaaaaacacatgcacacaatatttaagcttttcagcgagtgaaggttgacctcaattcctgtttttcctccctctttgtgctgtcttcagggttgatatgcctccctcctcttctacccccaatagtgcttaagcctctctcatgtcggcgcaggttaaaactcgtccacagcctctgtatgtttcattagtctgttttacattgctgtaaaggactacctgagatagggtaattgatgaagaaaagaaatttatggtacggcaggctgtacaagaaccatggcaccagtatctgctcagcttctggtgaggtctcaggaagcttttattcatggaggaaggcaaggagagccagtgtgtcacatggcaaaacagggagcaagcaagaagaaagggtgctgggctgttttaaacaaccagctctagagcaagaagtcacacattactgccaggaaggcaccaaacagttcatgagagatctgcccccataaccaaaacacctcccttcaggccccgcctccaacaagatgtcattctttgcttccctaaagttcttaggtcttcaaagcactcactcaacaaagcagaaaactatttataccatagttttgctattctgtagatccaggacatattgcaaattatcaattacatgcaatgagttgttagacttcagtgcattttaaggcaaaggattctctgcctctgcgtcagactaagagattgagttggtctttatatacacaggtttgtaaattcaaactacactttaattcatgttatttactattataaacatacttatttcacctaaatactttcaatggaggtagaggcaatatcatttctgtattctttaacttccctgtggagattatagcatggccaggcagtgaatgagaaatataaagtgatgattaaaatggaaatgagccatctgtaataatattaaataattgagcagaaaatttcaatctaagtgtcaaggcttatcaaccaaaataattcatggaaaactattattaagaatggtttcaggttattatttgtctgaggattaataatttcttttgttaaaaactactgtttttttaaacatttattggaggtccaggggtacacgtgcaggtttgttagataggtaaattgcatgtctcaggggtttgatggacagattatttctttacctaagtaataagcagagtatccaataggtagtttttcaatcctcaccctcctcctatcttccaccctcaagtaggccccagtggctggcttttgttcccttctttgtgtacatgtgtactcagtgtttagctcccacttataagtaagaatacatgatacttagtttcttgtttttgcattagtttcttaggacaatagctttcaattccatccatgttgctgcgaagtatgtaatctcattcttttttatggctgcatagtattccatgttgcatatgtaccacattttctttatccattctatcattgatgagcttttaggtttattccgtgtctttggtattgtgaatagtgctgcagtgaacatacctgcgcatgtgtctttatggtagaattatttatctttgtttagttatatatccagtaatgggattgctgggcttaatggtaattttaagttctttgagaaatccccaaactgctttcaataatggctgaactaatttacatttccatcagcagtgtataagtgttctttctcctcaaccttgccagcatctgttattttttgactttttaatagtagccattctgattggtatgagatggtatctcatggtggttttaatttgcatttctctaatgtgatgttgagcattttttcatatgcttattggccatgtgtatgtcttcttttgaaaagtctatgttcatgtcctttgcccacttttaaaggggttgtttattttttgcctgttaatttgtttaagttcttatagattctggatattagacctttatcagataaatactttttaaatatttttctcctattctatagattttatgtttactctgttgatagtttcttttgctgtgtagaagctctttattttaattagattccacttgtcaatttttgaaactactcttttaaaaaagaaaattgtaaagagctttttaagccaaatttaacaagcaataaacttttaaaattaacagattcaactacctaattatcaaaacttcagtataacaaaaaaagatactataaacaaaattaattttgtctttaaatttaaaaatctgggagaaaatgttccccccaaaattagacaaaggcttaattttgtaatatgtaaagagtgttcacaaattaattatccaaaatgccataataaaagaggcaaataaagtatgaatagtcatttcacaaaggaaataaaaattatcccaataaagacaataatgtccaaccttaccaattaattacctgacaaatgcaattttgtggtctaatgggacactttttcatttgtactgtattaaatagttcataacattcatcgttattaagtgttgtggaaaatttgattccaggtgaagcaagttggacccttttggataacatactggtatgttcataaatttggtaatacttacaaaaattttaaaaacatatattgtttgacccagtaattctacctgtggtaatttattcatcaaaaacacttgtatgcaccactaagaagccttcaccaaaatgtttattgcaaatttagaatgacaaagtattaaaaataatcaaaatgtccatcaataggagaaaagtaaaatatataataatatattcttaccaatcagtgctaagcaaccattgaaaataacttggtgaatatataaagacagattaaaatatcaaactaaagggccaggcacagtggctcacacctgtaataccagcactttgaaaggctgagtaggaaggatctcttgagcccaggagttcaagatcagcctgcgcaacatggtgaaacatctccacaaaaaaatacaaatagccaccgggtgtggtggctcatgcctgtaattccagcactttgggaggccgaggcgggcggatcacaaggtcaggagatcgagaccatcttggctaacacggtgaaaccctgtctctactaaaaatacaaaaaaaaaaaaaaatagctgggcgtggtggcgggcgcctgtagtcccagctactggggaggctgaggcaggagaatggcatgaacctgggaggcggagcttgcagtgagccgagatcacgccactgcactccagcctgggcgagagaatgagactctgtctcaaaaaaaaaaaaaaaaaaaaaaaaaaaacaaacaaccagccatggtggcatgtgcctgtggtcccagctatccgggaggcagaggtgggagaaggtcacctaagcccagaaagttcgaggcttcgaggctgaagtaagttgcaattgtgccactgcactccaacttgggtgacagagtgagaccctgtctcaaaaaataaaaataaaaaataaaacagcttcaaactattcactataaaaagcaagtctcagaataaaataaacagaagagtctcaattttctcttaaaaatcatatatatgtataaatatatctaaatatatacaaatgtgtataaagttttgaaaaagttctaaaaggatatatgacacactgaaacaaaagtggttacctcttggggaagagaatgggttgaaagagtggcaattggtattaatttggtatttagtattaaaatttggtattaattattttatatacacttgaattatttacattttaataataaaaatatattcttctattactttcatagttcttataagtcatgcaaatacaggtagtataactgaagtgagtaaatgttttcagaaaagatttgatgaattatcagtcaattagtgatagtgttctgaagggtgggcatttttgaacatttttcctgttatgccttgaattttttaattaaatttcaaaaaaattaattttaccacagttgtagggcttagctttggctagaatcaaaattttatataaattacacgtcagttggaaacaaataatcagaacctcctcaataaaataacattgggaggtgggagagggggtacgaatctcagcatggtttttgggagataaattttttaactttatatttgaaaagtactttttacttgacaagtaaaaagaaaaagaatcttagacaaggcagtatgagaaaaattaattttaaaaataaatttaagaaaggaaaataagttaaaatttgactttctctgctatgagagatagttgttatgtaattttataaatattataagaaacttcacctgtcttcatgtattaaataagatgaagtaaaaatgtaacctggtgtgaatgctaatgtcacattaataatgccattagttatattctctccccaccatcatcttgaatgtctcagtgacacaataacatgggctccatttagtgctttaaaaattaaattaactcccatccttttttgaaaatatctctctaaaaagcagagacattgttcttggacattaaagaaattctgtagattaactgcaattcatgagcctgagtgaaactttcaagcactttgatcattgctataattatgaatacccaacctgtttttacatattatttttaaaggttacaaaagtaattctttttcctccttcaagataatacagtaaaatttgttttctttgacacaattttaattgaactacatacacatgttttccaacttagtttggcaatagaaaaagtgatcattattcttctgactcattctaaaactcttacaatgtacgaggaaactcttggagctttgcttttctctttactgtggcagtgcaaacttattgcttgctactctgcagctatttctgaactcaagttattttagaaattcttcaaaatttaacattttctcctgatcctttttgaggaatcagtacaccatagtggtcgtccctgcttataagacggggttaataatattaccacctacactgttggtttgagaatgacacaagatggtgtgtatttgttatgtgcaggacccactacctggcttgtatggaggagccctttctaaataagtactgctagcattattttttcttctatgagttcctatttctcttttactctaaattatcatcacaataggctatacattatttattttccaaaataaatgttatggtaactacctgcatgaagaaaagtgaaaaaaaatagaacatattatgaatgactatttctgaaaattcaactatctagcattgtacaaataacaccttgacgagtagcttgatttttctcattttcaacttattttttctttccttctctttccatatttatattgtaagtggttgccagcactgaccaatgcagttatccagactacaaatgtagtgttgtcatactcctccaaacacacacatacacacgaacacacacacctttgtttcaaatcgtcaaccttaatcataattgtttaagcaaaaggaggaatgcaggctacaaatccctatctctgagaagaaagttttatagacagcttattcgcattctactgcttctagaccttcagaggaaatatgtgcttgttccataacctcagaatgctttagggaatcccagcttccacgttcattcagtgattcttctgggagtcattctcataagtaccccaaagaaattgagattgagaaaagatttcctataactttgcagacattatggaaaccaaaagaagtatcctttttttcttcacctggtatacaacaaatttattgcctcttctcaaataagtaaaccatttctctaacatgtggagaggaattagggaaggggaggtgatctaaaatttactaaattgcctaaaacatgtcagtaaattacaagagttatttttcctatcatcacagttctatgaagaggatattatagtcttcatttctcatatgaacgagtctcagagaagttaaagattttcctgagtcccagcatgaaatgcagaagatgcaaatggtgccatttatcaattgcatttcttcctgtctctctacaaaatgcccacgttacccatgatacattgttttttctcatcctaacatttacatcactagatattggaacaaaatcaaaagtcatttgtttttgatattatttgtttttttaataaatgctaatactttatgggagataggaattcttttccactccatgaaactttttattagtactcaacatcattccagaaaactgaccgaaaaacaaaggttgaaagaacatatgtgtctgctgttccatttctaaaaggctttataagctgctcctgaaaatgatcaaaatgtcagtgtttctgcccccagtagaacgcatcctctctggtttcagctgcaggttagtcattactgtgtgtaagcatgcattccacagcagaatcatgagggtttggataatagaggaaggttaattagactgtagtaagtacataatatagaggaatatttttcttcacaaaaaagctgaaaattgtccctggactgacaccaaaagagaaagggcgacaattttgggggacttgttagcactaagctacatacattttgccagacatttataggtactcaactttattatgctttcttatgttctgtttttggtgatttagacacattcattctttatatgagaaaatattttataatgtgttttgatatactgtaatgtaatttgtgctaaaatgtaaaaagcatataacagttcctataagctttcctaaaacatttatgaagtataattgcccaagcaaaaaaactatttgcagacttttagtctaacattcaaagcaaatacacaaaaagcatattattctgttcacttcagaggactttatgtatctatagccatttatttatttatttatttattatttcaataggttttggggaacagatggtgtttggttacatggatatgttctttagtggtggtttctgagatcttgttgcatccatcacctgagtagtgtacaccgtacccaatgtgtagtcttttatccctcatccccctcccaccctttccctggagtccccagggcacttttttaaaaataataataacaacaatattcttgtcttttagggaaggtatggaccatttgtatgcgtgtgtactgggtaataatataaaatgtatttcttactgtgggtctaaactaaatgtcattgccaaaaaaggaaaaaaatagccctagaaaggtggaacttttaagaaattttccataaccagaagccacttctgtggtgcttcacttacatcactgaaagcagctaggagtagaatacagggatgaagtaaaaccaaaaaaaggaaaacagcagagaaatcattgtgaacatctgagtaatcaattggttattttttgaataataagacagatcttataattcagctaataaatattgggttcagacctcagctctacaactggttggttagggaaccctgaccaaaattatttaaccacactaggttccacattctcatctataaaatgaggatgaaactaccctctgtctcctcaggcagttaattaaattaaggtgtgtaattcatacattgaacttactgccacacatggaataaattttcagtaattgtaaactattcggttaacccctctcctggagggattacaaagtgttaatttacagactaacctaaagtgtttttgttttgcatgtttgtatagtatactttgctaaaattacttgctaaattagtagactctcaagtaaataataaattttgctttttatcttcaaagatatattatttatttgtaaggtcttatgattttctaactatcgaataaggatagtttcactttgtttaatgttttactataggatgttaatagttaaggtaagtaggcataatttttttaatgatttcaaagagatatccttaagtacttctttttttgactcctaagtatagaagcccacaaaatatgatgacaaggttttcagacacatgagtttgggaatgagttaaatgagaaaaataaagagaagatatgtgaacaaatagaaaaaaattaataaaatagttttctgttgtagaattaatacatgttcattataaaaatttaggtaatagccaaagataaatagaataatattactatttagatgtatatgtttcaaatgcatttgctgtgcacatatacagctaataacatttttttcacaaaatgaaatcataccatacataattttataacttccttttgtcctgtgactatatcatggatgttttctatgtcaacacatataagtcaataatactgtttttaagagcagtataatattccattctttgtttggatcataattttttaaccaattacttattcaggaacatttatctaatatctgatatttagaaattgcaaacaatgctctattgttttataaaactctctgtgtccttctccaaatatttcaatatgataaatttctccttcagttcataaaagtaatcaccaattactgaatgctatttgacaattatagtgttaaaattttatatacactatttcatgggactattacaataattattacaataatcccacgaaacagatacatcattaactacattttaccaaatagtgcaactgaaaattaataaagttgaataattttccaaaagtccacagaaagcaggaattataaccaggaacaactgattccaaaactcatgtgtataaccactacactatactacttctctcgtgtagtatagtttgaatattttaattttttattagtcttacttagtttccagataatttaaattattttttgataaataatagaaattctactttgcaggaccaacttcaatgtatttgtcctcggtcccccatgaattgtctaatatgtaaacttgtcaagtagctgcatgacacattcaaattacctggcatttcaaaaaggtgcaggttgctgtattgcttcattgcaaagttaaggagtaacatgttgcttggaaagaaaattactctttcaatgactttattgaatgtcacataatatgaatgggagacaatgtggaagataaattatcatgtgtattatggatgatatttttttctatacaatcttacaaaagctgaggtgtgtatagtataatcaaatgttagtatatgtacagtacatacttatctataaacacacacatacatgagggacatttggttcaccaaaaatttgtgccagtagaggtatttctttagttactgcttattattattttgaacaatattgtagcctcagacaatgtcctattggaattagaaatgaatgagcactacttattgggcccaagagaaaggtgttaaagaaggaatggcaaggtttgcaccttagtgccaatactcaaactgctttaggctggaaaccagttggccagccaatttaattattcttcaccatgattcaacataaaaggaaataatgagcattgggaatataataatattatggatgctaagtatactgcataaagacatgcacagcaaatgcaaaactgccagtttcaggaaaaaaaaggtaccgggggagaaagaagtgggaggggagttgctgttcaatgggtataaagtttctgttgtagaagacgaatgagttctaaatatttggtgtacaacattgtgctaatagtgaacaaatactgtattgtgtacttaaaaatttgataaaggttagatcttattacatgttcttaccacaattttttaaaaatataaagtagaaggaatggtgcttttgaaataagaaagtgggaagcaaacatttctttccaagaccaacactgtcatctctgtgatttcaagtggctttctcaagcagcatatcttagtgatatattcgatatctagtatagcctgaatcaattacccattgccaaagaaatgacttttctgagatgaaggtaatagacttccttagcaagatcaaaaggaaatcatgtaaaagagctgatggcttatagattgactttttccaatccttaatgattgcctttatctcctacttgcctgagaaatatattgatggggtatcagtgggcatattttaaaatcacatccatatattgcattagatcattaagaaatgcatttgaggaaaatgtcaccaagagtaattagaaagtcatttgtcttgacttcctcatacttgagtgagtagaataatttaaccttttagctttgagcatgatatgttgatatgtgatggggcaccaaaagttagattcaatgagaaatatctcagtattcaaaactatctaaagaggttctgaatgcttcctgaaaatcttgacagatacaattaaaagttttgacttaattttactaagaaatgaactcattatgcttaggtcagatataaacagcatcatccttcttgcagttatgagctaatttatgcttattatattttatctttatattttagttataataaacattttaatgtacctaacattggcaatccttttgaatactatgtatccattgagtgatcagcagatacagaaagacttatatcatgcttaggaatatcttcttcacagcatttgtatgttatcacaatgctttttatgcacagaagagagcaaattttattccaaagaaatgtagtcataagtgtggtaaagctctgtgtttgagagggtagcagcattgtgggatttaaaacaatagcagaaaaaaaataattgcgaggctactctcaaaccaaatgccattctcaaacaaatttcacaaataacaaatttgatataacttttagtatcccttaagaatatcaacttttaatgacttatgaatcagacttgatatttacagcatgcagactgcattcccccaaatagaataggatacgagaaaatggaaacctttagacagaatttataaatctttgacatttaccttttcttgtcttccatatacatatcaaataaaaatttagattcatggttatctgagatctgtcagcaaatatttatcaagaacttattaattccaggcatattatgaggtgctgtaaggcatggaaaccatgagacacaacagtgaagtgttttaaaaagcaaaagaatgggagcctaccaaaagaaaaaaatatgagccaaccaaaagagcccccaatggccaattttgagtaacgcataaaggagtaatttgataaacaaaataaatattgcagtattatattatactccagtgtagagaatgaatatccatgagtgcatagttatataaataaatgattaaatacataaatgagggagaaaggcagatgtgtcatacagaagaattcccaacaagttatgtggatacttcaccctcaagtagaagcataaattccaagtccataattgtgagctgcacataataacctcctcccaaatagtacagtatagaaatggagaaaaagaggaactttacagtggagaaacctgataaacattgcctcagcaaggtgataacacttaacatcaagagtggtaagttgtattaacagccaataataacttgatatgatgtgatgagaatgacatttcacctctttttttctagcaacacaaaacagagggaaaaagaaaaactaagaaaataagtaaaaaagaaaatatgaataaaatattgggtttagtgaataataatatattaatattgactcattagttttgatgaaagaaccatagtaatataagaagttaaaaatagagggaactggatttggaacatacaacaactttctctactctctctgtaaatttcctgtacatctaaaactattctgaaattaagagtttatttaaaagttacatattaaggtatgcctgaaggtttagtctaagagggcatatggaacatcccacttatgactaaaagtaggcaaacctgtctctaatgtgcttataactgctcatctgttgaattgctggattgttccatgtttattattttgatggacattgtacatactctcccatattcatattgcttctttcagtgacaagctactaaaaggcataaaccctagttctgagttactcatgccctctcttgattaaaaaatagggcagcaatggttttccaagacagagctgggttttctatatctttggagaaaatgactttgtaaacaaagaaagaggaattgtaagtctttggatgaatgagtcaggatgatcttagcaaaggtaagggcaatttttgcttggtttttattgtttactctttcttttatgcacttctatttttttctttgttttactgtaaaaatagatcaggacgctgacaaagaaaaattatggctttccaaaaaaggatatgtgcaggaatattcttgaataaaagagcacaagcacctatgtgttccttgctttttttttttttttgacacttcaattttgcagggaaagtgaaattaaaaatggcacttcttcatgcaaaaaagagagcaaaagctcttagcacagatggttagcaacaaggttgaggacacaattaacagtctgaaattatatcatcgtatagtctgtcagcaacttcgaagctgggcagcagcatccaggacttaattggctttattaataaggcatcctttcatttcctttctgtctaactcttatgtcacttgtcaccataacagattttttttaagtatctgcaaatgaatttgatcccaaaagcttatcttttctgcagcatgtgttatttcttttaaaatagaagtttctcttgaacttctacttaaacttagtatggagctttcaggtaaaactctcaaacaaaaagtgtttgacaccagcaaggcagagatcacccttttggaaaaatatatcaactacttattgattgccttaaatacagataatgcaaatctcaatttaatctccatgttttaaaaaaaatgaccagcagatagaaattaacattacaggtgtatattggtccattttcatactgctatgaagaaacaccagagactgggtaatttataaggagaaagcaagttagttacttcctagataaaatgggggtacaggcattgtgtaaatatacctgttccaagtgggagaaaatggccaaaatgaagggcctgcaggccccatgcaattctgaaattcaacagggcagtcaaatcttaaagcttcgaaagacctcctttgactccatgtctcaaatccaggtcatactgatgcaagaggtgagttcccacggtcttgggaagctctgcccctgtgtctttgcagggtacagatccctcctggctgttttcatgctctggtgttgagtgcctgcagcttttccagccacatggtgcaagctgtttgtatatctattattctgcagtctggaggacggtggcctccttctcacagctccactaggcagtgccccagtggggacactctgtgtgggggttctcaccccacattttccttctgcatcatcctagcagaggctctccatgaccctccgcccctgcggcaaacttctgcctggacatccaggcatttccatacatcctctgaaatctagttggaggttcccaaccctcaattcttgacttctgtgcacccacaggctcaacaccatgtgtaagctgccaaggtttggagcttgcaccctctgaagcaacagcctgagttgtacagtggccccttttaaccatggctggagctgaagcagctgagatgcagggggcaccatgtcctgaggctgcatagagtggggcctccatgcctgtgattggaggggggctgctgtgaaggtctctgacatgccctgaagacattttgtccattgtcttggtgattaatatttggcttctcattacttatgcaaatttatacagctagcttgaatttctacccccaaaatggggttttcttttctatcacattatcaggctgcaaatttttcaaacttttatactctacttcctcttgcatgctttgccacctagaaatttcttcctccagataccctaaattatctctcttaagttcaaagttttacagatctgtagagcaggggcaaaataccaccagtatctttgcatagcaagaatgacctttactccagttcccaacgagttcctcatctccatatgacaccaccgcagcctggactttactgtccatatcactattcagcattttggccaaagccatttaagtctctaggaagtctcaaactttcccacatcttactgtcttctgagccttccaagtctataggacgttacaaactttccaacatcttcctgtcttcttctgagacctccaaactattccaacctctgcctgttgcccagttccaaagtcgcttccacattttcaggtatctttatagcagcacctgtagcagtaaactggtaccaatttactgtattagtccattttcacactgctatgaagaaatacctgagacggggcaatttataaagaaaaagaggtttaattgacttacagttccacatggctggggaggccttacaaacatggcagaaggtgaaggaggagcaaaggcacatcttacatggtggcaggcaaaagaacgtatgcaagagaactgccctttataaaaccatcagatctcatgagacttatttgctgtcacaagaacaacacaggaaaacccatccttatgattcaattacctcagttacctcctactgcatccccctcatgacatgctgagattatgatctactctcaccactgagaatattcatattcttcaatcataatgttcaaatatctaaagtatgtcatgcattacatacctaaaatcttcacagaaatgcagttacatttgaatgataaacatttgttttatgttatattgaccttagaactaggtaataattaaaacaaacacttcagtttctgggttgtaaagaggagttttgatagaatattcaatttttgctaaatatagccagacatgggattgttttcatttctttgactaaaattaatgagatttttgaaattatctcaaaggcattatgtttgtgacaagttatctataacacaatatggaagctatcctttaatgataagtttcttctgaaatgtatttttattactgtttttatacttttacaatattaatcttaatgataaaatctagacagaatatataggcttttgtatcatttttccaaagtttggaatactactagttatcagagatttttattagctattctatgaataaagaaaaagcattccacaatcaaataagtttcagaaatgtttcctattacagtcctctctgtatctttctattagcacacaaaatggtttggtaagtcctgtaaaaaagactctgaatcaggtgagatgcaggagaatgaaaagcctcaagggagaatgaggaaattaaagcaagaaagtggaggggtccagggggatcagagaagctggggtttaggtcaaaagagaggaaggtggagcagcatagcagtctaaggctgaacagaaaggagaaggcagatattcacagacgcttgcactttgtgtaatgagctagaacagtgggaatagaaaatataatgaattaactcacttcaaaattttaaagagaactcaagaattatgttgcaagctgagaatccagggattgtgggagatctggggaatgtgacagtgataagtcagtccttgctagggcttatcccactggcacagtactacttctccagattctggctgttgcctttgagattttcctagctaaggtttgcctacttttcttgactacagtttaaaatttctctcttcttgtctgctgtgtactcatcttccaattctaattttatctcttctccattttacatcccagccttctgaagtgattacttagtccaaacacacctataaaatatgtgtatattggtgaaaatacattttaatggcagtatcaggagtaagaccaacagcttacacactgggatgttttgctcgtgaatattgctaagaaactgtacaattcttttaaaacctaataatttcagaggttgaacagggtatagaaatatggcaaagaaaatcaatcccatttaaattttctagtcctaaggcaaatttctaggtcctgaagttcatcagtacagctgctttttgtattaacaagcgataagtgatactaaagataagagtaatctcatatcttgagaaatactcaattttattccttctggctataaatggaaaaaaaaatgaagcacaatccagttatgaatactggtctgggccagcagaggtctgggctatgtcagtgtcagatctaaagtggtaactggagagacaaagctggtgcatcttgccaaaagtgaacaagaggccaaataccagaagatctataaaagaagaaaatgatcagaatccggacagacttcaatgaagtgctattcaaaggttcatcattaactaagatagcacaactaagtgaatctgatcctacatcagaggctgtctcttcactctcttttgtgtgtgtcccacccccacctgagaagttcatttttttctgtatgcagatctattatgaggtcagtattgcaggttgttaacaaaattttcagagagaaatagcgaatagaaggatcatgatatattattttgtttatgcttaaaaatattttttaaattataaggagtagtatttatatacaaacacttttggacactgcattttatgctaatataggtttcttatttttttaacccaagaaagagcatatagtggagaatatacataggattatcaagattttattataattataaaataaagtcatagcaacatataattttaaaaactatttttatgtagattatatcatgggtatcttcataaaagcctgtggttttgataaggtagatattttgtctacatttcagaaataaagagaaataaaatcttagtgaactttagggttgctgtggtctgaatgtttgcgcccctctcaaaattcctacgttgaaaacctcatcaccaatactatacaattaggtagaagaggtgattaggtcaggagggtggaacccttgttactggtattagagcccttataaaagaagctctaaagagctgcctcacccctttctgccatgtgatgacacagtgagaagatggccctcaccagatacctaatctgttggcaccttgatcttggacttccctgcttccaaaataatgagacataaattttggttgtttctaagacattcagttcttggtgtttgttacacagtccgaaaggactaagacaagagttttttgcttagtggcataactcatcaatgtcatggctagatagcagatagttcatatggttccttccttcattcattccttctttccttttttccttccatccttcctttctttcatctcctcctccttctttctctctctcctttcctcccatcccctcccttttctcctttccttcttcttatttttaatataccctttccccatatctcaacccccaattattagaaataccacatcctcaatacatgtgtgttaggcacagggtcatttggaactgtttactaccagtatttgtccaaaaagattattttaaaatataaaaatataaaatcgttgggtggattgaaattttagataagatggctgagtcactgtttgtttgcacagaggtaagtgggaatgtactatcttgaaagaagctaggagggagtcatataacagaggatagagaaatgcccatttaaataatttaagcagattgcccttgcttattccacaccacccaactgcttttaatttttaccacttggaaataggtaatgctggttgtgtacttagaaagccccaattcagcaagtgaagagataagtcttcccagataaaatagtgaactgtaccccttaatccctgtgctcttcctctccaaactggctctcctgtttaccctgctcttgttcagaactctctcttggatatgttttctcgacatggaggcttcagctgcacacactcatatacgtagagtaatgcaaacttgtttgttatatcatctgtgactcctgcttttgggggaagttagtttctaaatcctttttcttccttagtgatttttttttccaattagttgaacgaatgatggtatttgtttgcagcttccagtgttgcccataaagaagagtagttattcatttagggaaattgcttgatcagtgctatgcagggccattatatcttctttgtgctggtaggagaaaagagtgatattctagattgaaacaactggaaaaacagattgctgaattaggagtgaagatataattagatgcaccctacaataattggatagaattgaaagcatttaagtctgtacataatcaaatattgcctggaaatgctacagcatcttcattttatgctaaacagatttttatggaagggctataaaggaggaaatctgcttgctaatttgattaaaaacaccatggatctccgtgatttcagctattaagattccaaatgggaggaggctaattataaaagaaaataagaaattgatttcatctttaagatctattatcaaacattgcatagtttaagtggaattattcataacaaagatgcacttcaataattgctctaagaatagatatattcttagttccattttaaactgaaaggaatctaaagaaaaaacaacactgtataatcagtatttatgggagaggtattttattaaccacataagcccattttactgaaaagaaaacaaattaaaagaatatcacttgctgaaaactatcctcaaacacagatatgtagtgtctcataacttaagaactgtattcattctctgtttatactatttaatttctgtattatatcatagctattagtagacacatcctttttgtcttattattattattctttattatttatttatttgtttgtttgtttgagatggagtcttgctctgtcacccaggctggagtgcagtggcacgatctcggctcactgcaagctccatctcctgggttcacgccattctcctgccttagcctcctgagtagctgggactacaggtgcccgctgccaatcccagataatttttttgtatttttagtagaaacggggtttcaccgtgttagctaggatggtctcgatctcctgaccgtgatccgcccgcctcggcctcccaaagtgctgggattacaggattgagccactgtgcccagtcttgtcttattatttattcatccattaaacagacattactgagcagctactatgtagcagccagtgtttcaggcacagaggatacagcagagaatgaaggagacaaaatttcctaccatcaagaatcttgcattctgtttggaaaggggtaaagtaaaagataaataagtatgatgtatagtgtgttggatagtaatgaatgctaaagaagataaatatgaagtggaagggtaagattatttttgagagaatggtcaaagaaggcctcattgtggaaacttgagtaaagatttgaatgaagtgaaggagctgaccatgctgatatcttaagaaagcctccagacagatgtgcaaaggcctgaggcaggctgcgcacggcttgttggggcaacagcaagaaatgatgttgatagagtacatctaggcaggggctggggagaaggccttcacaggttgtaggtcacgaggtctcagtaaggattttgatttctattttaatttattttatttctttgcatttcatttttttgaggtaaggtctcactctgtcatccaggctggcatgaccactgctcactgcagcctcaacctcccaggttgaggtcctcctacctcagcttcccaagtatctgggactacaggcatatgacaccatccccactaattatttgtagagatagtctcattatgttgccagggctggtctcgaactcctgggctccagggaccccacctaaacctcccagagtgttgggattataggcatgagctaccacactgggccagattttgactccaaagtgagatgggaaggagtggtagcactgaacagaagagacatgatctaccttattttatcagacatgagcttctcaactgcaggggctactctgggccatgcagctttgtaaaaatgatctaagtgatatcctattctatctactgggctgcagatagctgaagaacatttctatctactttataatttagtacacagtcaatcctggaaagtatttattaatgatgctggttaccttttaaacacaaaatttaaaatgtgggcctaatttaaacataaaaataaaaaatgttcaaacgacaaaggaaaatctgaggggttatatctttttagtctagtttaaatgcctgtacttcccaggaatttaataatttggtaagttaaaaaaaactttttattcatcatgcatatggtaaatgttatttgcttttcctttttagaactacatttaaagagaaataaattaattctggagtgccactttgtcacagaaagaaggcaaagggatatctccaaatttctagtttatgtaccttctcattcttttccatgttaccagaaaacagtattactacttggtgaaagttttgttttattgtaaaatggtaaaatgcagtttaaatttatttcaaaagatgaatccaggagccagctgaatatgctcatgggtctgctcaagccaaggttttattgctgctaattgacaagcccaattgtacaacaccaaatttggaactgaaaattccctgtctttgaatagctgtaatttaatcaagcttgctttagctcctttattatatcataatgaaatataaaataccttacacacaaatgcttctctttcagaaattaaatagaaagcaaagatttaacaggccaagagtaacaatcagtgcaaacacaattaccttctcacatacaggataaagcaactctccccctttttgtcatccaatatcatagtagcacgatcttttctccctacctgtccaattttttttttatttttctttttttttttttcttgagatggagtctcactctgtcgcccaggctggagtgcagtggcctgatttcggctcactgcaacctccaccttccgggttcaagcgattctcctgcctcagcttccgagtagctgggattacaggtgcacgccaccatacccggctaatttttgcatttttagtggatggagtagggtggggtttcaccgtattggccaggctggtctggaactcctgacttcaggtgatccgcctgcctcagcctcccaaaatgctgggattataggcatgagccactgcacctggtcccaaattttcattatcctcatgtttgtcctaaagcaaaagaaaaagatgagcaactgtggaaaatgaaaataccaaagcttggtgtgttttctgagaaaacttaagcttcaggatacttataactgtagttattaaacccaaagagagaagtaagtcttcttcatatatctagaagcaatgtgaacatttgccactagtaggatctagagtgaagatttcttaactcttcatcctttctgtgctaattgaatgatgaagaccctaggagtttttcaaaaaatctcatacagagtgctaacacatcagttgatgacatccagccatgacggattcaggcttgcataaataatctgcaggagttctttgaatatatcacagccacactagataaaagatgatctgggactacgatatagttaatatttcagaaaaaaaagtgcatttgatatgtttctgcatcagagataaaggtaaaagaaccaccgaacatgggataaagagtaccgaagcgaaaattagttttagaaacactacaaagcaaagactttaaaagcaacttttatgttggaaagaaaaaaaaaatattgaaactgggcagcccatgtgcaattaattgaagtccagtccttccttaaaaacgctttctaacacaccaaatatctcacaaagctgatggtgactaaaagtctttccaacagtttagtgcaatagacttatcactaagcttggaatgtaaaaatctaagttctagctgattaaatgatcttgagtaattagcactcagggtctcagattccaacctacagaataggaaattgggtctagaaagattgccaaagtccctcctatctccacaactatttgattctaacagctccacgtagctctggggaatttaatcatcaagcaagtttctccattaaggtggataattaaaatgagggagtactctgtaatgcatcaaaacagattcagattgctggctttttcaaatttacagtttcgctttcagtaaaaattacatggtataatcagtcgagctgtggaaatgggctctgaaggctattgattcctgagttcttgatactttcattgaccctatcaaaacacttaaatgttccaaagcctggagtggccctggagaagcccaagttgtaacaattttgtactgcctgaggtttatattactccagagagtatgtattttgtaatagggttgaaaagacagtaaaatttttaaaaagtggccactcctatagtagtgtagatacatgaacatttaaccaaatgtattgcctttattctgagtctgtacatgcgcagaaatcccagcaaaatgttctctaactagtcttatgtgaccctggcttaaaatgtgggctgttagacttttaactacttgaggccaggcacagtggttcacatttgcaatcccagcactttgggaggcagaggtgggcagatcacctgaggtcaggagttcgagaccagcttggccaatatggtgaaaccttgtctctaactaaaaatacaaaaattagccaggtgtggtgccatgtgcctgtaatcccagctactcaggaggctgaggcaggagaactgcttgaactcgggaagtggaggttgcagtgagccgtgagccaagattctgccactgtaccgcagcctgggcaacacagtgagactccaaaaaaaaaaaaattttttttgaactacttgaaaataatagactgcttttattatgtacagagtcagtattccatgcaattttgttgaattaaatttaattcttctatcaccagagagcattttttttaaatgaagaacatgattactaatttagatgacatgtaaccaagtttaaggcagacaaaaaaaaaagtctctattagaaactacaatggaacattatggggataaaatgaaaatattaacttaaaattcattcctccatcccttttagcccaaatgagtgaataattttaaaacctgaaacaaatgttttctcagtataacccttctagagaagtactgcaatttcactaaatcacagaactcccattgccttagatcaggagtgtgtatattatcagcatcaaacaaaactcaattatttgtaattgtcagcagagctgagaataaaccttattgaagcatgaacactgtgagaaaaaatatatctgtgcattccatcaaaagcaagcatttctttgcctgaatttttaaaaattgttttatttataattattgtagatatataatagttgtacatatttatgtatatgtgatgtttggatacagtatacagtgtgtaatgatcaaatcagggtaattgaggtatccatcaccttaagcttttatcatttctttgtgttaggaacatttcaattccactcttttagttattttgaaatatacaataagttattgttaactatagtcaccctattgtgccaccaaacactagattttactctatctaattgtattttcatactcattaaccctcccctctttaccccccttctccattacccttcccagcctgtggtaaccatcattctattctctataatttgtaataattatacttctagagcaaaagataaactctgcctacctgggtcttgattctcttaggacggataagtcatgtccaagaatagaatacaaaaagagaaaatggtgtcagtagtatggtgttatactggtgtgctatactaaatggtgtctgtttcaggtaaaatgacattagaattcagaatgaaggagtgattccagctggagcaattaggaatcagggaagtcattgtaaacaaagtggcatttttgatagacctggactttaaaatatggaaattagtgcagagcgtgatgaatccagcattccgaggaaaaaggaaaaggagaaggaggtgtgaggcaccaactgaaaagaggacttgatcttcctgagcctctagtgtgtgaaagagaacaatgggctgtgaggggctagatggtgcaaagctttggaggcctgatgtgcactttaatcatcaggcttggaccaggtacagagggttttaagaaggagaatgacagaaccagagctgtgcttttggagatttattctggcagcagtgtgtaggatggattgaaggaggtgatgccagctcaggctcaacaatttcttaaagtggagaaaaggcacagttgcagtagagactaatccacgtgccactaaaaattgccctgtgttccatctgcagcaccaatgtgaagactgttcacctctttccagaataccgtggatctgtgaacagttaaaacctattacatgagctgtgtggagctgacctgataggaataattataatgaaaggtttatatcattccctaggactgggggtaagggcaatataacactctaacactcctactttgttcctgttttagcttttgaagttttataatagcaagttacttgatttgtcttgagatttgagctgtatcactgatataagctttctaattatctttatcaacgtggctacggcaaggaaaagtgtgattccacaatttagatttgcagataccaaatagaatgctaattgatactttggaaatatgattttcaaacttagcagagtgggtaacaccaagaaaaatgttttaacctgaagtcattttgaaggctaaaatacactttaaatttaaactgaaagggaaagtgaggagaaccctgcttgaggctttaattctttgattaaacttgatagtgggttatctttagggtaacttctacttcaatatgagcctcattccatgggccaggccattataattatgtataatagaattttttttccaaaatacattacaatatctgaagaagataatcacattgtaacagagagaaatgaaaatctgtcaaagagaatgaagaaattatacttgcctttcttgtccttggtgcctaaagtgaaatgaaattgttttcctgttatcaggccaaatgcagacatactttaagggaccagccttctttaaagattttatcaggtagagacatcagttctgccttcctccttgcttcagggcactgcaaatggcttcagagtacatctatatgctagttcactggaaggaatcgttgttccaaagttttgcagaacaaaactcccctaaattctcaagagaccagttccacaaagctgtgagctgagttttgttatattcagattcactatccatatctctcatgagctctgagtttcagctacgatattttgaacctaaggaatactttaccctttctttttctccaggaagcaacgatccagtataaaaggagttatataatcaagacataactgtgagctttgaaactattttaatcaccagagcctgcttcttaccataaaacgatttctcaagctccataatttgggatagaaaacaatagcaatcttgaagaaataccaggaaggacattagagagatgaagtagagaagcattcaaaatgggatcagaggatgcatctattcacaggtccacctgatgccagggcttgtagaaaaaaatttagagatatatttagagccattgaaactgttcccatttttacatagggagagatcagcattatattttgagaaaccatagggaaggagcctgtcttttaaagtctggtgctacccaggattctgtctttgatcataggcttatctaatgggtcatatcttactctgtcatagtttttacctattacacgctgtatatgctggtaacatccaagtctaaaaatccagcccagacataatccctgaggttcagatttgaagatctgtgtaatgacctagatttatatgtggatatcgctcccacaggcatctggcacccaccctgtcttctagagtacccctcatagcactccttgtattgagttctaagtgcttatgtcactgcctatctcttccactggaccaaaagtactgggaaggtcagggtgaggtctgttttgttcataattaaaagccttgctcctggtacacggcaactgctcaataaatattttttgaataaatgaatcattggagtggggcttgaaaaatctggataattataattttataaaatgtccttttaacacaatctgctctccagcccctaccatttaagataaagggactgcattaggacttacttaagtgcctgtctacttagggtcacagcacactgattctctatgtagtcattttggactatgatttgttgtaagactttgcctacgaatattctgccaagtacaaataatttaatacgattgaccattcagttgataaagttgtaaatagataattattgcttttcagaagaaagttgctaaaaatgcatatatattcaaagcaatacctgagaagcataacataaaaagcgtttgcattcccacgaacacggttcagttaaagctgagctttgcctcacagaggataggcaaactgcatctgggaaccttccaggaaaactacagaaatccaattaggaacagtcctaaatggactcagaatgtttaggtatgatagagaaaccagtaattcttctcatcagtaaaagtaatgaagtgcctttaaaaacatccttccatttctcctgcttaataagtagatataaaattggggtacttacaaaaagtatttaattgtcataggtagttggcaagacaaatttttaagaatccaaatttggtaaagaaatacatataaacaacttttgaagagcatcagaaattgaacagcctatcagaccatctgggactgtattcccttcatctcatctggatgtgctctgtgcccctccctgagccagctgcttcatttttccctatcctcttgtccttaaaatcacaaaaggacattacacattaactgatgccttgcactaatttatatttgggggatattggaaaaactaacacttcttctaagtgtgcaggattctcttgagtagacaatgtgagaaaaagttacaaatacttttcaggtctcttcccaagtatgaaattgagaaatattctgaaaaatcagagtcagactgattttggttagaaaatacaaatcctatgatttctgctacaatggtatctgaatcaagataatgaccattaagtctcagacctttacaaaggtcttcagtcaggcgagacaaaaacattaatttgttaaatgagactatgggaaatactaccaacctcctgagatctctcatttatcactttgtcatgaatctcacctctccagtttccttacagttttcaattatggatgctagaatcactgctgtcatttaaaaaaattagaatgtctttatttctttataccatttgcattttaatttcctgcccctttcagagacatttcttttgctaagtaatggccagcagccaatctcaatctggagaggaaatgattaaaatcttaattctcctggagggggagctactatatttatcttttgtttctggatttgatcatcagactgtatgtttctgccacattaacctcattttagcagtagttttcaatatgagtgagaggaaaaagtagaagagatgttttcaatccaatggttaatctgtttgacacaacatttgcttcctcataatgggtgatgatagtttatattactctttaaatcagagctcaacacatgtttatagtatcaaattaataatattcactgtgctccttaaagttggatattagcaaaagtgatagaaatacatgagcacagagtagcaaaatcattttcacaaatggtgatctgttaatgctgagtttttagttcttcttattccctttagtcatttatatagtcaaattatctggtctaattttatttttaaaaattatgatttttcttagactccaacagtaatataaaagcaaacaaacagtacttagttactttttacttgttagttgaaaattataaggcataaaagtaaacatgtttttacttttttgtaaagtaagattgtgtgagacagaatgtacatcttaaactctctcaaggaaagtaaatgtattaatttaagagttcagaggttagtggactctgggtatagtctgatcaagtcactcagttttttacaattctactggctcttttatattccatgaaaagcttcattctgtgacttaactttttttgtgcctgcaaacagtgattgcatttgtaagtatcacatcttcctataatattgtccaattataaaaagaatgtcttagattaagtaaaaagataactacctttttaccaatagtcaaaaatttttggcttcatcttgtttgaaccaaagtatttcatgtgaacacttctgaaccaatcaatgtaactgacaactcctgtatatgcagattggaagataggcataggcagtggattaggtttcatggactggggtcagtccttcaaagtgcttgctgctgtgcaataggagaggggcacagcacgtgctgaggaggcaatgacagtccctgcagttacccaaactttcttaacatttcaggtggctctcaaatcacaaaagcattctctctagctcacagaaaaatgacccccaatcagcagagcaaagattctctcaattctacagcagtcaaggtttacttccctataatgcctgcctttttttgaatgctcttagcaagctttatagcaattttaaaatctgattctttgaaatccagaaagttactaattgggagttagaaggggtaaaaaaaacgctcagtgtcaaaagatttattgtaaaaggtctttcttgtctttttgggaggggagagagtgttatggtctgaaatgtgttctcaaattcatgtcgaagtcccaatctccagtatgtttttggagataaggtctttaaagaagtgattaggttaaaataaggcctttagtgtttggccctaatctaaaatgactgatgtccctataagaaaagcaagagctggagatcgagactatcctggctaacatggtgaaaccccgtctctactaaaaatacaaaaaattagctgggcgtggtggcaggtgcctgtagtcctagctgcttgggaggctgaggaaggagaatggtgtgaacctgggaggcggagcttgcagtgagccgagatcgtgccactgcactccagcctgggcgacagagtgagactccgtttaaaaaaaaaaaaaggaaagaaagaaaaagaaaagaaagaaaagaaaagcaagagctaccagaggtgagagcacacaaaggaatgaccaagtgaagaggcagcaatagggcagccatctgcaagccaagaaagagtctcagaaggacctaaccctcctgaccccttgatcttggacttccagcctctagaactgtgaggaaataaatttctgctgcttaatctacccagtttgtggtattttgttatggcatccctagcaaactaatacagaatggtggtttgtttgctttttgttaacttttcttttggaggttataaaaccaactgcttcttccaacattttaatttagggttttgttgcagtaggagactttatttcatagaagtaatagttattttgctgatgttcaaaggatgcttctggtactcggtgaggttgatgcatttctcttcaccagtgaagtctaatgctataggaaagttttcaaatttcacactggtccctgtaattttccttccaactggcaaatactttgaggatgacagctgtgagccagtgcaactatcaccatggtctgtttctaatttttttgttggtgtttatgaacacaacttttccccttggagcctttggttcattgctggtgatgaaggattttatctccttagctcatctaggtctgggttcttgtcttgtctcatgaccaggaaaaatcaggcacgtggacactcgaagagtgagtggagtagaatgtattaagtgaaaaggaaagctctcagcaaaaaggggcatcctgaaagcaggttgccagttttccttcgcagtacaagggcttatatatatataagctgatggagctgggttccctatttgtataaggcataaattccaggtggctctgccccattccccctagcgtgcatgtggacccttaatcttctccgggcatgtttaggcaagcctgctgtacaagttcccttatctgcacaaaatatctggtgtaggcacttgtgggttaggtcggatgttttccagggacccttcccttactgtctgcctaaagcaagctggctaactcctttcactggttttgaaggtttttgttgttatttttctaagcactcttttcattttatttcaccataaatccagttcttacaaggtataaatgaaatatctcctttttaatgtgtgctgaggtttggaactcaaatgtacaaattatgactgcctatacataaaaaacagaagcatgttaccatgaaatgaaataatgggcagacaatgttagtttgaaatgttctttttcccctccattcctattaaatttgtgttggttctttgttagatgaaagagaaagaaataaagtgcaatgcttttgcctaaaagcctatccccaaaggaattgagttaactgtacctagccccagagaaagacatgaaactatgactggctaaaaaggctaactaagatgtgtgtttttctaggatttcttcttatattctttgagtctatgtaatatgatcagtaccttcactttcgttttctcttgtaattatgaaacgagtgtgacaattctgcccatgacacctcagagtctgttaccaaagtcactgaaaacatcacaaaggaggaccttgagctcctcagaatatgttaaataagtattaaatgcggtaaactgtaaagattctctgtcttttcataatctttttattattttggtgagtttagttttgtgtttttcctttggaagagaatgcctaataaaatgagttgaggaatgtacactgagttagagtgaacaatactcctggatttgggagtgtttattttagttataaagaaagttccagtttagaatttattctagacaaataatgacatttgaaggcaaccatggttttaatggttctctgaatcaagcaaaagcaatgtaggaaaatttaaacatctaaccctcagaaatgccaatgaagactataaaactaattcagttaatgatttcaaaatcttatttgacatgttttataaaacaggaataaaaccattcctcagtaggaactactcagtcctgcaattataatttgaatcaatatcatattaatatagagcaacactgccttgcatttttttctctgttgattcaaaaatcacttgtcttcaaatctactcctgtctgttctttagagacaggctcatttttgcttaaagatatgatgcaaatgaaaggaatacatttgtaaaaatgtgatttctctagctccttattttttctctaactctataattttacttgtaaatatcaattatattatccagtcttaaagaatcactaatagaacaagcattattagaaaagataattagataaggcctcaacaatgatgacttttaattagcacttttgcaatatgatgttctgaagaaaatatgattagtggttactataatgtttacaatgtcatttacctgaactttacatttgtgtcatttttgtagataaataaagggacacactctcaaagactccatttctgatttttatatttttaaaacaaggtgatggtttaatggtctttaattcatttcatatcataatggacagatggtggacaaggattttccccactgtgcaggtgtatgatgttaaaccaataaacactatacaaagtaagttaaattttctataatatatatgatatgtgtgtatgtatgtgtgtgtatttcctgagacttactaagatattttattaagacaagttattcttcaggagcattttagaaatgtgaaatattaatccatttgaatttatgatttgacaaggggagttattaacttctttcagatggaaaccgttttgcaacagggcaaaacagattggtccctaatttcttaatcacttctttggtgattcgaaggacagacactcattaatcagctctcagataagaaacttgctctgttgttttaatgatcaagtattctggagagacttaaagaatctccaaccatctcttccgcttccataatattagatttgttgcttcatcccccaaattgcccatgactttcttctataaaataaatgactaaaattgaaactcttgcttctttttcctgaatcaacctcttaggcttgaatcctcagaactttaacatcatttgttaaattatttttaagcacttgcttgcagattttctgctgcgtccgtgttgttgatgggattgatgttgatcaatgtaaaggtaaaggtcaatgttcaggtaaatgacattgtaaacattatagtaaccactaatcatattttcttcagaacatcatattgcaaaagtgctgtttaaaagtcatcactgttgaggccttatctaattatcttttctaataatgcttcttctattagtgattcttaaagactggataatataattgatatttacaagtaaaattttagagttagagaaaataaagagctacagaaatcgtatttttacaaatgtattcctttcatttgcatcatatctttaagcaaaaatgagcctgtctctaaagaaaagacaggagtagatgtgaagacaagtgatttttgaatcaacagagaaaaaaatgttgatcccatcaacaacagggatgcaggaattgatgttgatccctctgaatgatgatatactattaagttgagccaaagaacaaaaaattaagagcatcttttctctataacttccttccaaaaatcaaagaatgaaataagacatgagaaattagaacataaattattaagatgggttctacaagaccaaatgtattggtagacctagatgtctgtaaaatgatttaaaaatgtgtaatttgtagaaatatctccccaaataagctttcagaaccaggctaattacactgactaaatctttttgacttgttttctttcactcacataaggtctgcctatggtgtttcaaagcccccttcatgctttcaactgtttctgctggagccaggatccaagttccattcatttagctcccattttagtccttagaatggtatttaataactgttaaaaatgattgaatgaatcaagcactataattttatatatgtctcatatcaacaggattctaaacacgttgattattttagcagtagatgtaataaactgtcttgataaactgcatcactgatccatgctttattagtgacaaagttaaccatgtcaacttttagttatggccacagctactttctgctattctactttatattcattgattataccttgaatataatttttcattagcttaaatttatattatcaacgaaacaagaaattaattaggctgacagataaaatcagaggatagaagaattatcaggacacttgttagttacattaagataaaacgttttagacttttgcccatacagacattttggttgagcttttaaaaatactgccattccctgtgtttccaacttaaagatggctcaaaccttaaaccactaatttaatttttggcacactgaataaaaactgggaattccgaaatctgtgccaatgatggtattgtggctctgatgaagagtcaggggaaagagtggggaggaaactgtgagtaaagttctcaaatgcccaatcatttcagcacctcataatttgtgctgatgaaaaataccacagttatgctgcccgagtttgcagaataaatagctttgatttccattactatccatgtttctatttgaataacaaagacttgctttacctgatttgaagaatagtcactctggtcaatctggtgaaacaattggtaagtgtagttgacataatatgcatgaacgctttttaaaaagtaagtgctataaagactcaaggaattatttattaaattgttatatataatgataaaaacttatccaacttgaagattcattaaattgttccaaataagtcaaaaaatgtggaaaagagaagctaataatagatattgatgactttcacaaattcgctatcatagataactagctcttatctatggaaataggctttggtgataacatggaaaaatgaaaatgcagatctatgtatgaattaattttgataaaaatataatctttttacaaagcaaaattatcacatttggatttttctctactatttcttattatgtacttaaagtagtagaaataacaataatgagaaggtgctaatgattaagagagagagtatgggtgacggacagaaataatgaaagacaatattctgtttttaaactatgattttgaaaacgtgaattgtaattactggataacatccatctacttctatagggtaaattaagatgggttatattccttagtagaggaaaatctagattcattttgtaacacaagagtagaaacagtaattggcacaagaccaagctcaaggaaaagactttatagctagaaatttgctatcatctgaatgtttatatctgccccaaatttatatgtcaaaacttaatcccaaatgtgatgatattaagaggtggggtcattggtgggtgattagatcatgagtacagagctctcctggatgggataagtgcccttataaaataggctcaaggaacatcattggccccttccaccatgagccgatacagttagaagatgtcctctttgaggaacaggcgctcctcagacaccaaatctgccagcaccttaatcttggactttccagccttcagagctgtgagaaataaatatttgttgtttatgagccacacagtttattatatgttgttgtaacagcctgactgaactaagacagaaacatagatacagataaatatagatataggtagagacagatagatagatagataaccaagttgattttgacatcttttgaagaatttaaatagtttcagtgttagaggtgactgcctgaatgtggatgtgaatatctacagaccacacaaatacttacgggatctaaaatacagtttcacacttttaactatcctctgaatttacattttctgttcaataaaagctgtattatacattatgcagatatttaaatcagtacctataacttctgcattattaatatgtgaatgccagatatccaaaaaaatacatccacttcactttgccttttaccatgggatgtgaaaaagtgataatcaccattccaagaatttctactagtggattttgacttctttcctctttgtatttcagtttgggaaatttctaatgacatatcttcaaactcattgattctttctttatctgtgtccagtctactgatgaactcatcaaaggcatttttgcatttctgttacagtggttttgatctttaccatttcctctttattccttcttagcactttcatttttctgcttaaatttttcatctgttcttgcgtgttttccatagagcccttaacatattcatcattgttattttaaattctgtctgttaattccaaaacctgtgtcatatctgagtctagttctgatgcgtgctttttctcttcaaaacatgttattttgttgttgctttttagcattcctcttattttattgatatttttacttgagatgtaatcattgtacatatttatgaaatacagcataatatttcagtaggtatgtcatgtgtcaaatcagggtaattagcatatctatcacttcaaatacacactcataatttccttgtgttggaaacattcaaaatcctctcttctaggtattggaaaatatactaaattattgttacctatagttaacctacagactatgaatgccagcacttatacttccccatctaactgtaaccttaccctttccagtctctagtaactactattctactcctttgtaattttttgttgaaagccagaaggagtgtatcagttgaaatgaactgaagtaaataggccctaaaaataatctaactcctagccagactaacataaaaccacacattaatgtttaatgattgttatagtagtatatgtcagagaccaacgttaactagtgtccttgttttgtctccactgttgtttttgtgcttccttaacaattcttccttaaatagagcctacatctggcattctttgcgttgtaattcactgctgtcatactggagcccttttggcctgccattaatgtgtacgtggtagagaggtattctttaatcttatgattaggtcattcaggaaggctagaagatgttagggaatgcctttcctgtaggccagataaggctgaggtaaagtcttttcccttgcagtggaggcctttgtcatggagattgctccaggtgtatttcacaaaggttattttcctctccctctctcagagcctggagaggattttggctcttcattgtgagattcatttggaaatcccaagaaaatgtgagaggtcctccaagactgcatcctttacaagtttctcactctcatcctagttcacaatcagcttcaacaattcatgaaagttactaatttaaatgttcctaccagtttctggctcaaagaaaagtgattaattacaagttgttcttctgtttccttgtttcaaagacagcagtaactacttccaagctctttttttttttttttgaaaacgagagtcttgctatgtttaccagtgttaaagcaaactaaatatggcctgagaaggactccatacttctatatttgagttattgcggatgaactgtaacctagcttaataggcagacaagattgaaaatctaacttaagagtatgtgcctgtaacagtagctgagctgagccttggccaatcccagtggccatacttcaaccactcatagactgctaagtgttcaaactgtgttcaaataaggcaaacaccaacctgtaaccaatacagctgtttctgtacctcaccgccgatttccttttttttgtctataaattagttctgaccatgaagcatctctggagtctcactcaatctgctgtgattctgggggttgcctgatttgtgaatcattcattgctcaattaaactcctttaaatttaatttggctgaagtttctcttttaacaccagacctcaagtattcctcccttttcagcctcttaagtagctaggattacaggcacaagccactgtgcccagctaagcactttacattttgtagctaaaaccagaatttccatatgtggctatttaaatttaaattgtaaaccaaaaagtacctgagacaaatctcgatcaatttaggagtttattttgccaaggttaataacatgcctgtgacacaacctcaggagatcctgacaatatatgcccaaggtggtcaagctacagtttggctttatacattttagggagacatatgacatcaatcaatacatgtaaaatgtgctttggttcaggatgcagaacctcagtgcaactctatgttggggatgggggttggccctccaggtcttaggtgtattcaaagattttctgaatagcaattggatgaaagagtttctctaaagacctggaatcaatagaagggagtttctgggttaagataaacagttttggagatccaggttctttttttttttttttttttttgagacggagtcttgctctctttcgcccaggccggagtgcagtggcgcgatctcagctcactgcaacctccgcctcctgggttcacgccattctcctgcctcagcctcctgagtagctgggactacaggcgcctgccaccgctcccggctaattttttgtatttgtagcagagatggggtttcaccgtgttagccaggatggtctcaacctcctgacctcgtgatccacccaccttggcctcccaaagtgctaggattacaggcgtgagccacattattccaggtagcaggcttcagaaagaatagactgtaaaagcttcttatcagacctgaagagtctgctctgtcagtcttaagatcgcagttttaatgttaatgttggtcagctatgcccaaattccaaagaaaggaaggcaaaatgaggcatgtctgaccactcattcccatcatggcctgaactcgtgtttctggtttattttagaatgtccttgtccaagaggagggatccattcagttggttggggaggcttagaattttatttttggtttccaaaactatgtaaagttaagtaaaatttaaaagtttgtttcttggtcacactagccatatttcagatgttcaatagccatgtatggctagtggtttctgtatgagacagtggtttctgtatgaacatttccatcattacaggaatttctattagtcagagatgggctagaggaattctctaaagaaatctcatggggcaactagaatcacaagacaaaatgggtcagtataaagtaagatcttttagagtgatgtaagtctttgtctcagattcactaaatgatgagagaaaattcacaatagaggataactagagttgactcacaggctgggagtggtggttcacacctgtaatcccagcactttgggaggctgaggccagcggatcacctgaggtcaggagttcgagaccagcctgacaaacatggagaaaccccgtctctactaaaaatacaaaattagccggtcgtgatggtgggcacctgtaatcccagctattcgggaggctgaggcaggggaattgcttgaaccagggaggtggaagttgcagtgagccaagatcacaccactgcactccagcctgggtgacagagcgagactccatctcaaaaagaaaaaaaaagagtcgattcacaatagtcttcagttataaagataaaaagtgatctctcctttattatagcaattagccctaggttaaaaaaaaaaaaaagacccaacccaatgcaaagacctttatattttcataatatagctaaagccaaacttggattttctgcaagtgactgtcacttgtgcatttaaaacttgagtctcgctctgtcatctgtcacccaggctggaatgcagtggcgtgatctcggctcactgcaacctccacctcccaggctcaagccattcttgtgcctcagcctccgaaatagctgggattacaggtgtgcaccaccatgcctggttaatttttgtatttttagtcgagacggagttttgccatgttgcccaggctggtcttggactcttgacctcaagtgatccaccagcctcaacctcccagagtgctgggattacaggtgtgaggcaccacacttggccttgtttttatattattctgtatatttttcctgtcagacaaaggtctgagaattagctactaaaattctagcttcggcttgtggttttgagtgtgtaaaaaaatcccccaaggacatatggtgattcagccccaggaattatttaatttcaaaagcatataatctaaaataaaagtaaaaatttttaaaacaaaagagagagagagagcacacacacaattcacttgcttcagaaacaataaaaaaaaaagaaaatgagatcttctgtacttttaatattaaagaacgtcatataagtgtcaggcttaatggctgaaatctttcaggtaattatactgccaggacagttaaatatgataatgtaatgttagacctgagaagcatagtaatgttggcatagtctatacattgtcagttgttcaaacattatcttactagtgtaatacagcagttaaaaatatctttttatttttttcttaataatgttatatataactgtatttaaaaatgccaatatgctgctctgagttcctcacaggagccacaagtttttactttgaacaatctgttttttaaattgaaggttaaaattagaggtttaccattttgcctttgatcttttacttttatcagaaagtaagcgccattaattctggaatgccattggttgaagaaaataaaatatttcctatactttttttaaaatgtgacatttggacaaaatgtgatacttattagtaagaggcaataaatgtatgtcgcactacatagttgcccctcagtatcccttggggcttggtttaaggatctcccactgatataaaaatctatgcatgctcaagagtctgttgtaaaatggtatagtttttgtcattgtatacattgtactatttgtatataacccctgcacatcctcccatactctttaaatcatctttagattacttatcatacccaacaccatgtaaatgctatgtgaatagttgtcatactgcatcatttagggaataatgataaggaaaaaaagtttgtagatgttcattcagtacagatgcattttttaaaaaatattctcaatccactgtcagttgaatccatggatgcaaaaccatggatacagggggttgactgtacattaactttgtaactttttactctctgattaaatgctttcattactgagacttcctaaaataaattcctgaaaatgtaaaatggttattttaagtttgagagaagcaatgtaattaagaataatttaaagtctatttctgggactggaagttattggatgtgatccttaatccctaataagcaactatgtatcttcaaatattgaaaattgaaaataataataaagatcttgaaaatgtctaaatcaaatgccttggccaacctgatggcaaatatgtgtagaaatcaataaagccaataatgagcaaagatgcaaagaaggaaacaacagtaatatcataagatctccctccacttgcagcatcacaaggtggaggggtaatatggaaattgcaaatatagctaatgtttattaatcatttacacgtaccaggcaccaaactaattattcattcattcactcaacaaacatttatgaagcacttactgtgtgccagaaaatgtctagacatgtgggacacttcagatgagcaaagcagacaaggatttctgtcctcttgtagtttctattttagtagaagccacataaataagtaaataatgatgtcaaaagtactaaggataataaaaagagtagagtaaggaattcagagggtgccaagtagaggagactagttgcaacttgaaatctatgggcctcattgagaaggtaacttttgaacaaaagtgtgggagagaagagtgctccaggtagagacaatagcttgtacgtgacctagggtggagagtgctactgtgctcaagatgctacatggaagccactgtggccataaacgagtggccagggaactgggggaaaagagaatgaagaagaggtcagagaagtcactgaaggcgagactataaatataagttgaagatagagccaactgtatttcctgctaattggatacacacgcaagagaaggagtggagtccaccatatatcccaagattatagcttgagcaactgaaaggatgaaattgccatcaggtaagatagagaaagaaacaagtggagaagactgggtagaacattgaatttcaatttttcttttatctgaaaataaatttgagatttgatgagctttatttgatgatttttcatgaatttgagatgtctgtgggaagtccaaatggaaggatcaagcaggcatcttcatatatgagtctagagttcaggagtgatctgctctggagatacataattggtaactttgcacatatatgtggaacaaaattgggtgtgtgaaccaggtactaaggtctgggacacctgaaccttgactgataaagaagaatgggagttaccaagaacggagcagagaaagagtgatcagaaagggagaaaactaagagaaggtggcatcttgacctaagagcagaaagtatatgaaggacaagggaagaaagcaatcacatcaaacaccattcgtaagtaaaggaagagtgaataagatgaagactgagaattgaccattaaacttgggaaatagaagagtttcatgaagtagcaagggaaaatggctgattagaaggtatgtaataggaatagaagtagaaaaagtgaagaaagtgaacatgtagacaattagttcagagagttttgctgcaaagtgaaatacaagagtaaatcagtagatggcagggaagtggagtcaagagaagtttgatgacttattttaagatgagagatatctttgtattgtgatgggaataatcccacagaaagtgaaaaaaataaatgataacagaagggggctcaatattttttaatagtcaagaggtgatgggacttactgtacaaatcaaggaattggctctcataggaataaagcttatcctacctatcgcaacaggcaggaaagcatggcatatgggtacagatgctgctaggtctgaacagaagggagtagaagcatatatgtggaataaaagtgggttgacgttctgttctttacatatatcattagcagtcaacatgcccagcaactggggaaaccaatgagtaccaaggcgctgaaggagggagctgggtgatgccctacactgtccactacagtgacttaccaagtagtgagtaactaatctgctgatgggcaatttaatattgcctacagaaattctgatgaatatgaagcaaatacgctgatattaattctaacttcaaagtaagctgggctgatgatttcagttgtattttacattcatttcccaattaaatacagtaaaataatgtcattatcatggaggataaggttatttgagagttcagtgaaatcttgcaaataaagaactcagcatagttatggcacatagtaagtactcaatgaatctcaggtataagttaaatgaaacaatcataattctcagaaagtaacaatttatttttcattattgctaggtgtggagggagtggttttgttgctaatagtgttttgtttttatattgggggaggtctcgactgaagatcagaattagacttatctctcaggaaaaagttttatttattggtgatgtgtataatcattttaaatgtaagtctttcgctctttaggttttttaaaatcaaagaactattctaaagtacttcggcagtataattaagcctttgtttctctcttattcaaatctcttttaaatgctctgtgtttaccaaatttctctcttttgctccttaaaattgtttattattttgactcatttggcgaaatttaaagaaataatttttctccttttgaaaagaaaggtaaattaatttcttatggcaaagatgagtgagaggttaattttgccaaccaaagaaatttggagaaaacttgagtgagtgatttctttcattagcctgtgaacaggttatttatttcacatgtaattataaaacaagtaattctgaataaaaccaaccctgaaaacaaataggactcatttgcagttctaactgaattagatactgaaaaatgcttgcattctgatatgttttgaaaagtctaatgaaattataaatataatatttcagagaaggaaatgtgcagagacagcataacaagaagctcaatttcactttgccattcgaaacttttcttacctataagttggtgatgtgaaataattcaggaaaattgagtttcaacccaaatatcatgaggttgctaagtatatgtagtttataatgtgcacagtaggtcaaatcgatattgtgatccttagagttaaatgttttattggataaatgcagaaacccaagtttgactctaacagaagtttaaaataagttataaataagatttaatgttaacagcagggattttttctaaccataaactgaaaaatatacccatattaataagttaggattatgtacaacaatatatcaaaatcaaactgtccttttttttcttccaaaagaatagccaatgaactagttagagctagttaaatcagaataaaatccctttcacacacacacacacacacacacacacaattgaatagtaataaaataagaaaataatgttactgtcacttagaatcattgccttctaggttgaaaacaatggttttcctatgatatcttcataagttaatacaaatcaataaagtatataataatgacaaaagaaccactgtcctggtattagaaagaaatatctttttctaactctccattcatacaacatattttaaaccctggagaatgggacatttggggattgtgctctgagtcaagtagaaattcaaagaaaattccagtgataaaacaaactgtcccactttctctaagttactcataacagtgatttagtacataaatgaagtaactgtctacacttttgaggacaacatgtagttcactcattctgcttttttccccctttctttccctacattctcactgtttcagctgtagtacttttgaaagcagggtctgagacaaagacttgattgccaatcatttggaggagcatacaatcctaagaaacagaagtgcagaacagggcaagtgaaaatgaaaaggggcaataactgattccagaatgcattttcaagttggcaaccaaacaggtgactgagactcaagcccatggcacattctgaggaggcttcagagctgttttcctggaggatgaaagatgaaagcatttatctgtcagttccaacccgcatttggatgagagtgactcctcagacattaactgccctgctcttctgggttgctcatgcatgagtacgttgcaggagctcaataatgttcttcactcaaggcagtaagcagttggcttgtagcccaagaaaaggcactgttgggttccaactgccacagctagtggagggctgaatggaggccatcacaccacataaacaggggctggagttcccagtaaggcttagagaatggtgaaatgggacacaatagttgtctgagacgctcttcctcctcttgtaatctagactccttcaagctcctccacttatggctcacaaacattttgcttttgttgctccgtgcataccaaggtgattttatctcaatgcatgactcttatttttctggagcaggataaaaacaaaatagtgatatctttaacctaaagtatgtaaaaattctaaatagcagctttagaaagggcccatgcagcaaaactttgaatccttctaccttattcaagactttccatcacctcatgggatttctactcttggttcccttcattcatcctaaccctaacccttaagttagtcaagtgtcctgaaacaccatcctacccgcatcttgaattacctagcagaataaagaatttgtctaatatgtaagaccttttatggttcactactgttttgcaattcttatggtagaatgtatttcctccaaacatcagtgtcttagttcaggctgctgtaacaaattatcatagactgggagacttaaaccacagaaatttatttctaagagttccaggggctggaagttcaagatcagggtgtgagcttgttcaggttctggtgaaggatctcttctgtttgtatcctcacatggtggaaagagttcctgggatccttatcacaaggcactaattctatttatgggagagggggcttcattctcaggacctaatgaattccccaaatcccaacctcctaataccaaaacactgggggtcaggatttcaacatataaatttgggagagcgggacacaaacattcagtccattgtaatctgcgtgagctaacttgaatgaaaaatttcttttaacatttttgttggaaacattgacatttacaaccatatacatttttcatatcattttatttttgccaaaatgcttagtaatgattctacatgggtctgaatacaatttcaggtgattgttgttacatctttttggaaatcattgctaccacacttgagagatgtttagtttattagatacttgacccctgtaaatttttgcccctttctaggaaattagggtcttagtagagtgtgggtttctacatcataccaccagtgtttagagattgctgccaaaagtcaagacaaggaggaaaggaagcccgttattgaaaaaaaaaactggacaaacactaaaagtttaaggctgacgagtagcagcaaacaaacaggttcttcatcaaaacaaaagattgtctgcacaatacattgacaaacatgcacaaaattctcatttgtccaaaaagattggcactttggaggacaaaataaagagataggttctcaatcttgaagggagcactttatactctgaggacataagagagccatgtacaaacatttacataacttagaattaggtgtgaaggttccctgtaccattgaaaaaattttaaaaacagaaacatttttataaggctggagtcaaaatgaatggttttatggatttagaggaagacttgtagaaaatgggaggtgtgaatttgggctggtggaaaaggccagaaaatgcatttcttgtgaggaatagtacatgagtaattacacagacacacattattctgtccagtcacaatggcatttttccatttccctgagttcctctctgctgatttttcttcagatatttgaggtgctggctcccacttgtcatttaagtcttgccttaagaatgcctgtgtcatcttacttatgtagacactagtctctctgtagaattatgccttattttattttcctcaaaggacttgccttaactgatattgtcttgtttactttcttgtgtttattttgtctgccattctccactaaaatgttagctacatgagagaagagaacttttccatctttacctgctgttcaacagcaatttgaacagtactcaacataaagttcacgactgatcatatttcttggataagttggagaatgtatcacacatcgtcatatgaccttgcctcttccatggcaagaattgggccttcagtatgttcttttctcactctctctattaactagaggtttccttgattcatattcttttttcatttaaactctattcaacaaaaaaaagaaaaaactggtgactattttatcagataaaatactcttacatctgtcttataaaggtaagaatttggcaagatgaaacatcttgtcttttatatttacaatatgctaaatatgataattcaaaatgtattatggacatttaaaataaaaatcacacaaattttttttctctaatactgtctatctcctaagatctgctgctatcttcttacagctttgctaaaagagttttgaattttaaattaaatgtgacagccatattgttgtcattaaaattttctattaaaaaaccattttgcataacaaaatagttaataatttatttgtgttgattgttttttagtttttataaaaaggaatgtgaaattttattatatgaatcaagattaagaaaaatacaagaagtatttaggacttctaaaatgaggaatttgctccagtggttgagacaggaaatatgcaatcctgtggcccagtaattccttcatgggttttgcagtcacagaccacttcaagccctactttagaaattcacaagcaacactttaaagagatgtgattaaataaatacaaacttttcaccactcctgtaaaatgactcaaaattaatgtcctaacaattccagctttgtatttaagggcagcacattattatagagatgttaaagaaacttagattattattaaagaaatgtgaactgaggattactaataactgttttcaagcatataaaaagtgctgtaaaaatggttgaccagatgttttccatctacatggggacagaatcaaattaaatgatggcaaattataataagaaagaagtaaattacacctaaaaataaaaaaacatccccactggataagattatagattggcacagtcatctttcaccagttaagtacagcaatacttgcaggcagagaatgaagagacaatacctaccaggatttttcttctggcagaaatagacacaggggtctctaaataagaggctcactattaccacgataacaaaatacacacattatggtcttgttttcccccagttcatcattgtgcttttatttggaaccaggaaaagaaacaataaagtgaactgagaaagtgtgactaggttagaaaggttgaagaagatggaaataaatgaaggaagataagaatgcacagttaggaagtaaataatagtaaactcaaagactttttcaatacataacagttctgaagtcctaaactgatgacctagaaaacatcacaaaccaaagctccttgaaattcaatgcaatccatttcatatatgtgcatttagaaaaaatcatcagattctaaagcattcatctatcccaaaggggtggctgacttcaaaaagtttcaggatcttagactaaacattgctgtggactaaataatagtgttgctattccgatcacgattttaccttaataattaggcattagctagattgaagactttttttttttttcctggagctggactgagaaaatgtcctcagcaagatatcaagtgtctttcaagaactatttaaagctaaaggaatatcttgtggctcccagttaccagacattacagtttaggagagaaatgttggagctcattaaagagaaagaaacagtgcttctccaagtccatggccccgtcacctgcttctccttcccagtagaacatttagctctgtctttactgagtaaaggtaaggctttgtatttttgtttcctatctgtctcattccatcttttatctcaacaaaatacatccccaatactacattgtctgctaataaatgtgtaagctatatggtcactttgaaagaaacagagaaaaattaatggtctcgatgctaaatatataaatcaaataccaaatattatacctattcggtggctagctgtgatacttatgtaaatacaaatgccatggggcacctagtttaatgtagatttaataggcatgtacattgaaaatatagagtttcttgtttaaaactactctgcccttctacctgagcctcaaatattatgaaaaaataagtaaatgaatgcacattacactttaaaataaattttacctggtgctataaaccagcgattgcaaactttctatagggggccagagagcaaatattttaggctatgtgggccattcagtctgtaatggttaattttagatgtcaacttaatgagattaagggatacccagatagatggtaaagcattgtttctggggatgtctgttttgagggtgttttcagaagagactggcttttcatcaatggattcagtaaggaagatctgctctcaccaacgtgactgggcactaacaaatttgctgagggcccagacagaacaaaaagcagaggaaagaagaattcactctctctctctcccttctggagctgagacattcagcttctcctgcttttggacatcagaactccaggatctccagccttcagactccagggcttgcgccccttccctctctaccttcagccttggaccgagagttacatggcccactccctggttctcaggctttgcacttggaccgagccacactattggtttccctggttctccagcctgtggacctcatactgtgggatttcagccctccataatcacataagccaactcctctagttaatcccctcctatttatatctctctacatttataaaatatgtatttgaaatattttatatcatataatatacaatgatatataatatatgttatatttatatatatcctattggttctgtttctatgggaaaccctaatatgcagtctatgttgcaactactcaactctgtcattgtagcacaaaagcagtcatagacaatgtagaaaagggtaaatctggctgttttccagtaaaatattatttaaaaattaggcagcagctggatttggccaccaggcttatagtttgctgactgtggatttaaacagttcctttgggaaattttgctttttcattcgcccagatattctctcctttcacctatttttcttgcccagttgaaattcaagagaatgagtagaggcatcttctcatctgctaacctcagggccatgcttcctggctccttgcttctggcttgccctgctggctttggttctgcggccgggataatttgtaatctgggactctccaggaagggcactatgtggagctgcctggctgtcttggttctcctcagctcctttggcgctatgacttttcaggggtctggctgtgactgccgcttagtcttaggctctgcaggtcccacagctacttcatcacattatggcaatcccctctgacaagctttccagctgcatctacatcccacccatactatacataaaacaagggcaatttggagaactgtctcaagatctcaggtgtctgactatactgttggctcttcccatggtttgtgagaggccacttctatctcctttaaatattaccctaaattatgtgatactcctcacttagatcaaacccagagaacttccctcaatcctaaatcttgatatgtttaaaagcattaaaatttttttctctaaaaacaattgagtttgtatcttttactatatgtcagaaggtgaaaattacagtcttctttctcttcttagtccttctctaataaatctgaatttacttatcctacccacccccaaggtaaaatagatgacaagccagctaggataaaggtcatgcattgagaaagttcagaaaggaaaataatgtagttacatgttatgttaaatttcccctacaacagtcctcctagataggtattgttatactcatctagaaatgaaaaaattaaggttcacagaatttgctaaataaagcttgaccacctgctatataaaaaaacagaaaacctatctgtttctgactacactcctaattctcattcaaccacaattcctggaagacaggaagttaactcctggtaaagagcatggtttgtgttccagccccaaagcctccaaataaatgaacttctctccacctttgcatggaatcactgggattaaatgaggtaagtatagtaacagctatctttcatccagcccctgggtaagtcaggcagtttctaaacatttagatatattatctcatttaattctcaaaacaatcctataaggtattaaaattattatcatttttttacttaatgttactaaggtcctcaatatagagtctgccacatagtaaatgcttagtaagaactagttattcttaaaattattactcttccattagaattacaccaaccaataatatttatacagacatctttttccccagagcagaagcagtctttgataggcagcctttgtttgctcatactgtgaggaactcccattcttaaaaggactaaaagagcatcacacttaagaacaaattctggggtccacctacactgccattctcctcagctcccatgatgccagactttgctgggtgcagaggcccagaacataatggcagtgttggaagcaggaaaaagataggaaaggatgtgtaccaggatggccaagacaagccactgggtcaattcaatatccaggcacgatttttcccttttgaatttacatttgtttaagttttaatcctaacccacttgatgaattcaatttgaattcattttgaattcttaatatcacaacgtatttcctcattttatgaaaaggggagacactgtattatggaagaagtcttggcccagaagctaatatatgtggtttgtcatttctattgtgccactaaatatgtgatattagcactaatcgaaattttatgtatctatttgaaaatacaatcaaactatataataaggctataagactagatgttcataaagatacctcccagagaaaaattgtcttttgaatattttctattgtcctcggctcaaatgctaatgagtctcttcgtctttagtcaacataagacttgaaattgtttccattggcaaccacctcacaattattagttaaagagaaaccagctctaggctttgaataatccatcatttttagaattatttatgggtttcaattcctcatttgattttctttttaactgaaatataaatggaaggaatatgaactgtagtatctaagggtcttctttacctatcattatgttaatcatttaatataataaacacagagatatccacttcccatctcccttttgcactgtgccaatatttgcttcacatcagcattcactatttgcaatccataaaatcacatggtgaaaaaaaatatgtcctttttctttaaggatctcattaatactttgatttcacagttatcaactacaaaaaaaaacaccttttgtagtttctgtcattttgggatttcgaaagaatctgggtcttattttataccacaagaagcagaaacctcattctctcaatgcaatgaaattgttatagctgtaaatatatagttattgggatcttaggtatagtcatcccgtattgtatatgaccatagaagattcgtccttcttcattccaaacaaaccaagaaaaaaactatcaggttagaatgtttgattgaactttcatgcattcattttttatatttatttgttcaatacatatttactcatttagtagatatttatgtctcccgtgtaccagaaattgtgctaagtacaaagaatagaaagtcaaaacaaatttggttcatgcctccatggagcttatggtttaataggggagaaacacaggcaaatcaattatagtgtcattataatgcaagtgctatgtcaaagagatgcacagcagctatgggagcacagaggaggaacatctttcttactaagacaaaatctttcaaaggtatttattattcaacaggatttatatgttactttaacaattttttttgcttatgcattatttaagagggatactattcaaaacactatgttacataaatacatgaacttaaaaatatttagtgaacatttgttatatgcaaagttttggttaagttaccttgctggctgaaagaaaagatggaattcttatacataagaacaataaaaattaagaaaatgataatgagtgaaaatcacttattcccaaagagaacacctgaaaaaaaatatgttttcagaaattgaaggtcaaagaggggcaaagtacatcagagaaaatgagtttcttaatctcgtacagccagatttgcctactgaacacacagcttatgacaaaataattgtgcagtaattactctaaaagatgagacaaaatcaagttaaaatggagcaaattgccttttgcattgtggccaatgacaattagtgacacattcatgctgtaaaataccactttctttttgtgagaggtgacctattgctcgatggttaagtaactaggttacttcatggaaaatcttctgcaatcctgtctctcagaggaaatgcaaagtttattattgctactgctttggtggcaatttcatattcaataatgaaacaagtatacatcttaagtcatgcaagtgtaagtgcaacaatttttcccggtcatgtttactgagtgtttgctatgtccagggactatcccaggttacttacatgtatcaattcattttacatgcacaaatctagcatagtggcatttttctcagtttttagatgaataactgagacatggaaggttggggatgttgcccaaaagtttcacagagagccagatgtagatccatgatttgaaaccaggcatgctgtgtccagagtaagtgttgtcagacagaataatgtgccatgtgccccacatagtccagaaaccagtggatggtcttcctgtttacattttttaaatgtaagtgaagggttttttggttttattattatttttaattaacatataataatgtacatatttatggagtacagtgtgatattttaacacatgcatacttttgtatcaattcaccaacctttggctatccccctgccaccaacactctcctacctctagtaaccactattctgctctctgcttctgtaagaacaactttcttagcttctacatatgaatgagaacatacagtatttatcttttggtgcccaacttatgtcacttaatgtcttccaagctcagaatttgttcttttctatggctaaacagtattctattgtgtatattttctttatccattcatttgttgatggacgcttaggttaattctatatcttggttattgtaaataaaaatgaaatttttcttgatgacttaagcaaatgctcccaacttactgttaagtaaaagaaaaaaaaaagaaaagcaggagaaaagagatctttacctactggttctcattactgtttttaaaaataacatacatagttagtcattgaaagtagataggtaaatatatagttaagataaggaaatagatctatacagtaaaggctagaaattgttattaattctgtgagttgaagtatagactgctttcatttacttatgtgtgtattttcaaaatcgtatacaataaacattaagttaatataaaaatcacattgtcatatcagactcacttcaatgaaagactgtgtccagtatcaagctttacctgtagtttaaggatccaatcaatgaagaggcaagaagagatctaaaacatcctactagcttccacagccctctttttcacattagaacacatagtctctggttgagaataatagaagtctacaatgtcaccttacccaataggaagcatttatgttataaggcatctccattttattttttttcttcatagttcttttttaatttttttttcataggttattgggggaacaggtggtgtttggttacatgagtaagttatttagtgatgatttgtgagattttggtgcacaaatcaccaagcagtatacactgcaccctatttgtagtcttttatccctctcctttctccctgagtacccaaagtccattgtgtcattcatatgcctttgcatcctcatattttagctcccacttatgagtgagaacatacaatgtttggttttccactcctgagttacttcactaagaataatagtctcaaatctcatctaggtttctgcggatgtcattattttattcctttttagggctgagtagtattccaccgtatatataacccacagtttctttatccactccttgattgatgggcatttaggctggttccacatttttgcaattgtgaattgtgctactataaacattcatgtgcaagtatcttttttgtataacaactacttttttctggatagatacccggtagtgggattgctggatcaaatggtagtcctacttttagttctttaaggaatctccacactgtttgccatagtggttgtactagtttacattcccaccagcactgtagaagtgtttcctgttcaccacatccacaccaacatctattagtttttgattttttgattatggacattcttgcaggagtaagggtatcaccttgtggttttgatttgcatttccttgattattagtgatgttgagcattttttcatatgtttattggacatttgtatatttcttttgagaattgtctagtaatgtccttagcccactttttgatggaattgtttttttcttgctaatttgtttgagttcatcttagattctgtatatttgtcctttgtcagatgtatagattgtgaagatgttcgcttattctgtgggttgtctgtttactctgctgactattccttttcccatgcaaaaggtctttaatttaattaagtcccagctatttatctttggttttattgcatttgcttttgggttctcggtcatgaaatccttgcctaagccaatgtctagaggtcttttccaatgttatcttcttgaatttttatagtttcaggtcttagatttaagtccttgatccatcttgaactcaggtttaagcccttgatccatcttgtgtatagcaagagatgaggatccagtttcattctcctacatgtggctagccaattatcccagcaccatttgtggaatagggtgtcctttcctcactttatgtttttgtttgctttgtcgaagatcagttggcttgtaagtatttgggtttatttctgggttctctattctgttcccttggtctatgtgcctatttttaaaccagtaccaggctgttctggtgactattgccttatagtatacattgaaatcaggtaatgtgatgcctccagatttgttctttttgcttagtcttgcttccgctatgcagactcttttttggattcatatgaattttaggattttttttctagttctgtgaagaataatggtggcattttaatgggaattgcattgaatttttaaattgtttttggcagtatggttattttcacaatattgattctacccatccatgagcacgggatgtgtttccatttgtttgtgttgtctatgatttctttcagcaatgttttgtagttttccttgtagaggtatttcacctccttggttaggtatattcctaagtatttcattttttttattttttggcagctattgtaaaagtgctgagttcatgatttgattcttagattggtcattgttggtgcataggagagctactgatttgtgtccattaattttgcatctggaaactttgctgaattcttttatcagttttagaagcattctggaggagtctttagggttttctaggtatgtaatcatataatcagcaaacagtgacagttggacttcctctttatctatttggacgccctttatttctttctcctgtctgattggtctgagacttccagtactatgttgaggagaagcggtgagagtgggcatccttgtcttgttccagttctcagagggaatgctttcaatttttccccattcagtattacattggctgtgggtttgtcatagatggcttttattacattgtggtatgtcccctctatgttgattttgttgagagttttaatcataaagggatgctagattttgtggaatgctttttctgtgtctattgagatgatcatgtgacttttgtttttaattctgtttatgtgttgtatcacatttattaacttgcatatgttaaaccatccctgcatccctggtatgaaacctacttgattatggtggattatctttttgctgtgttattggattcagttagctaatattttgttaaggaattttgcatctatgttcttcagggatatcgggctgtagttttctttttttgttatatcctttcctggttttggtattagggtgatactggcttcatagaatgatttagggaggattccctctttctctatcttgtggaatagtctcaataggattggtgccaattcttcttttcatgtctggtagatttcagctgtgactccatctggtcctggactttgttttgttgttggtaattttttattattaccatttcaatctcactgcttgtttttggtctgttcagggtatctaattcttcctgatttaagctaggagggttgtatctttacaggaatttatccatctcctctagcttttctagtttatgcatgtaaagaagttcctagtagctttgaatgatcttttgtgtttctgtggtgtaagttgtaacatctctcattttgtttctgactgagctcatttggatttttctttcttcttggttaatcttgctaatggtctatcaattttatttatcttttcaaagaaccagttttttgttttatatatcttttgtttttttgtttgtttgtctctttcaatttcttttagttctgctctgatcttggttatttcctttcttcttctgggtttgggtttggtttgttattgtttctctagttccttgaggtgtgaccttagatttactgtttgtgctctttagatttttcagtgtaggcgtttagagctatgaactttcctcttaatgctgcctttgctgtatcccagaggtttttgatacattgtgtcactattgtcgttcagttcaaacaacttttaaatttccatcttgatttcattgttgacctgatgattattcaagagcaggttatttaatttctatttatttgcatggttttgaaggttccttctggagttgatttccagttttattctgctgtggtctgagagagaagcatctctattttatacttaagattgttgtatagcttatgtgacattccctagtgagccatgtctcataaatccatcaaagtttaggtttgtttacagtaagcaattctaaatcaagaacacatttctcaaagtagctcatagatagaaatgctttttttttaagcaaacgttcttagtctgttgccctgaggacccagttgttatgttaacaaggagattagaccaggccaccaaccttccttccccactccctaggggaatcccctgataatcaaaagaagtcacaggctagctgctttaactccttcctcctcaacaatatttttagaatttttttttttaacagaaggaatgaaaggcgggaataacactcaagccatcgtgtttgttttgaattggaggaaagcaagaccaacatcatttataatagtgaatgcttcattataataatacagaaaatgatataagcctaaacaatgaagtaacaatagcaaggagagagggaatgagatttaataaatatcacagcatttcaatggactcaatatagtaattgactagatgtaggatttaggcagttgaagaaataaataatgatttccagtcagagccttaggcaggtatatgaataatgtggctatttgtggccacagagaaaacagaggagcaatgtgtgggaagatggaggttctttaatagaagataagagaacttcgattttatttaaactctgatagaaaacaaccagtgaaaacatagaaatggatgatgtagcaaaaatatagaataatctgcagaatgaggtaactttacccatttagatttcagaatttaatgaggagggatcagccttagatgtgaggacagatgtcttttccactctggtgggagggaaaaaagcaagaatgttctctttgatgtattctcttctagtggcctccattttttctattgtgttcacaaaatatggaactttcttctgagtatttagcaacttggtaaactaaatattcacaagattgtttattaggaatgaaatcagagcaaaatataagatgacccttgaggatgttcctttcagactatggagaaagaaatggagccaaaaaatttcccgatataagaaaaatcctcccctccaaggttcgagaaatttgtctctctaagattagtgatttctctttcttggatatttacttctaaactctgcctttccaccttttttctaataacatcattttccaaaaagtatgttaattagttcattttcagattactcagatgcaagctgattaaacttgcctttttttctaaaaatctctttacttttctcataatctatacttttatcatattatttcttaggctgttgacatctttgtggcttattttttctatttcagttcttactagtttgttctcttattgtaaattgaacttgaagtttcagagctcctaattaaccacagtgatacatttttatttaatcccagcaaagctggtgctaattagtttcccatgagctcaaaagatgatcagcctgcaaaatttggtctgatgcagaaactgttgtcatagcaatgccccatctaaggtaatactctctctttgactcctgcagccttcttcttagtatgttaacgtccctgatatgcacgatggtgtttgttttgtaactgtgtattagggttctcagagaaacagaaccaacagtaaagagatttatcatatatatagaatacatataaaagaaatttatctgtatagaaagagatttattataaggtattggctcacacgattatgacagctaaaaagtttcacaatctgctgtctgcaacctggagccccacaaaagctgggagtggtttgaaggcctgaaacccagacaaccaatggtgtcaattccatttcagatctaagggctgagaaccaggaaacctgaggacagaagatccatgctccagttcaaccagtcaggcagacagcaagttcagcctttctctacctttttactttattaaggccttaaaatgggttgaatgatgtctacccacattagggagggctatctgctttactcagtccgccaatttaagtgctaatcttttccagaaacactctcacagacacacccagaaagaatgtttaaccattcatccaggcatcccatggcccaagcaagttaacacataaaattaaccatcacaaactggaagagcaagaattttatgtaaacataatagcaaaagattagaccaggttaccagccaagcctaatgttagaaaaaagggtgtaggaaagagtcaaggaggataaagcagttggtttcccatggattctctatcctgccctgtaaactggactaaagcctctatcattagcagatagaggaccagaaattaagggaaatgttctggaagagatgctgtgagtgtttcactgaattcaaagccactgaaaccagcaagaaagtttgattcagatagtcagttttccaactgcaacataaagccagactggcaactgcagagttagaggtcaaggaaccactgaatttgggattctgggcccacacatccaatagggaggagcagaaatgagcttgcatcagacagattctcagactagtggcagccaaatgataaagggcaagtagggtgggtgcagactgtaattcctagaaaagtttggaatccatataaaactcctgtggtcttttacagaaacaactggggaaagaaaagaaattttcagtggtaagatcaacgaaggatcaaactatcacaatatagtcagttaatatctgaccttatatagtagcttgatgagatccagggaatttggattataaaaatatacagggagggaattctttattttgttttaagtgattaaaataaatattttaaaattatcaactgatggtgttgtgtggaaaactctgggacataagtgaaatgtttacttacattctttcttatctctccccttattgtttttaggcaacttggttttttgaggttagttaattttgaaagctgactcaacaaagcagcacataaggaatttatctgaaagagaatgtgcctaggaggggatacaactatcacagaggccttggatcagcaattaatgcatcattaatccttgatgttccttgaatttcttcataaacaccccaataataaaacaaatctagattccttcactgttctgattcacctttctacactctcctgatggcacgtgaccactgttcctggccgttggcttccagaaagagaacagacagggaagtgttggtgaatctagtttgttctaattaacaatgactccagggaaatatatatcataaaataaattttcattcatataattcatagaagtctttgcaactgttaactggaatcttcattttctctctcttttgtgtgtgtgtgtatgtatatatataatttttagagatgggacctgacttgttgcccaggctagagtgcagtggcacaatcgtagctcactgcagcctcgaactcctggattcaagcaatttttctgtctcagcctcctgagtagcaagcaatcctgccttggccttccaaagtgctgggattacaggcatgagccactgcactcagttgtcaacatttattcttaaagcaatacgtgtgacctgaggcagaaagatgtacaccagtttcctcatctggaaaaactgatgtaattctaacccatatttcatctggttgtgagatttaaaggaattattacctgcaaaatgcttggaaccatgcttggcatatagaaagaaatatatatatatgtgtgtgtgtgtgtgtgtttaaacacatgcacatatatttttcatttaacaaatatatattatttgatatatatatatatatttgttaaatgaacagtaagaaatacatttttcctgaaaattaaatggtaaaatttatataaaaatcttagtctggtggtttaaacattggaaatgctgaatggttgttagctccttggtcagtcataacacatacgttgagagcaagaatatgacaagtatgatttaggcactagggactggaatctgagtaaaaacgcccaatctttgccttatgagcctggttacaattgaacagagatgacaacattaatcgtatactcacacaaatctaggtaaacttgatactgtggcaaatgctgtgcaaaaatgacacgtggtactataaaatgtgtacttggggttttgatttagtgtgttgggggaaggttgggagactgttcggggaaggttgggagactgtcaggaacttttcacaagctactgccagtagaactgagagctaaaaagtgaaaaggaatatatcagtaaagagaggagggaatctgctccagggagaggtgagggctggtggagcagctctgtgagagggacaagcatggtgatggagggaatgcaacattggcatgtgctgagactggtgacaaaagctgtgtccccatcatccagggctccttaagctacatgaagacttttaacattttttttttttatcttataagcaattggaattcatcaacagccctaaaacagaatggtaatatgtgatctgtggtttgaaacatcacgctattggaggaatccccaaattttagtgtacatctaatgttgacagtggggtgttaaagtctcccattattattgtgtgggagtctaagtctctttgtaggtctctaaggacttgctttatgaatctgggtgctcctgtattgggtgcatatgtatttaggatagttagctcttcttgttgaattgatccctttaccattatataatggccttctttgtctcttttgatctttgttggtttaaagtctgttttatcagagactaggattgcaacccctgcctttttttgttttccatttgcttggtagatcttccttcatccctttattttgagcctatgtgtgtctctgcaagtgagatggggctccggaatacagcacactcatgggtcttgactctttatccattttaccagtctgtgtcttttaattggagcatttagcccatttacatttaaagttaatattgttatgtgtaaatttgatcctgtcattatgatgttagctggttattttgctcattagttgatgcagtttcttcctagcatcaatggtctttacaatatggcatgtttttgcagtggttggtaccggttgttcctttccatatttattgcttctttcaggagctcttgtagggcaggcctggtggtgacaaaatctctcagcatttgcttgtctataaaggattttatttctccttcacttatgaagcttagtttggctggacatgaaattctgggttgaaaattcttttctttaagaatgttgaatattggcccccactctcttctggcttgtagagtttctgccaagagatcagctgttagtcagatcggcttccttttgtgggtaacccgacctttctctctggctgcccttaacattttttccttcatttcaactttggtgaatctgataattatgtgtcttggagttgctcttcttgaggagtatctttgtggcattctctgtatttcctgaatttgaatgttggcctgccttgctaggttggggaagttctcctggataataccctgcagattgttttccaacttggttccattctccccatcactttcacgtataccaatcagatgtagatttggtctttccacatagtcccatatttcttggaggctttgttcgtttctttttattcttttttctctaaacttctcttctcacttcatttcattcatttgatcttcaatcactggtaccctttcttccagttgatcaaatcagctactgaagcttgtgcatgcatcacataattcttgtgccatggttttccgctccatcaggtcctttaaggacttctctacactggttattctagttagccattcatttaatcttttttcaaggcttttagcttctttgcgatgggttcaaactttctcctttagctcagagaagtttgatcatctgaagccttcttctctcaacttgtcaaagtcattctttgtccagctttgttctctcgctgatgaggagctgcgttcctttgaagggggagaggcactctgatttttagaattttcagcttttctgctctgttttttccccatctttgtggttttctctacctttggtctttgatgatggtgacatacagatggggttttggtgtggatgtcctttctgttctccttctaacagtcaagaccctcagctgcatgtgtgttggagtttgctggaggtccactctagaccctttttgcctgggtatcagcagtggaagctctcagaaggcaagatataactaagatcagagcagaactgaaggaaatagagacacaaaaaacccttcaaaaaatcaatgaatccaggagctagtttttttgaaaagatcaacaaaattgatagaccactagcaagactaataaagaagaaaagagagaagaatcaaatagacgcaataaaaaatgttaaaggggataccaccactgatcccacagaaatacaaactacaatcagagaatgctataaacacctctatgcaaataaactagaaaatctagaagaaatggataaattcctggacacatacaccctcccaagagtaaaccaggaagaagtggaatacctgaatagaccaatagcaggctctgaaattgaggcaataattaatagcttaccaactaaaaaaagtccaggaccagaaggcttcacagccgaattctatcagaggtacaaggaggagctggtaccattccttctgcaactattccaatcaatagaaaaagagggaatcctccctaactcattttattttggtgttatcctgataccaaagcctggcagagacacaacagaaaaagaacatcgatggaaaaatcctcaataaaatactggcaaaccgaatccagcagcacatcaaaaagcttatctaacatgaccaagtcggcttcatccctgggatgcaaggctggttcaacatacacaaatcaataaacataatccagcatataaacagaaccaaagacaaaaaccacatgattatctcaatagatgcagaaaaggcctttgacaaaattcaacagcccttcatgcaaaaaactctcaataaattaggtattcagtggacgtatctcaaaataataagagctatttatgacaaacccacagccaacatcacactgaatgggcaaaaactggaagcattccctttgaaaactggcacaagacagagatgccctctctcaccactcctattcaacatagtgttagaagttctggtcagggcaatcaggcaggagaaagaaataaagggtattcaattaggaaaagaggaagtcaaattgtcactgtttgcagatgacatgattgtatatttagaaaaccccatcatctcaacctaaaatctccttaagctgatagcaacttcagcaaagtctcaggatacaaaatcaatgtgcaaaaatcacaagcattcctatacaccaataactgacaaacagagagcgaaatcatgagtgaactcccattcacaattgcttcaaacagaataaaatacctaggaatccaacttacgagggatgtgaaggacctcttcaaggacaactacaaaccactgcttgacgaaataaaagaggacacaaacaaatggaagaacattcgatgctcatggacaggaagaatcaatatcgtgaaaatggccatactgtccaaggtaatttatagattcaatgccatccctgtcaagctaccaatgactttcttcacagagttggaaaaaactactttaaagttcatatggaaccaaaaaagagcctgcatcaccaagtcaatcctaagccaaaagaacaaagctggaggcatcacactacctgacttcaaactataatacaaggctacagtaaacaaaacagcatggtactggtaccaaaacagagatatagaccaatggaatagaacagagccctccgaaataatgctgcatatctacaactatctaatctttgacaaacctgacaaaaacaagcaatggggaaaggattccctatttaataaatggtgctgggaaaactggctagccatatgaagaaacctgaaacgggatcccttccttacactttatacaaaaattaattcaagatggattaaagacttaaatgttagacctaaaaccataaaaaccctagaagaaaacctagacaataccattcaggacataggcatgggcaaggacttcatgtctaaaacaccaaaagcaatggcaacaaaagccaaaatagacaaatgggatctaattaaactaaagagcttctgcacagccaaagaaactaccatcagagtgaacaggcaacctaaagaatgggaaaattttttgcaatctactcatctgacaaagggctaatatccagaatctacaaagaactcaatcaaatttacaagaaaaaaacaaacaaccccatcagaaagtgggcgaaggatgtgaacagacacttctcaaaagaagacatttatgcagccaaaaaacagatgaaaaaatgctcatcatcactggccatcagagaaatgcaaatcaaaacaacaatgagataccatctcacaccagttagaatggcaatcatgaaaaaatcaggaaacaacaagtgctggcgaggatgtggagaaataggaacacttttacactgttggtgggactgtaaactagttcaaccgttgtggaagacagtgtggcgattcctcaaggatctagaactggaaataccatttgacctggcaatcctgttactgggtttataccgaaaggattataaatcatgctgctataaagacacatgcacatgtatgtttattgtggcactattcacaatagcaaagacttggaaccaacccaaatgttgatcaatgatagactggattaagagaatgtggcacatatacaccatggaatactatgcagccataaaaaaggatgagttcatgtcctttgtagggacatggatgaagttggaaaccatcattctcagcgaactatcgcaagggcgaaaaaccaaacactgcatgttctcactcataggtgggaattgaacaatgagaacacttggatacaggaaggggaacatcacacaccagggcctgtagtagtgtcaggggagaggggagggatagcattaggagatatacctaatgtaaatgacaagttaatgggtgcagcacaccaacatggcacatgtgtacataggtaacaaacctgcatgttgtgcacatgtaccctagaacttaaagtataataataaaaaataaaatttagtgtacgtcagaactacttggagggctcgccaaagcatgttgctaggcctctttccaaagtttctgatttcatatgtctgggttctggtagaagaatttgcctttctaacaggatcccagatgttgctgatgctgctgatctagtgccatcctttgaggactactgatctactctactgtgaacaaattgaaaggatcaaaagggagcactaggtggaccacttagaaagaaatgtccgtcttccatacaagaattgatagacatttgacctagggaaatggagagaagtctactaatataaggaatatttaggaggtaaaattggcaggagtcgatgctaggttaggtgtggatatgaaggaaaagacgatgtcaagatgtcactgggttagttgccctaccttatcatctagaatgaagacattctcatttataaagtccaaaaggctagtaatctatcagcccaaaatgagagttttggattttttttttttttaatctgttggctgcaagggactaaacctgacaataatcacagaagtgctggtgctgacagctaagttataaaagactgctggcctcaaagggtgctggaaagcttgttctgaaaaaatgccagcaaggcacctcctggccctgtctgtggtatttcccaaaggcacgtggagcatgagccaggttacatttgggctcagtgtcagatctcatggctctagccacagctgaagccagtaaatagagcttctaaagttaataaagacagtgatgaaggactagtgattgagtagagaggagagagagcagatgaaagatcaaactaaaagaggctaatccctgaatttgtaaagaaaatttcgaagagagagacagtagaaggtgcccaaaataaagaaatttgcagtacaggaaaagcggtagttggcagctctcttgccagtagaaacaaacgtctgaggcaaaaatgaaggaagaagaaagaattttaaaaagacatgcattggactgtctaaagacaaacccactgcagaaatgaatcagggatttattattaccagagagagttctgaggaatatttaggaaaagtgttggtgatcaaaattggtgtcatttggtggcaacttcctcagggcttgaggaaataaaacaaaggcttacccttggaaataccagggattatatataaggatctttgagaaaggttcacaaacacaaattttatagcattccggagatcaaccagtgtcttcgtgccaaaaagtaaagggcatttttcccaaaggcaagaggcatttggctcagaatttaatggagaaaattgtgggaacttagaggaggaatgcccattagagaggttcaatagaatttgaagtttcaagggaatttttgaaagcgcagtgatgaatatataaagttttataggactttgagacagaatataatttggtgtataatagctaaagcgtaaagcttttgtttttaatcttgcacgtgttcttagcataaaaattgtagccaggagtaaaagcaaaataaaacaataaccaaaaaaaactaaaaagataagccacccaatttaaattataagcattcatgtagtattcagatttttgcagaatcctgtactaatactatgatagtgaagatcacaatgattatatggggagcaaattattctttgaacctgcataaacagattactaatagttgagaatcagataacaccaatggcttatataaaataaagagatttctttgtatttttaagaatttacatatagtgttgttgtggggtgttttggcttatttgaaaatacagataattatggatatattttgaaggattcaagatacatactttggatcctggaatattaggggaagaagacggggaagcgattgccagtgtgggaatagagaggtggtgatctctttcctccccatcataagggtcatggccagcaaccctctaacaaagacagattaatagaagaatagtctaatataatagatggattaatttaaaaattaataacagcataagaaacttatttgatcatagctttatgctacatgggagccttcagaattaagactcgaagacttaaggtgaactattcatttttatgcttgggattaatgaagaatggacagtcatatggaaatgtgattgggcaaaaatgatctgacctaataataataaacaaaggagggacgggcgcagtggctcacgcctgtaaccctggcactttgggaggttgaggcgggcagatcatgaggtcaggagatcgcgatcatcccagccaacatggtgaaaccccatctctactaaaaatacaaaaattagctggtcgtggtggtgtgtacctgtaatcccagctacttgggaggctgaggcaggagaatcgtttgaacccggaaggcagaggttacagtgagctgacatcacaccactgcactccggcctggtgacagagtgagactccatctcaaaaaaataaaataaaataaaataacaaaggggagaaatccagcaagaccagtctgttaagattcttcttggcttctctttagcattccttccttctggtaagaggcaagatcttctctggaatgcaggtcttatgacctacaatcaaataaggtaggtcagaaaatttcatggccagttcttacacggaaagatgggtgaaagttgtagtaatatttttaggttttattagtggccttggaggaaaagggttcttgtttctatgactgccttgggaaagagggattctagtttctactgcttgctttaggagataatgagtggtgaaagacaggagagcagtagaaagtcagacagaaactttgtttctgaggctgcttctgaggcctttgctaacttgtagctctcttgccagtagaaacaaatgtctgaggcaaaaatgaaagaagaaaaaagaattttaaaaagacatgcgttggactgtctaaagagaaacccactgcagaaatgaatcagggacttattattaccagagagagttctgaggaatatttaggaaaagtgctggtgatcaaaattggtgtcatttggtggcaacttcctcagggcttgaggaaataaaacaaaggcttacccttggaaataccagggattatatctaaggatctttgagaaaggttcacaaacacaaattttatagcattccagagatcaaccagtgtcttcatgccaaaagtaaatggcatttctcccaaattcacccttcaatttgtcagtgattcatttcttgtctttggagttggtatgaatttatcttgaagatccacaggttgatctaaagttctgttcaaatggtctatgtatttcacatatttttaccagctatcaaaaaatctcattaggaatggtttaatagtacacatacacaaaaaaatagtaaatgtactatacagtgactgtcaaatgtcctgatccaacaagtcctaatggcataagggaaaatctcttccaaccccaacatcctgctaatgatgttgggataggggaggtgggttgaagaggtaggtagtggctgcaatctgggaataatgccccaagtcacaaattacaagctcagctatcctgttccatctccacattttaagcaagtattgaactttgttctatagcatgctcctgtttctttccatttaaaataaggattcaatacctacctccaccaaaaatcaaaacttacagtaggactgcctctccatgagggagcctcctgttctccttagttacacatttttctccctaataccttgatatgtatctgtggttggagaattacaactctaatctttttctatttcaagttatcttccattctttaacattcagtagagtgttctttttttttcctttttttttattattattgtactttaagttttagggtacatgtgcacaatgtgcaggttagttacatatgtatacatgtgccatgctgctgcgctgcacccactaactcgtcatctagcattaggtatatctcccaatgctatccctcccacctccccccaccccacaacagtccccagagtgtgatgttccccttcctttctccatgtgttctcattgttcaattcccatctatgagtgagaatatgcagtgtttggttttttgttcttgcaatagtttactgagaatgatgatttccaatttcattcatgtccctacaaaggacatgaactcatccttttttatggctgcatagtattccatggtgtatatgtgccacattttcttaatccagtctatcattgttggacatttgggttggttccaagtctttgctattgcgaataatgccgcaataaacatacgtgtgcatgtgtctttatagcagcatgatttacagtcctttgggtatatacccagtaatgcgatggctgggtcaaatggtatttctagttccagatccctgaggaatcgccacactgacttccacaatggttgaactagtttacagtcccaccagcagtgtaaaagtgttcctatttctccacatcctctccagcacctgttgtttcctgactttttaatgattgccattctaactggtgtgagatggtatctcattgtggttttgatttgcatttctctgatggtcagtgatggtgagcattttttcatgtgttttttggctgcataaatgtcttcttttgagaagtgtctgttcgtgtccagtagagtgttcttaaagaacgactggaggtaatctcttaacagaaaattgaatcatgcataccaagtcttgttaagcagcacttttaacccagattctgttattttttatggtaaagtctttaagttacattctctcatagtacttgaaactactaaaaataattgaaaaggtttaattatcctatttactgttacaatttgctttgtgctatatgtttattgctatctctggtgagctatagtaacactgctgcaggtgtttttaaaataggtagtattgattatcagtataagacatgttaagtatccaactgaattttagtcatgaggaataggtgaaaaggattctgtcaaggagatgtcaatttggccccaagaggcaaactttttttgacagttccgtacaaagtagaggttactgagtaactgcccctattatttagtaactgaccctgacagcactgaaaaattgaggggagggggtgagcagagagttaagaaggataacctcaagttatataaaatatccaggaagcatgaaaactggaaaccacacagtagaagaaacgtcgtttctgtctagtgatcaattcctcgtttggctaatgagagagagagagagactgagacatggaactaaaatgttctggatagatgctaactttgagacaaaacagagaggcaaaactgggagattttgctcttctagtggtaggaatagccatatgccaattttaatgggagtaattccatagagagctccatgctaaatgcacagaggaagaaacaaagtacgtattcattcattcacatttggctaatttttgtatatctggttacctaccaagcacagtacttgtacatagttgagatgcagcaattcacccatttattcatatgagacatacagcatttattaagcatctactacattctggtgataaggatacagcagtgaagaaaacaaagcccctcacaaagcttacattctggtatcactaaaatgattgcatattctggctgcaacctggggaatcagtgatctaaaatgttaattatcaagtgcccagattctaaagccaggtggcctgggcttgaaaagtattttgtgccattaactctctgtgtggttttggacaagtcacttaatcattttgggcctcagtttctttatcaataaaatggggatataatgagttaataggtgtgtgtgtgtataagttaatataagtgctcagatcagtgtttgacactaataagtgccatatatatgtgtcagatacccttgttaaaagaaattaatctaaattcaactcatcgttaaatagttcttaattacagaataaaaggtagagaccagggaaatcaagacaacaaaacttgagataccaatagcaaatggattattcacgtttgtattatttgttcaaagtagattacagaaggaaagagagagcacaatccagtggttaagctggttacttgtatctgtggcctgcaatttcctcatctgtgaagggatgagaaaaggtgtcctttttaggggttctagaaggattaaaggaaatgatgtgtgtaaaatgcttggcacaaggcctggctaagggtgagcatttattaaatggtggctatttcatttataacctgattatattgaactgacatcatttatttaatggtttttgccattgcatttcagttcaaaaaggatttaaggaaacttttaatcagagtatttctaaaaacattaaacattggtctcacaggaagaaaacactgcaacagtcagtcaaatcattcatattaaaagttaatgtttttccaatgaaaagagaccctttcagtaaggtttttcagtctgtaagttctggagtctagatggaattgagagattgtccaattaaatttatacttaggatcaaatgcaactaaacttccataaacgtactcttgaatcacatcacgatctatttctaatatttattattgctgaatttttgtatttttgcatctgtgttcataagcacaaatgactttttttttttaaacaaagtcatatcttgcttgggtaacaagattataattgacctcatgagctaagcttctttcttaatttttgtattttccaaaataatttttaaaaaaggtggatggtattcctaatttattgaattgttgatatcataggaaaaccatttagacctagtatttgcctttagttgttgttgtttatgaattccatttctttaactgttaactgctgaatcagaatttttctttcacaaatattggtatttctgtatttgtacaaaaatacaactatttagtcatatttcaaatttttcaacataaaattactcaaaatagttacttcaatttttatctatgctaaatcaacaattatttgctatttttggtattacatttgaatttcttttttcttcattattcttgcctaaagtttgagtattttcaaatattgtgacattattactcatttcaaatttctggcccttaccttaacatttttccttcttatttttttagcattttaccatttttctttgtatagcttcttgagttgaccgatttgttaattttctgaaatgtgtgcaaagctataatttccttctgtttaaatatacaacaaaatttggcttgtagaaccttcagtgtcatttaatgtcatttaattctgaataactgaaatttccttcataattctttcctgattttctctgtattccaaggattgattaataatttagcacctagacatatttgatatgtatcttttgttttcattttcttattgactatagaactgaaaccaactttgacaggaagctgcaatctctgattccaataccttagttctgggagtgatctagaatgcagtgtccaaaatctttggactcacagtcaagctttgctactcagagagtctcatatgctttaagaaaaactacatagcaaaagaaggtgctttttttaatgttcacatatatttaggtaattaaatgaaggataatttctcccgttttttggaaggaaacatctaatgtttctatgctagtttctgtcaaaatttcaaaatactttaatgagtctgaaatttataggccatattattttcgtaagagaagcaacatgaatttcaaatgacccgtgagaattttatcaataaacagtttttgcaaatatatttttgtgttcatagccataaagaggcatgaatgccgaagagaaaaaaacttgaaaacacttttttctttaaaaaaaaagccttcactcatctttttagccacaatctgctaaaattcatgacatcaaagttgttcttcatgaaatatagcccttttttgagaatttgtttatttttataataccgatatcatcttaatacaaagaaaaacttttttaaagcccttaggctatgtaagtgagaacgtttttccaatgcaaatagaacatttgattattacatcttggtagatattggatgtactaacaaattattaaaagtaaacaaagaaaactgtaagaaaaatatataaataaaaacaaaacactgtgagttttgaatttataaaatttgcctgagtgtacttgttttttaaaaatgtatcaaatcaagagttgccatttttttaccagatgattatactaatgcatttgcaaactgtgaaggtaaatttataacgagaaaaacaaaaacataacgtttttaaaaacagtttagttttctaacgaattccatctgaaccacaaagttatggtacagtctcaatatgcgagtaaataagtgattatatcaactgggagatgttcacaaatctgatgtggttacaaaatactaaaaattttagtcatggctttagcgatgacagtctaggttgtgccacttttctacaagcaaataaaagtagaacagttaaggatagcattgaaaaaaacgttacttggtttgaagatatgctggtacttttagaagagtttttgggaaacttccttttgaaagctgtttcttggctttgaggaaagttctgtttctctcaatggtttgataacactgaaaaggaaaatgcagttgattactacttgtttatctcatatttatgattttaaatatatctccaatatatttatgattttctcttcattcccaccgctacctccccttctgtctttctctatttcgtaggaaaaattatgacatcaacatccaaaggaattcttcgcccatttttaattgtctgcattatcctgggctgtttcatggcatgtcttctcatttacatcaaacctaccaacagctggatcttcagtccaatggaatcagccagctctgtgctgaaaatgaaaaacttcttttccaccaaaactgattattttaatgaaactactattctggtgtgggtgtggccatttgggcagacctttgaccttacatcctgccaagcaatgttcaacatccaaggatgccatctcacaacggaccgttcactgtacaacaaatcccatgcagttctgatccatcaccgagacatcagttgggatctgacaaatttacctcagcaagctaggccacccttccagaaatggatttggatgaatttggaatcaccaactcacactccccaaaagagtggcattgagcacttgtttaacctgactctgacttaccgccgtgattcagatatccaagtgccttatggcttcttgacggtaagcacaaatcccttcgtgtttgaagtgccaagcaaagagaaattggtgtgctgggttgtgagtaactggaaccctgagcatgccagagtcaagtattacaatgagctaagcaaaagcattgaaatccatacctacgggcaagcatttggagaatatgtcaatgataaaaatttgattcctaccatatctacttgtaaattttatctttcctttgaaaattcaatccacaaggattacatcacggaaaagctatacaatgcttttctggctggctctgtacctgttgttctgggaccatctagggaaaactatgagaattatattccagcagattcattcattcatgtggaagattataactctcccagtgagctagcaaagtatctgaaggaagtcgacaaaaacaataagttataccttagttactttaactggaggaaggatttcactgtaaatcttccacgattttgggaatcacatgcatgtttggcttgcgatcatgtgaaaaggcatcaagaatataagtctgttggtaatttagagaaatggttttggaattaaaatttttcatcacttgcacacttgataaatattttgatgagatatcatccaagtattgaggataagaagagatgcaacatactacttttgtgtcacaatttatttttatcaccctctctagggtaacgtgtatattttggtggagatttttaaaagctcagcatgagcaatcattccattcggttttaaattatcctgtatatacctaattatgtgcactggagagtaatttattcttcattatcatttgtaaacattgttttttcacatttttgtagttgtccataatgtaagcttgtggtttgattattgtttccacactgatcagctgtttaatctatttgggaaatgaagatgcacatcttaaagtatgaaaaattttcactaagtattacaatgtctagttccaactttgcatactataacagaggaagaacatgttgcgattgaattctaacctctttgactccgaagatgaatgaagtgtataactgtctctatttgatctattttttttacctgtttatcacatttgtgaaggtgaaattattcatggagtgaataagaaagatatgaagcagaactgttctattcgggaagctattagacttctcatttattttcattaagctgatttgcagctacttattctcatggtcttaaattaaattattcaagtatttttaaatatccaatttgttgtgattttcagcacctgggaagtaatcccaataatactttagaaaatctaagacagttctttctgctactgatgacactcattgtcataataaaacaaataatttcctcaaataacaaagaaaaatgatacctataaatatatttataaatggtgtcatttatgaacaatgtttaattatgtatcaatttaagatttttttctgaagccctaatatttaaaatggtcttattttaccatatggatataagatttggctcataatgatgagccctatcatttgatttgagttctatcatttaagagagcctaaataaaattatcatcaaggtattaaatataagacgttaaatataataaagtggggatatatagaaaacacacagtgttagcacacagtaagatctcaatgcacatttgttggatgaataaataaatgcaattgaattcccagaaaaatgattgtttcaaggaagtgacagttctactttagaagtactaattggagatgacttttatatcccattttggtaattattcatacatagcacatatgaccatgatgttcagggctttatagaaccaaataaacctaccattacatgaaaattttgaagagtatattcctgaacttgcagctgcctatagcattctcctccataaggctagaggagagctggatataagcagagatcgtaggtgaaaaaagatgggccattaaggattcttcaaggaaaacattcctcaaaatgatctttagtgcctttattcctttcaggccaataatccacccaaaaattagaatgttctgagacatccatttgggtctatttgtgacttattcgtattacaaattgacatcagcaaaattcaaaaagaattcagtaaaaagggcatagatccagctatccagactatcttgtgagagaataagctcaccccagcaccagaaagatttgagcagaggaatattcctgtaatgaatagaggattgtttgattctcaggtatatttcttaagccaagattgaatgcagtgtcaggcactgccttaacacccacagagataagatgaacaaggtactatcactgcctaaaatgagcttacaattaagtggatagacatataaaagcttcctttcaattcagcctgagactgtttatatgcatgtgctactccgaatgacgtttgtatgggtcaatgctgatttaatggggaaaaaaagtagaaaatttccccaattgcttagctgtttgacatgtttctgagctgcaaactttgtcaactcttttgacccaacatattattctctccgtattatctcttctaaccacaatgcattaagaaataatatttttatgtggatgtcctcctcaataagtaaagatctccatccatatttaattaattggtaagacagtcaaattcatacatttacatttactttgtcaaattttttggtctataaaaagcatagagatctaaagaggatacactgctaacaagtttagaaagcacctgcttttttttattattattatttttgtgatagagtcttgctctgtcgcccaggccggagtgcagtggtgcagtctcggctcactgcaacctcggcctcccaggttcaagtgattctcctgtatcagcctcccgagtagctaggattacaggcgtgtaccactatgcctggctagtttttgtatttttagtagagatgggtttcactgtgttggccaggctggtcttgaactcctgacctcaaatgatccacttgcctcagcctcccaaagtgctgggattacaggtatgagccactgtgtctggcccacctgttttttttgaaggcagaaaaacattcaatattaaaagcattcaatattatttcaacctgccttggctctagtgaatgttcatgatttgaaagaactgaaagacctaaaggcagtgtctctattgttgactacaaatgtaggctctttgttggactatgactataatcacacactgataatatgacgcaagtagaggcagtactactaagtatctagcaggtgctttgaaaccccattactaagtcccagaagactgtttcctaaatttgaagtggaagaattaaatgactcaatggaaccctttagctgtgggtccattgatgtgtgagttttagagctggaaggaattataattttgttgtttataattgctataatatagaaattataattgcttttctttctacttatgagttaactagatccagagatatttattcaagacacacattcacacacacatacacacacacacacacacaccccacagctagtgacaatagttaagatttggatttaaggatcctatctttctttatcccactttcttttcaatcgcattcataacttattatagaattatgtctcaatttttacaaatgtgaatgtcttattggtatttttagggcctatagaatggtacacctcatgtagaagaacttcgacttttgaaggtatacaataaataaaacatcaaacttgttagcattcgttctggtttaaatattttaggagttgagttcagcagaaggaaatgggctatcactacatttaagtgaaatacaaccctcaagaaagtgtatggttcacagccactcctttaataaatcctgtgggttgcaattctttgtaagaaactcatgaaaaagatatattgattcaacaaaattggtttgctgttgattatacaaaccaataattatgcctagaattaaattgtggacacaaaaaagggaacagaccatttaaaatgttttatttcaaaatatcgaaaagctattaccttcaatactctaaatatttaaatattaattattgtagacatcagtaagaataaataaatgttaatcattatagaccttactaataagaatatatactgaattgtccacatccagagtattacaccctgaacaagaaagacatgagagcctgacagtcatatatattatgacagctgtatatctgacaatatgaagtagaaactgaaaaaaaaaatcatcttagtgggaaacaaatacatgcttaaaattgttatatttactgtaaaactcctgataatcttagattgtgcagaaatgtttcttattttgaggggcttagaaagctcagcgcatttgatgtataaagcaacagaatatttaggaattatttgcggaggctttaaattcttacctccaattggaggttaaatattaaaagaataggaaactatgcctctgatattttttttgtcagcctatttttaaactagattccatgagtcttaaggtaatatcctagaattttttttttgcgtgaattaaagttaccacaaatttcaggtccttaccttatgactgtgtttgatcatatctttgagttcccttgaactctgatctcattttgagaaacattttgagaaacttcttaacaattacaatcgagctgttaaatataacaaacatcagaatctaaaggataagcacagtgcctaatgtacaggagggtcatatcaaatacttgttgaataaatacatgaatgtgataagtggtcctgtaaaatattttttaagagtagtgacaatgtttattggtaccaattggagatgatattttatatttattttgttagtttgtcacctggatgcaaaaggaaggcattttaattcctttctatcttacaacattgtaaagcatcaaaagaagtaacatctcaagaaagattagaaaggatttggatcacgttaacattctatgcaaatattagtaacatatcaactgtttctaaaaggaaagaaaattagtatttaaggagagtataaagtgcgagcactgtgaagggcagatatctattaccaaaccacatggagagaaatatagtctctctcctaacttcattccattgtattgcaatcagtcaattaaggtgattttttttttctggatgtctcaatctagagattttgtagcattttgcaaatgggtatgcttcactactatccacagtgttctcccctttagtaattcatattgaatatatccatattcatatgcattttataaaacagttaacagaatctaaataagatatagccggctaaatctggaatgtgagtgctaccctaggttattagttcaacaaactaattttgagagagccacttaacctctctggaccttgtttgtaagctttcttctagcactattactcttatctaagatcgaaattgatatatgcatgaaattcctaatggaatttcaatgtccatctcaaagtaattttttaggatattccatacagatttccttctcatttctctgtgtagatatttaaagtatgaaattgattatttaaactaatatgtggaaagaacctaatccagagcttggaatatagaaagtgctcaattaactgacattcctcctgtatttcctccctccccttagttgtctatgacttttgaactcactgctcactgacatcttaattgcctgcagaaaaatcaatcatattttaggcattattttgaaatattttagagttttctgtactattcaaactcttattacaaaaatctaaagatatttattgatgcaaaaaatttagggagtcattggaaatacctgaggcaatcccaggctaacaataaaatagcataattttaagtaagctagattgagttcatttgaacatttagttattttttagctcatagttaacatatgtccatgcatttgatttactttaaaaatattttatttaaaaataacctctcaaacaccagttgctttctgtcagttttactcaaagcatgcttcctaggtcacctgacctagaatcaccagaagtgttaacaataccgatttctgggctttgagccatgaaattagaatttcttcaaataatccatgcccccccgtcacccaaaaaaagagcatgcttttaatacatttccaaaattatcctgtttctgctataactggtgaaccatcctgtcctaaactagcagttctcaaacatgcatatgcctttgaaacttcctagatcatctacataaaaatcatttgaaatattgttaataatacacagcttctgaatctctgggtgtgagatgggaccaggaatcttattttaaaaatctccccagatggttctggtgtcctgctagttttgaggttttcatcccacctgtttagatgggtagtattctattaaatatgaggtattacctttctttagttcacctggaatcttcttaaatatatcggtaaagtattctacttcaaaatccaagacattttgtatacctaattatttcacacaagagcgtggaactcaccagtcttgtgacttggggcaggttatttatagtctccagacactttttccagttgcgagttgcttatagtagttcgcgaacctgaatgcacattagaaccatctggagaggctttaaaattgcagatgtccaaaccccacctccagagagctgatctatttagtttgaggaagagcccagaagtctaacaggtgtaaatgttccacaggtaatactaatgcaggcatacctcaggaaatcaccagttctcgtcttggaggaactattaggaaaataaaagattatatatcttgaaaaaaatctctaatttgctttctaggttctaactgcatgtttatattttgcaacaggaaagactggtctagacaattactaggatatatgcttctgtgatctgcttttctattgtatgtgtttaagagaccacattcttgggttccaaagtctccttgtctgataggtaatttgcaattgagatatggcaaagaattgtagcatccaaatttttgacaactacagatttagaattgaatccaaggtctgccattcactagctatgtgcaagttactcaacttctcttatcctcagattttgcagctgtaaagcagaggtagcatatttctgagaaattatattcaggtgactagatatgtgttcaagtgttatcttttattcttataaaagataattgtgaggaatccagtgctattttcacaattttaattctaaaactctgaagacattaaacaggcagtttgtaggaatcattgaaattttatacaagccgaaggaacaacattcagcaaaacggaaacaaataaatacagcatggaagcatatattcatgtttcccataattactaagttacggaaggggtgtgaggagctggcagtggtggtgaataggcattgtttgcattactaaatatatataccatttcttaagataattggaactcaagcagtcctaattttctctccctgttatgagcaatcagtaaatttgtagtcaatttaacttattatcagttggtatagcgcatgtcacagaataggatagcaagaagattctcagagatcattttctggtaaagaaaaaggcctagcaatatttaacagtttgacttaatccatcacttcagctggtccactagttttgacacaggactagttaatgatttgttaggaagtctccatctactcttaaactaatttaaaaaaaagctaaaagttgcttttaatatgttagggtataacttcaataaacaggagtatttatctagtggttcagaaataaaataattgttagccagcctgtgattaaggctaccataattgcataataaatagctttgacgtgaataatctcagttgttcaagtgtacaaatttaaagctgtactatgttagaataaaaaagtaggctcaaggaaaatttctatttttctatatgaaaaagagaatgatattcaaaatagtatttttaagtagtttctaattgtgttcctttaaagagtattagaaatgtctgttatgtcagtaacattagaaaacttcaaaaactgatttatttttctgagttctctggaaaccaaacaattttgaattagttgtgtaagtaaagtaagttaagttatagcttgctggaattttattgtggaaaacaaatatagattttatctgaaaaattttaagggccaattctacagaaagttatgctaacatgctaactttccacacatggctgcattccattttgattaatgagggttcaggaaatagaaaggcagtctctgcagaagcagtatccaaaggctaaattaacaacccaggactaccactcattatgtgagaaatatgggccagagttacaatatcacatctccagtctcagattggcctcattagccaccttcagttccttaaatgagataatcctgaagatgccatccttgtccaaggtgagattgccagaggatatgagctcatctaggatggaatacatgtctccagggactgtaatgagatcaggcttttcatttactggttttctgcctcaagagtccttaagcaaatgaagattatctgattgtctatgtaaacctggaagtagtctactttttagataaaagataatctatcttgaatatttcatatgtgattttaaaataattaatcaaaaaacaaagactatcatatttgagaacaagattttacttagaagggaaaaaaaagaactttcagcttaatcggggttaagggagtaattgtgacaatataaaatggcattgttatagaatccctaaaaggtaaataatgtatgagatgaaggtaggaagtaatgtgtgcttgcagaaatgcaactggtcaaaattacttgaatgaaattgttgaggttaaacatcttcattataataatatgtcttattctgattccaagacaatacgaatgtagagaagagatttttaaatggaaaaagtaaggagctaacaagtctgtacctagattcaagttcacaaagcggcaaaaaggagaaaagtgtcaacaagaaacaagaagaggagtagtaaactaaggatcaaagcccaagttccagttttcacaatctgctgtataattcactaacatttctgagccatagatttttaatctgtaaaaggagtgtgatggactgtacattagaagtacctgagaagctcttaataaatcttgatgaattggttagaaattctaatttaattagcctggcacagtgcacaaactgccatatattcgtgcagatgttttcttcttttcttactgcgcatttccatgtggccatgtcactacaaggggtggggaagaagttaatgtgtaattgcttcaggagctctgaataaaaggttgctgaagcaaaatactgcaatgaagttctgaaaatgaagagttaggactttacatgatttctcttgcctcattccctcaagaatgcacatatagacacacatatgccaatatcttttttatgtagttcaagtataactttgaataaaatgacttacattcaaggaaggtcaaaactattattctgaaacaaaatgtgacaattctagccattatgtgaattgtaagggtcagtaatccataaattatttggatggtaattgtatgttttattaatgtgatgtaattttgcactattgtattgtcatatttaatcaaactcttaaaaataccctgaaacataatgccaaatgtacagtttataggttcgtgttatttctgataagaatttaattgcattgtgctaatagttgtttattgctattaactttctgtgtatgtattattgcgatgcagacccaatagggttattttaagcacactaattagtcatctggatttttatagataaaatcacatgttgatcagaaatcatttttctacttatttttttgtagagtatttttccacacttgaaaaaaacatgattattttatatcaaacatcaacttttctttaaatcttattttagtagctaatgcatgtttgaaataagatgtgttagaaattatatgactatattaaggttgtgtttatattaggtgaaaaattgcatgcaattggtgaatcatgcagctttggggacatttacactgccactcacacacaggctctgtctcaatccgtatgcatgattcacgtcctttcaaaagtcccttttcaacatttggtaaagtgaaaatgttattcatagtgctaatgagccaataaacaatgctgcgtttcttttttctaactgcagcatattgtggtaaattttctcccaaaactttatttttggagttattgttggcaataaatacaacaaattatttgttggcaagtgatacaatttactgtataacaacttaatagtacaaagcatgaagatgtgaaaatatcatcttaaccagtttcattctatgaacataatattctggcagctttttctataactgagaatggtatatctttttatacactgcctaaatcagtactactgccagtcacctgaggtcaggtctgcacaacactaaattgggcaataacatagaacatctaggcagtcttgacagtcaaccagtgtaatcactaggggaagaaaaagtaggcctacccttttacttattaacttaagtaataaaaattgtataaaaatatgaatgttggctgcagaggagcctttacatgcagataatttgaagcagtctttgaaaataacaaaaattattccatttaatgaagggtttgttttgtttagcttttctcttttattcagaaaacatacctgtgcttttgaaagggcttaatcccaaacaggtaatatgtgtggatcaatcatctctcctcccatgaaattaatcattcatggtaatatattaaggctggaacgtagctcttagtgacttaaaacatgacagtaagcatttacactgttggaaggtaatttcattgctatgttattaaaatgatgggaatcctatttatacatttatttatttatttatttacagaagattggttccttccagttcaatttaacagcttcagtgaagttagtataatgataagaaaaattgactgtagctattattccaagtgaaaatcatgcagctgagtcctgctgcatcctgggagcaaagcattaattcaaatgaggagtagtcagtcctagcactgtagacgccgactttaccaaccaagatagtgtatgtgtgtgacattcagctaacattgatctaggcacttagtttgctaccacattgttcccttcattgattgaaactgtaaataacataacactttaaggcagctaagcaaatattttaataagccatgaaaggcaagatgccagagaaaatctgtatattcagctatttggagaactcgtgttttccacaaattaaactggagatgtcatttgaaattttcttcccttaaacatgctgtcacaacatggattccttctcatggatgtctttctaggcttataaatatatggtgtgattgctataattttgtgaaattttattcagcaattaatagtgatttcagcaatatgtactaagattccaaggcagaaataaatgtataaaggatttgagcctgtatgtgtaagaagaaactctctcttcagtcatatttcctaaattcagtgtaagtacctcgctgatttagcactggagttattccttgaatgtgtaaataatgatgttctattctgacctaatgaattcctgtaatgtgaatatttaaaataaaagaattcaatttaaatgta

SEQ ID NO: 54 - DNA, 317835 bp, Homo sapiens
gggggcaactaacttttagagattgaaaaaagtggcaatgagaggaattttatttttttttaagtttgtgtcattttaattttggtccaatttagacttttagagacttataccataaaaacacccctcttgctagtttgttgctggcgtctgggctgatcccacatacagcaattgaaaagtctatacaagaacaacaaagaggaaaatcacatacaactttcatttcaccttggtggagtcaaccaggatagtacctgctccaacagcctccaagggtcttggaggtgtgtcctgctgtggccagtgggtgctgagaagcagataggtagaccctccttcactccctctcttcttcccctcggcctattttctgttccagttatgtgagatgttctgaatctttttcattttgatcctctgatccagcatcttgtaccttgcaggatgctcatcagttttctttgagactgaaggtgcataggagctagatgcgtaagcagggcgtttaaaatgacgcaaaggaggcttgatgactggcggccatggaaaggaagacagacaacggttagcctcacccacgacatgccacaacctaaatattgtgagcaacttcctctagacctgtttgtttcctccaagaccaggaaagaagcagtttggattctccctggaaaccttatggcagatagatgaataagcacgttaccaccttggtcattcagttaaaataaataaatggaagaaatttctagagatacagtgataactgcagtacataaaggtcctttgacaatgaatggatggggttaagggagtgagaggaagcattggggtcatttctgggaacagcaaagcaaacaaggtgaacacaggtatatcattaacagcatttagcattgtatgtaagcttttagtgtttggaaagtggcactcaatccccaagggatacttaaaagtgcatcattaagaaaatatttataaaacacatataaagatcttgtattcaaaatataaaaagaattcttaaagctcaagaaaaagaaacaacccaattttaaaatgggcaaaacatctgaacagacttcacaccaaggaagatgtatgtgtcaaataagcataggaaaaaatgctcaacaattagagaatttcaaattaaaacaactatatgctactacacacctccacaatgctaaaatctaaaaaacttgacaacaccaattgctggcaaggatgtaaagtaatgggaactcccattcttgctgattggaatgcaaaatggtacagccactttggaagacagtttgaccgtttcttatgaagctagacatagtcttaccatgcaatgcagcaattgtgcatcctaggtatttacccaattgatggaaaatgtatgtccacataaaaacccacacatgaatttttgtagaatctttattcataagtgccaaaagctggaagcaactaagatgtccttcaatagttgagtggataaacaaattgtgatacatttatacaatggaatattattcattgtgataaaaagcaaattaactatcaagctatggaaagacatgaatgaatcttaaatacatattgctaagtgaaagaagtcagtctgtaaaggctgtatagcatatgattccacttatacgacattcttcaaaggacataactatagagatgataaaaacatcagagattgtcaggcgtttggaaagaggagggatggttaaataggtgaagcacagggaatttctagggcagtgaaactctcgcatacaatactgtagtggtgtatatatgacactacacatttgtcaagacccatacaactttatagcacatagaataatccttaatgtatgcaaataaaaaaactatttaagaggtcggaggaatcctagaatgaaatgcaaattgtaacaagacaatgtaaatgcattgccaatgtaggaaacaacctcactgaagagtgggggacaagacggtcatcgaagtaaccttgtatatgaacagaatctgcaagactaaaggccgaagaagctgtacacaagcactctattctagctgataaaattgtttcccatggggctattggttatcaactctaagaccactctacatgtataccagaattcaacaattacgtaaacagagggtggatggtgagaaatgttggaggaggttagaatggtccatgtggtaatgaacttgattatatcaatatgaattaatatttagcttaatagagatacaggtgattatatataaaatacttatagatatgtgtatgtacatgagttggcattcacacatatattgtcttgctctatcagctgaaggggagggggtctaggaccaacgaagtcactacaaatctagaagtctcagcagcaataagcacatctactgccctgatcttggtttctaaaaccatttgctaatagcagaaaccagggctccttgcagaaatgactgattccagaactcggacacaaaatatacaagaagtacctgaagcatcttgtagagccagaaaatttgaagtgttcaaaaaaaacaaaacaaaacaaaacaaaaaacaaatacaacaatagacaaaggagccctgaatgaaagatctactgaatgatcaaaattgaatcaaattgagcaacaaaataaacaaggcagtattgcattttaacccgaagtataaaataaatatccatgagtccacactgatataaataaatgattgaataaataaataattgtgggagaataatttatatacatatgcctcccttaaggagaaggagcccttagtatggattggacaaagtgacatccttccaaaaagtacagactaaaatatgagacaggcttggcacggtggctcatgcctgtaatcccagcactttgggaggccgaggctggcagatcactggaggccaggagtttgagaccagcctgaccaacatggtgaaaccccatctctactaaaaacacaaaaattagctgggtgtggtggttggtgcaaacacctgtaatcccagctactcaggaggctcaggcaggagaatcgcttgaacctgggaggtggaggttgcagtgagccaagatggtacacttgcactccagtcttggtgacacagcaagactccttctcataaataaataaatatatgagacaaaagagtaactttatatagagaaatctagtaaacacttcttccaggggatcaaggttgacaccagtggcatgtgatgaaaattaatattttgtgatgaaaatagaactttacttctggagtcttcctcccaaaaatatataaccccattctaaaaatgaagaatatcaaataaattccaattgagagatattccacaaaatatctgacaggtattcctcaaagctgtcaaagtcaccaaaaattagggaagtctgaggaactgtcacatccaagaaaagtctaaggaaagttgatgactaaaagtaatgggttatcccggatgggaccctgggacagaaaaatgacactgggtaacaagtagggaaatttaaataaagtaggaacttcagataataataataattaataataataaggacagcatctaatctgcagatctagacatagaaggtaaaatactcattgacttttcctccccctgctcctctctgtgccagcccccacctcatcccttctaggttctgctggaaagtgtttggtcagtgagataatgtcaacatgaataaaggtgaaaacaagtcaaatgatcatcaaaaacagatgagatataataactaggtgaaagtgcaaggaaacagagccagttgaacccttgctcactggctttccctgcaggctcctccactgtcactgaaaaagccagtgcaggagcaggacacacggtggatctgctggaagggccaaggtcagggacccatctgtccaatgcctgaggcttccttgtgaaaaaccagctctgcacatctcttccaataacagggacatgcatggtgcttgtgaccaaacaaaagatgagaaacaacttaaatgaacaatcatagggaattggttaaattctggtccattcttagaatatgctactgtgatactatggaaagatgatacagatgactactaacaaaaatagaggttcatgtaatggtgttaaatgaaaaagcaggatatattatctaacctcattactagaaaatataaacatatgtgcataggaaaatctggaagaacatacatttaaatcatagcagtggttatctctgagtagcataaacatggctattttatctctttggttgtttatactttctaatttttctatgatgatcatgttctagtcatgtaacttttaaaaaagaaacatactagtaaacatttcttctatagaatcatctatcagagttattctacgaaatcacacctgagagaaaatcagtcaaaccaagttcaccttggaccttagtactagacatctcagacaagccatagctgagtacacttttcacagcatacagattaacttcatcactggccatcagagaaatgcaaatcaaaaccacaatgagataccatctcacaccagttagaatggcgatcattaaaaagtcaggaaacaacaggtgctggagaggatatggagaaatatgaacaattttacactgttggtgggactgtaaactagttcaaccattgtggaagacagtgtggcaattcctcaagaatctagaactagaaataccacttgacccagccatcccattactgggtatatacccaaaggattataaatcatgctgctataaagacacatgcacacgtatgtttattgcagcactattcacaatagcaaagacttggaaccaacccaaatgtccatcaatgatagactgaattaagaaaatgtggcacatatacaccatggaatactatgcagccataaaaaaggatgagttcatgtcctttgtagggacatggatgaagctggaaaccatcattctgagcaaactattgcaaggacaaaaaaccaaacactgcatgttcttagtcataggtgggaattgaacaatgagaacacttgggcacgagaaggggaacatcacacaccagggcctgtcatggggtggggggaggcagaaggatagcattaggagatacacctaatgtaaatgacgagttaatgggtgcagcacaccaacatggcccatgtatacgtatgtaacaaacctgcacgttgtgcacatgtaccctagaacttaaagtataatttaaaaaatggtaaaaaaaattaaaaaaaaattatgctacttctctttttaaaatacttatgaggtacccatactcccaagtatgcctcataaaagccttcaaaaaatatttattcacccacttcttagagtacctattgtgtgctattgatataacagtgaacagaacagacagaaatccctgcctttatagggcttccattctaataagatccttcgaaacttttaactcactcacagaaataaaaagtgttcaggtataaattatgctatggctacaagctccttaatacccatgccaacttcacccattgcaatatcctaacgtgaagtaaagagttgcagcaaatggctctgttgttacatagtaatatatattcttctatattattataggtttgtttattagatctcagagtgcttaattctgtttcttagggtaaacaagaaattatggcatcaaattgcctaggaacaaacataaaagcagtgccgttaccctggagaatggtgtagaaaggggagagggcttcagcttaaaagcagattgttgcaatgtctgagccagctgattcactgctcttcaagtcaccgtccctctccatattcattctatttcactactcagcaggaactcagccaaagtattactgaatttcccacttctcagcatgaagaaacatttaccatttgctgggattctgattgtcagaacaaaacctctccttgccactggagtcactgcaaatagagttgaacctgctgatataggtagactccccactgagtttgtggaaatacttatatggctgctgtcaccctcactcaaaatgtgggataaaggaaaatttcgtacattgctgttttgtatgcattcattgcctttcccctctgcaatggattgtgatttggtgacagagcaaaacaccagagccaggcatgagggcaccatcttgaatttaatgtggaccattcttctggggtcctggtatggccttctgagggtaccctcattaattgtctggctatacctaaactatcggaaggggtccgaccctcctcctttcaacgactgggcacttcccacagctgaatccaaccagtcgtacaatccccgaccactagtggagaagaaccaaacctggatccccacccctgccacaaataaatggttgattatcagcaagttggacacttcttccccttggggatactttaaaaaagtctggcctcatctcttagaacaatttgcttggagaaaatgatctaattagttaatgaagattgtgacaaaggcacatatctcagcacagtacctgaacttgggaaaattatctatattacttttaaacatgcttagaaaaacaaaagttcaagccaaaaattgatacatcaccgtcctttattttataattatgctccatgtttgattttcataaaagcaatgctcttttaggagttttaactctcaattgtttaattatttttcataaatataacaatttctcccaaaggtatctatgattttctcccctttcactgccacaaccagcctatcttttgttctctctctctctctctgtctctctctctccattctctctttctctctctctctctcatcatttttcttcgtggctacttttttgttttggtatggggaacagttgtacagaattatttttctccaggaaacaggttcacatttattcatatatcaaatacagctattaggattatttatattagtctactggaaaccaaagtgcccttcaacaaagctgtgtaataggtgtggttgtggggagagggtttcctcaatcaaatttaactgagttaaactagtatcttcacaccaggacttaccagcaccttaaataatgctaacatctattaagaatccctgagaacagccaatagcatgtagtttctctcaattttatttggctaaatagctcctttttatcaaggacatcttatagagtgaaaacgccttcagaaaaatggaattaatttcttatcatatggtatcacactatatcaagtcattaacccagtataccctgttgttttccactaaatgagagcaatcaagagagaacagccgctagtcctcatccacgcttgggtctggcctcattcccttgagttcaatatgatttcccatagcactggccttggtcctttcaatccactgtgacttcagtgtgacctttggaaccccacactgcagtgcagcagtatcttcaggtggaggttttctgaacctcttcaggtgagcatcacctcaaatggcaataatttggtctacttggagcttttgagtaaattctaatattggtagccttagttttaaacaaaaataagtgttggatatctgttttttctctttcaaacataatgctatgatatgacatttggaaaaagcactttctcctatagacactttctatctgcaatgtgtacacacacacacacacacacacacacacacacacaccaaaccacatatactaaactaacgaaattaaaataatcatttattgccacttaaatgttattttacatgaaggaaaaaactctactatacattctatttctaaaatcagtatctgtttgtggtagaaagcccttatcaaaatgcacaaaaaccatccaggagttttgaactgcaagggactggaatgttaacgtgagccccactgaggatgggacaatatgagatttgatcctgtgattttcatttcaggaaccgctgtggtaaaatcattgtaatagctgatactatgtactgggcatgtattttggctaaagtaactggccaaaatcacacagttagcacaaaggagtcttgattctggattcacacacatgcaatctgaattcacacccttcctcctatcctcccatatctaaaataatcttgtaccaaaatgcagagtaagttataataactaccaataataaaagagtcaagtcaaaattgtatctcatttatattattaacatttaggtatgtacctgagtcatatactggattattgaatacccttgaataatcaataattttgaagcaataatcttgcttccctgtaaacaaaagtaagtcatcccctaaccccactttaaaatagtttgtggcaatggctcaggaagtaactacattaaggtcctgacttaaagagttctcttaaataactgctttcatcttttccctcccttctgccagactggaatattaacaagtattccaaaactctaggccagtggagtctagccaggcaagctccaggactctttaacttggtggttctcaatcctggctgcatatgggaaccacatagcttttaaaactcttagtgctcaatttgtaccccagatcacttaaagcagaatctatgagggtaggactaagccttcaggaattgtttaagctcttcagataattttactgtactggagtttcaaaactactgtcttcatctctccaatcctctcattcttcatcttccatgagctatttgcaactcctcaccatccttggaagctggccagattcagttctggcactgtccccataggacttggacactttatttcagttttccatttaaaaaaatggaaataataacactcacttcacagggcaatggtaagaataaaaatatatcatacatgtgaaaacagccagcacagtgctgacacatagtaggtgctcattcagtatcaatttccatccctttcctcagatgaagacatttaggaactatctagaagatttgcaagtgccgggaaaatttagtagcagcatgctttcccaactagggaatttatttgcctctctaagacacaaaagccttatagtgaggccacattaataagagcctttccttttgtagaaatacaatttagcaactttaacccaaccaaaaaattactttcgtgccatgtgcgttagatgtagtgtcgtctaaggtgataatctattcttaaactcttcaaggtatatttcatattaaaaactagaatgattaagcccattatctacattttttatttttttgagatggagtctcgctctgtcacccagcctggagtgcagtggcgccatcccgggtcactgcaaactccacctcctgggttcaagtgatctcccacctcagcctcctgagtagctgggattacagaagcatcccaccatgcctagataatttttgtatttttagtagaaatggggtttcaccatggtggccagagtggtctcgaactcctgacctcaagtgatctgcccatctcggcctcccaaagtgctgggattacaggtgtgagccaccaagcctgtccccattacctacatttttaaagacccagattctccaaggactttacctcaagaaagtgagaatgctgaattctctatggcttccattttttcatcacacagagcaaagaatgcaggggacaggaagcttgcagtctgagaagctatttagaaggagctgagttgatcctgtctgaaccaaacggccactagtatggtatggaaagatgacccaaccagcatttccagatccctagagggatatgcatccatagaaaacagataaaccatgtagttttgctaccttccatgcaacctgaagttgttttctcccactggtggttctcaatcccgggtgcacatcagattgcttggggagctttgaaaagtactgatgcccaagccttacccccaggagtctctgaagtaattgatcaccctggagtggagcccaaacatcagtatgtttgtaatgcccagttatcctaatgtgtgaccaggcttgaaaaccactggctttgggactgagtctgttttgagagcaacttggtttatacttagctttagaaggataatggggcggccaacctgctccctgttcctgttgtctgggaatgcccaaccctcagccatgtgctaagattgtagaaacacaatttagcaaacttaacccatggtatgagagaaaattactctcttaccatgggcattagatgtagtgttgtctaaggtgataatctattcttaaactaagaatagatctaagacaggatcttagtgctaaggtctgtgacaggaaaatgagcccatggagaggcttttgggagaggtgggtggtcttatgaaaaaaaccatgggcttggggcacgtcacagagctaagctattactagctgtgaaatcctaagtaaataatctgttctagcactcagggtttggttttctttcttccttttttaaaatgagaatagtaactgccttccatggttgtggtgaggattttaaaggaaatataaatgggaatatgcatatgcagtacccatgtgccattgcacagtacacaatgcccagaatgttgtaggtatttgatatacagccatcattgttacacagcacaggaagacaaaaggtcatcattgctgcctcgtgatagcgccctccctggtggatcttcttattacaatatagaaaagtcacataattccccacaggatgggttttattacatgaaagatctcaccacacaatgaagagattaacttaatgaatttatttgtgaatatttggcagagaatacaccactttgattcacaaaagaccagttatttaaaatctgcatttgtgaaaatatatatattatgtatatattatatatatttttatatatatattttatatacatatatttctattctgctacctgaggaagccactttgctgaaactatgtgccattttaagcaaaggaaaaatggctagcccacattctaaaccatttaggcaatgcaaaaatatagtggttcattcactcactttggttttgtttttgtttttaagacggagtcttgatctgttgcccaagctggagtgcagtggcacaatctcggctcactgcaacctctcaggtttaagtgattctcctgcctcagactctgtagtagccgggattacaggtatgcaacatcacacccagataattttttgtatttttagtagagatggggtttcaccaggttggccaggatggtctcaaactcctgaccgcggtgatccaaacacctcagcctcacaaagtactgggattacagacatgagccaccctgcccagcccattcaatcactttgagtaacacctaacctcaagtacaaagagtgctggaaatcccagtgggaagtatgccttagataaccaaccaagacggaaggagttccagtccctgaattttaatcttgaaatcattagaaaactgtcaaggacacttctcattcttaagacacgttgcgtttattatgccgagtcatggtaattatttgagtcactcattggaagccattcctgagccagtgattccctggattttttggagcttctttgtgccttattccataaataactcaatcctgcctatcagcttcctgaggataggtatgcagtatatgcatccccagaacttaatcacagtattaactggtggtgagaaatatttaatgagtgaataaactactctacttcacattcagtaaccttcataaatcttccatttactaaagaataaatgaatcactttgaatatacacaagctggaaatgatgattgggatctacagatccgaatatttctctctttcttcagcggtgtcttgatatttagattttgctgcccatgtttgcttgagaagaatgtcaacaagttcctttcctctcaagctttcaagtttgagtccttgttttacacaaatgctaaaatcttagctcatttctactggtctcatgataatatggggaggcactgagacatattttttgagccttctttccctgaacaaataggtgaaaggggaggagcaatttaaatgaggctggaaaaatcggctctttttcaaacgatggcttcctatcaaatgccctgtgacttcatgatttaatgctaaggatataaaaatagactaaaaatgaactccctcaaggtgatgatcatctttaattttctcatttataatgtggttataaattttctcatcattaatgtgtttcttcgttttcattttgtttgtcttggcatgattctagttgtttcaatggagaatcatattttggagataacgcaagctaagtcttttgctgtatttttcttaacaacgtgtgcattttcccacttgtgcatgagaagatgggaaatgtaaggctattcagaagctcctatgtcctttgttcacactaacagtggccaatttcagaagaagcctataaagatacatttcttcaaggtgatagagctcctgcataacaaagctggatcaagtgggataggcttcaatccagtccacagtaagtgacaactgccatccttcaatcaactcaggtaaaagacagttgcagagagaacacttaccagagtcttcacttaaaagatagtgcaggatccctcccacaccccaacaatgtgcttgatattggtacatggagcttgatctcactcccaggcagaatacaagtgtgaaagaaaagtggttacagtgaggactatttagaatcagtctttaaccattggcaatgaccttcagagaaaagagcacaggcctgccccctgctaactttgggtaagctattcatctctttgtgccttagtttcctaatctgtgaaatagaaataatagtacctcccttagagggttattgtgaggattcaatgacataatacatgttaaggacctaatgttgtcctgatatttgtagatatgcaataaatgttaaaatatctgtggttgggcccggcgcggtggctcatgcctgtaatctcagcactttgggaggctgaggcaggcagatcacgaggtcaggagatcgagaccatcctggctaacacagtgaaaccccgtctccactaaaaatacaaaaaattagccgggtgtggtggcgggcgactgtagtcccagctactcgggaagctgaggcaggagaatggcgtgaacctgggaggcggagcttgcagtgagccgagatggcgccactgcactccagcctgggcgacagagcaagactgtgtctcaaaaaaaaaaaaatctttaatataaaatcatttaagcatacagaaatgtataaataatgatataataaatacccatactctcaataaagtttaataaaatcttaataatttttacatttgcttaaacattttttgaaagaaattaacacagatagaattaagttacccggcagatcctctctatgatacttcactctcttccctctggaaaagccatcctccagaatttggtatttatcattgctgcgcatttatgtatgaaattattgcatttgtatccacaaaatatctaatatttctgcatgttttgaaacaatataaattgtattagaaagcatatatcttgttgcaacttgctttacttgctcgacattatgctcagcattgtttgtaatagcaaaaagtggaagacaaccattaataggagaatgattatatgtcttttggaatatttgcattataaaatactacacaaatgttaaagtggatgaaggttttcaaataactagctttatattttgcatagaatttcttttactatgcattagcaaacctaatgtatggcaaaagtttttttatgaaaaaacttttaatgaaagtctgtctgtgggtgccatctcttaaaaacaagatagacctggattttttctttcttatctaatcaaataatctctatattttaaaagcaagttgaagccacttgcaattattgttattcctgatatttttggacttatttctactgtttaattttgttttgtgtttatcattctttattctttgcttctctgtcttcctttagccttctattaagttgatacattctcttcgtttattgttgttcatttgttgatttaggtgcctgctgatatggtttggatctgtgtctcatcccacatctcatgtccagttgtaaactccaatgttggaggtagggcctggtgggaggtgatttgatcatgggggtagatttccccctggtactgttctcatgatattgagtgattcctcatgagatctggtcatttaaaagtgtgcggcacctcctcctgtttcctgctgctctggcaatatgaagtgctggctcccccttcaccttctgccatgactctaagtttcctgaggcctccccagaagaagccactatgcttcctgtacagcctgaagaactgtgggccaattaaacctcttttctttataaattactcagtctcaggtagttctttatagcaatgcaagaaaagactaatacacttggcttagtcagcttgggctgctataacaaagtactgtgactgagtgggttacaaacaacagaaatttatttcttgcagttctagaggctggaagtccaagatgaggtttccagcacagttggcttccagggagggccctcttcctcttccaggttgcagactgctgacttcttgttgtgccctcttatggtaaaaacagaccaagctagctctctggggtctctttcataaggtcgttaatcccatttgtgagggctccatcctcatgacctgattacctcccaaaggctccacctccaaacatcatcacattgtgtgggggttcagtcaggatggtgggaaaaattgtaaaataaaccttcttgaaaggccagaaggttttagcaaaagcctcaggatagagttatggctgaaggcagcctaatcctctttgagctatagcaagggtaattaacattggaatgtagaggagtctatctaaatagcttgtttaatcatgtggtcctaagactaacctttgccatcagcaggtgcatgactgctttctacttggggggttggcaatggtaattaccttctagtggtgtttacttgagacttttgtcatttaatgtgtgctgaataaatgctaagaaggccagtgagtcgggccaggctgcggttgccactgtttacagcactctccttggggtctgtaagcggcccagactctcagctggactgacaagcataatatctgtgtcagtgtatgttattcatctgttgttggatcaaggtctgtgggacggaccgctgcaacattggggattggattttaacatatgaatttggtgggaacacaaatattcagtgaataacaatgctattatgtttccattattttactgatgatcctttgtgttaaaaagttacaaaaattacgtagttctgaccaaagacaagatagatcttagcactccttaggtccatattgaaacatcccgccttccatctatagcttctctttcctattttaacacaaaagtcggatgttattttatggtcactagtcactcaaatttaccaacatgttttaattactgatgtgctcacccctaattcctgtgtctcatacattccttgtgggttcacttttcttcttgttgacatacttcccttaacacttttttttttgaatggagtggcccaggctgtggcccaggctggagttcaatggtacaatctcagctcactccaacctccgcctcccaggttcaagcaattctcctgcctcaacttcctgagtagccgggaccacaggcacgtgccaccacgcctggctaatttttgtatttttagtagagatggggttttgtcacgttggctaggctggtcttgaactcctgacctcaggtgatctgcccacctcagcctcccaaagtgctgagattataggtgtgagccatcgtgcctggccttaacactttttttaatgaaagtctgtctgtgggtggtaaattatcattgtatacctgaaaatgttttaatgtgccttcactcataagcaataatttagctattttaactattacatattgctctattttcccttagcatatggaagatattttcttcattgtcttctggcttctactgttaccaatgcaaattttgctgtcagttgattacttgcaacttccctgcacataatcagcttctcatagcatttaaggtttcctcacccttgatgtagctttaggcaatgtcattcaatgtctttaggtatgaatttgtttttgtttagttatggcactggagatgtactttccatctaagaatttgagtctttctttacttctgggaaattattacctctttgttgaaatattgctttcccacaactttctccatatcctgctaaaatttctgagagaagtagtttatggcaatttgtctatcttccatgcttttaaattttttattgagatataattcacaaaccataaattttgcccttttgaggtatatattttgagggttttttcctatattcataatgtttcacaaccatcaccactgtttaattccagaatattttcatcacccctaaaaacaacctcatatccatgagaagtcactctccactctcttttctccccagcccgtgacaaccactaatgtactttctgtctctatggattagcccattctgggtattttatgtaaatggaataatacaatatgtgaccttttgtgtctggcttcttttacttagcaaaacgttctctaggttcatccatgttgtaaaatgtatgagtacttcatttaagtcactctatgattaactttttgaaaaacagccaaactgtgttctaaagtggctgcaccattttacattcccaccagcaacatgtgagggtgctaatttcaccacatcttcaccatcacttgttatttcatttgttttattattattatagcatcctagtgcatgtgaagtggtatatcactgtggttttgatttgtatttccttaatgactaataatgttgaatatctttttcatatgtcatttgtatatcttctttggagaaatgtttgttcaaatccttgccactttttaattgggtcgtctttttattgttgagttgtaaggattctttacatattctggatacaagatcctcatcagatatgtgattctcaaatattttctctctgtggattgtctttccacgttcttgatagtggtttccaaagcacaaaagttttttattttaatgaagcccaattacctaattttttcttggttgtttgcacgttgttatgtttaagaaaccactgccaaatccaaggtcatgaagatttacctctatgttttcttcttttttattttattttttttcttttctgagacggagtctcgctctgttgcccaggctggggtgcagtgacatgatcttggctcactgcaacctccacctccttggttcaagtgtttctcctgcctcagcctcccaagtagtgggattacaggcacccatcaccatgcccggctaatttttgtattttagtagagatggggtttcactatgtaggtcaagttggtcttgaactcctgacctcaaatgatccacccgccttggcctccaaaagtgcatgagccaccaagcccagccgtttccttctaagatttttatggttcatgatctttcatttttttgatatggttccctctccatgctatatttggtgtaaagtcttcaggactatcctccaacattaattaacttttccactgtgttctaccttgaacttatactatcaactgatagttttctcttttttaaaattgcaatgactatatgtttgcttcctttttttaaatttcagattttgaaccacttcttttacatatctctgctttcttgggtttgtacaatttttcttcattgtttttaggataatttttcctccatttggctgtctgagtatcctaaatacattttaaagtgtttgacagcctgcaccaaaaatcaacttcttctagaagaaattcatgttccagttgccaatttctgtggtacactctgctactggcaccaattcttcctcctgtacctgtgccctttgctttctaacctgcacttccctgcttcttgactttgcctttggccagaccatttttcacagcagctgtgttattttatgttcctagaagcaatataccagggttcacatttctccacaccctcaccaatacctgctatttgctgtttgtcttttatagtagccatcctaatgggtgtgaagtggcatctcactgtggctttgatctgcatttccctaatgactagcatctttctatgtgcttattggcccatttgtagatcttctctggagaaatgtctattccagtcctttggccatttttgaattgggttttacttttgttgttgttgctgctgctgttgagctgccagagttctttatatctttcatatgtctagatattaaccccttatcccaatatataatttgaaaatattttctcatattgtgagctgccttttcactgtattcatgtgtcttttgatgtataaaaagtttttaattttaatgaagtccaatttatctattgcttcttttgttgcctgtgacattttggctaatttcaagtagaagatacttggtttgggaggccgaagcaggcagatcacaaggtcaggagatcgagaccatcctggataacatggtgaaaccccgtctctacaaaaaattagctgggcgtggtggtgggtgcctgtagtcccagctactcaggaggctgaggcagcagaatggcgtgaacctgggaggcggagcttgcagtgagccgagatagcgccactgcactccagcctgggcgaaagagcgggactccgtctcaaaaaaaaaaaaaaaaagaagatatttgggttttgggttctttctctctctcgcctgcctagagttttgtagttacttccacctcctcccttaaacttccacttcagagccttataatggcactttatgactaatgctctataatcatattggcatattgcagatccaattccaaagctagctcggtctggcagaaaagctgtcccaatgtccttccatctctctaggccaacagcttcctgttaatattattaagctgtggcttggaggaaacaggctggcagcagttgttttagcctgtccaccccatgtcctgtattcaggttatagccctagctctgattcccagtgtcccctgcagcacttttagtcccttttgctccacaggattcaagctccttcctgccactccttactcaggatgtggatcacagctgtcccagggcttctgcagttctctctctctcttttttttttttctggttcccagagttgtttgtctctggcaccagtttttttaaaagatatatttttttattataattttacctaccttggcgtgtgtttgagcagaggagtgtttgtcaaaaaatgaacttactcaaccatcttgaccggaattcacagcaaatgttttcatctcctaatgactgaattggatcagcttacagcagattgatttgactgcactggatctaatcatgtaggtggtgttgaagaaatataaaaccctaaaattccaattaaatccattcactggctgtaaaatcaaaggtttttaaaagattctatctattggtggtcattcagaagagtcatctcttctacagctatgagatggtaaggtggagctgtgagcaggagccagcatgcatgggcaggggcccccatggcacacaagccagagggaggcatctgtgatgctcctgaggcaggaagggaagtagagagctgggtattgcaatgaggtggtgagcacatctgctagtgaaagcatgattccagctccttccgtgcacccctcaggatgtgaagcacagctgccctgcagcttctgtcctgtagtgtcaatctgcacactgtgtagtaccagttacacagattaattatgtctggtgttttgagaactacccacttccacctctgaccatctctcaagtcctgtagggcagaggattgtggtttacagccctgtaggctttggagatgctcagaatgcagagcctaagacactccttttgggaccactttggatggctaaagacaaggtagctgtgattctgagtcagaggccttgggaacccagtggccatccctgggtccccagcagagcaagtgggtcccaggacagctctgcatattcttggaggtgacaaggatgccctcagaaatcccacctgatctagcaaggctatgaccttgtcaggagcaaacaccatcacttcacactggaattgcttggtttaaagctgatttcttcctgatactctgtagtcccaagagcataataacctcaagcagagacgagatgcgaggggcttccagaaactatagaacaagatctactcactactcaaaagcaagtctgtagagttgaaacaaatccaaactttaagatgagcctttttttctgaggatggttcccttctgtgtagtcgtaaactaaatgggaggctgctcactcacgcaccacgtacccagcttagaaacattaatgcatacccagtaagtgcctgtcaccttggcagcactgggggcagaaaggaataagacagtcctcatcatggaaaaagccacctatcaatgtacaacaggacttagaagcaaaccattgtagtgcactgtcaattccacctagatgattttgacaggactacaaagagaaattagccaagggaagaagagaataaggagcatcccaggcactcacagaggcaagaaaagttcaagggttattcggcggatgtggagtccacttgtttgacttgggtgagggagctacagaaattgaagttacaaaagcaggcagacataagtcatatttcatctaaaatgccactaattgtaaaatgaactattatttcatgtacaaccaagaaaaaaaaatgctgctaattgaattttcacacaccattgactgcaaaacatcccaattcaaaatgggttaaaatgcaaggcaatgtgcctctcagaatggatgaaatatggtaattccccaaagaagaaatgtaaaggtgaattaacactaaaaaaactgtttttttaatagaaagatacattcaaaccaaatgtagatatcatttttctcttagcaaatcagtaaaatattgaaaataatgtttagcattagcaaggggatcatgaaatggacaaactcacactaaaaccatacattaataccatctttctgaaaatcacttaggtaataatgtgtcaggaacctatatatgtctgcattctttgagccagcaatcttacttagtggaatctatggtaaatccgtacttacagactcagaagacttatgtacaagaatgtaaggtcacttataaaaatgcatgttatataaatgctaaattatcaatagacatataaataaactgtggcatagtcatagaaatgttagtcaattactgaaatatttgttgaagtatttaataacatgaagaaagtctcataatgtagtggtaagttttaaaaggaaggaaacaaaactctacataaagtattaatctaattcaaatctagagaaaaagtatttaataaagacaggaaggagaggtaatcttggttaaccctgagtggtagcattattggcaacatttttccttcttatgtttatcattttttaaattttcttcaatgacggtatttatcttttataatctttccttgccccaaacagatgtgcttttccaaattctgctcgttaaaattaaataaaaattaaattgtagttgagaatgtaagcacatgcatggagacagaatgatcaataagtgccccttatattaaacaataattatacttgatcctcatgaatacttatgatttgccagtacatgtgagattgggtcgaacagaggtcatacatgccttccatatttctcgatagtagagattattatgagcactatgtcaatactgggctaaatttacaagcattatttctaattcttatcttctcccaaacagatgagaaaacagacattccaagaagctgaagaagcacatgtgagggcacacaatttgaacacagaaaagctgggatttaaacctgagtctcgatctcaccacagactcacactacttcccttgcacgatctgcctctacaaggcagatccttccatagcatgtacagatgaacatcaaagaggaccaaaattctattctttccataggtgagggggacgattgtgaaccaattatagaaatatttatgtccattcctagaggggcctcacaaatgagggtgacagagacaaagctctctgataacgtgagtagactggataactatggggccatgttctcagtttatcaacccaattcccgagaaaccaggcctttccattgtctgtggtcactaagataatggtgcaatgctgtttacccacctggcaacgtaaggcgacacgtggagctggtgcttggggctggtgagccgtgagaacgctgttttgtgcctgtgaagaggaaaaagaggataaggaaaagtaggattgtggaaaaacctgttggacaagtaaatgttcatctgaaatgttatcaagttggggtctgaaaacaatgtttagaagcaggttaggtgaggttgcagggtggtgcatattctgtggtccagaaaagctgggagcatcgcctttgcctttgtgtgtgtgacagtacgcagttcctctggctggaaggttgatatgttgggaccgatgtgccactgagcaatgctacattttaggatcacaggggaagttttctaaataggaagttgcctgggcgtcacccccacagtacaggggtggaggcccagcactcatgtttttaaaacccctcattctaatgtgcatccaggatggaacaggatggaggactatctgaagaaggggaagttctgatttagaatgagggaatcgggggttttgtctctgctttgtccttataggctttacttgctattggaactcaagcaatgaactggatctctctgaagctcaggtcttcatctgcaaaatgacgagaatgacaacaattgcgtcgaagtgttccagtgaggattaaaggaagcaaagtgtgtccagtgctcaggaacaatgggagacttcacaaatgctagtttagtggggtttcttagtttcccagcaactggcaacagaattcctatgaggaaggggattatctttgttctaataaaccctttaatgggtcacgaggcaatgaaaagtcaaaccccaggatgggatcaataaggagagagcagaataaagggacaaagggagaactgagaggtcctgccaaaaaattttacattttttgtatatatgtatgtgggtgtgtacgtatatacatacgcatatatttacgtataaatatatacacacagacacatatatggacacatatcttatatataaacataaatatttatttattcattcattcatttattttgtcatccagagtgggaaggaagaggcctggaagccagattctagcaacacggcagatgcctgcagtctgagctggcagaaatgcagagagaattcctcagcagaggatatccatgagtcagtgttaggttacttccgttaggagtccccacaaacttcccaaacttttagttaagtccactttatatgcagaggcctggtgtaagtggaagctgtgctgattgagaagaccctatgtgtcaatatagtcactgataaagataacaaaagaatcagtttgtggggtggggggaggggggagggatagcattaggagatatacctaatgttaaatgaccagttaatgggtgtagcacaccaacatggcacatgtatacatatgtaacaaacctgcacgttctgcacatgtaccctaaaacttaaagtataataaaaaaaaaagaaagaaacaattagtattaaaaaaagaaaaagaatctgaagactgggcagtgtcagaggaagcagagacttggggttggaggtgagtgggagagcggtaagctttccctaccccagaatccctggggaagagtggagacatgcactttggatgacgtttgatatcgttccattttattttatttatttatttttgagatggagtctcgctctgttgcccaggctggagtgcagtgatgcgatctcgactcactgcaagctccgtctcccgggttcaagcaattcccctgcctcagcctcctgagtagctgagactacaggcatccaccaccatgcctggctaatttttgtagttttagtagagacggggtttcactgtgttggccaggctggtctcaaactcctaacctcgtgatccacacacttcgggctctcaaagtgctgggattacagacatgagccaccgcacccagccccattttcatcttaaacaacagggcaccaatcctgacattgtgtgacaaatgccctccagacaataacaaatgttattgttaatcattattattctttccttcttttctggcagcagtagtagtaaaaatagaaaacataaaattaatccaaatagctcagacctacaaaaactgttaatttgtatgaagtgaagggaactgtatctggcgggactttatttctccattttccaggtctcacagatgccctgaaggtcagagttggtggagaacatagagggtccaaccctggctgtagctgtgcttcagttcttgaacctcagttgagtaactcagttactcctgaggtgatgtttataaatatgacttccaagctccttgattggaccctgaagcagaatctccagggaatggagccagcaatttgaattttaacaatttcaccaggtgattccaacgatgatcttgtaatctggcacttcactggtctaatgaagtgtcttggacactccggggtgaaagatttacgcaaagtgatactctgtgtcaaagccagtgctgccacaatgcacaaccccagtggatgcccgtcgcattgtatcttacacaaagaatggtggaccctgggtgtgcaacaaataggccccattaggaggcactaccagagggcacatctgtgtcttttatgttgtgatccagagccgttccttctctgcccgaaatgcctctgtgtcccacaagattttttacttgtctcatttgacctttgggatagggtttctcagcagtgacactgtgacatttgggctgtacaattctttgtggtgggggctgtcctgtgcactggagaatgtttagcagtgtccctggcctctacccatgagatgtcagtagctcctccctagtcatgacgatcataaacatcctccagatggtgacaaatatcctctagaggcaaaagtgccctccattgagaatctctattttaggttgcagacagggcttcaagtttttatttagagatgtggttcccaatttggctgcttggtcattgctaatagtcactcccacatattaagcagttactgtggccctggtgccatattacgtaggcaccgtgaaatatagatttgttgttgtttctgattttaacattctgacaacaaaattatcccattttacaggatttgaagacaatttttgtctccaaacattttgtttaaggaacttgactaatgttactgagtgttgtgggaggagggaaaaacttaagtcaagatcattcaaagttcaaactcaaagaaatttttcccctgactcttgctgcttcttaaccaacccattgtctgggtttccttcaagcacagtctcccaaagttgtctaagaggaagaaaaacctgggacaattattttaacaaaaatgaaaaacaaagccagtttcccaggcctcactaagctctcggagccagcacttccagaggcgaggtttagggacctgggtatttcacaggtggcccaggtgattcccatcatcaaacaggcttggaacaccttgtgtggtagaaatttccttttgtcgaactaacgaaaagtgtggcattctgctttctgtggatactcttgtgaagttgagagaacaaatttaatgttgcctacatgagtacctgaaaaactgcaaagtgctcaatgaccacaaacttccaatgttgctacctgtagaaacgctattgccaggttatttcatagaaatgcttggtggaattttttaaaaaataactgactataatcttccaaaagcctgcagcttgatagcttttcgtagaggtagcttttcatccccttggtgtcttctttgcaaacactgagtaagggaactctgggaaccttgagtcagtgaaaaagcagaactacaaggccttctggaaatgctgttattttctctgttagcttggtgagatgcccaatatatcaggacagggatgaagccatcccacctctcataaccatgagccatatacaggtagcaggcggggatacataaaataaaactggttttgattttgccacgggccattggcggggggttaggttctgagtcagcctcccactggcttccagttcactgaggatgtgttcttgaaatctctttccatgaggaagctaccaaattacctatcactttactcaaagttccactcatgggagtaatacccaacacatctgagtttcattttctaaagcccttcgcacttcacccttccgttgctccctctcatgtccaggaagaacatcagaaaccaggtgggaacagccagtcctgacccagcttctaaactgtactgtatgatgcacacagaaggcttcagaccacccaccacatggaactggttcttggattcattgtagaaatctactctgtcagtggttttcaatcctggctacatattagaatcatcaggggagttcttaaacaatatgctgacacctgacccttcaccccaagatgctgtttagttggtctgggtgggacctgggcatgaggactttttaatgttcccaggtgagcctgatctgcagccatgagaaacactgccttcactgaatacccagagatgtttctttcagttgtcgggagggaagccttactttcttctgaaacaactggtgtgctcatcctcacggatgtgaatcttgtaaatggtttatttccatttaaacttaagattccagaaagcttagacccagtttatggcataatgctaggaatcaggggaggccgatttagactgcacgtctgcttattaacatttgccctggtttgttccatctatgctagctctactttgtgactctggttttattccatttacttaatcattaaaaaagcaatgtattaaatttgcatgattttagaattctcaaatatctgataaatgaggtaaaataaaagcaaatgaacaaacaactatgtcaatgctgctattgctaaatttcattttcctcatctatgaaattgagaaaacatcaatgtcaggacaataattgcgagcatcaagtaagagtacacacatgacagtgcttagcaaactgtgtcatacaacacagtttttattatttgttttagaaaggtgtgtgtatgtgcatgtgcgcatgcgtgtgtgtgcacgtgtgcatttgtgtgtgtgtgtgtgtgtgtgtgtgtgtgtgtgtgtgtgtctaagtaggtaatctgtcatctttgggaaataaacactttaaggtcaggaattacatttcccttgactcacagcatgtggccatttaaggagtaaacaacccaatccgtcagctaggggcagagatgtcaccactgcagcttatgtgacttgaggtatcctttgacaaatgaatagctttcagatatttcaaattaatgtccttgtttggttcaactagagggcaatgaatccaattcatcaagagtgtggagaagaggacagtgatagaagtgacaactaaggctacccgcctcagggtgaacgcacacctaagactcgggacttcacaaagttagtgctaaagcacagtgatttgcagcttaacctcaaacaaataatttcccttctgcaaaatggggttagcctggccaagcctatgcctgctggagaaagggtgatttaagagctcttgagaccaaacatcatcattattaatggtctggcaatagcaatgttattatagtacaaccagatcccacagggcagaggaggatgctgaaaagctgaggtatgaaagtttctgtcaacttattggccattttcaatttctctgttttagcatattgtaaatgactgcctttctgatacccacagacctctgatcattattgctgagcatatctgccaacatcttctttgtgttccatttgggctggggcacagggcaacaagccattgcctgaagcctcagaacaaatcatcgtttttgcccctttacagctttgaagagagagcatcagtaaaagtccaagttctgcttcaggctgtgggaacactgaaagagtctggaggtcttcaacgccccaccccccaccccccacacactgccctaagagttatcaaccaagagtatataaattagagctgcatattcagagtatttaatgcttttttcctgcacaatacaaccaccatcaatactaggtttagtttcgtgtgatttgaatatgtctgttcatcacaaagaagaatgattaaaagcaagagctattcagagatacaacaccacaagctatttaaatgtggctttcaaaatatttgaatgtgctttgaacttgaattggacatatgaatgaggagttaaaaaaagtgttaacaacctgtgacccagtaattgtatatctggaaatttgtccagtggagatattcagaaatgtgacaaagcgttatgtacaaagagctccattgctgctatttacaactgcaaaaaataaaataaaagcgtataagttaattgcccaacagcagagaggtggttaagtaaattgcgctagagccacagaataaaatattatgctgctattgaaattatattaatggagaagttaaaaaaacactcacaagaaaatgcttacaatccaatgttgtgtgaacaaaccataattcaaaattaactatactatatggccttaactgtgtaaaaatgcatagcgaaagatcataagaaaataaagtatctacaatgattaattgttggatggggtattacaagtgattttaagtttcctattatactgtcgatactttccaaattgagtaaattctatttttactttaagaaaaaaattaaaaatatgtttcagtgaatggcaagcatggctgctttggagaaacatcacagtcgccttcatcagagcaataataccatgcgaaacgatacaccaggaggccctgatgaaggggtggtatttgtgtaatattcagtatcaccactagagggttctctctctgaggccggtttgaaggcatcaggctggatgccataaaggatgtaaaccacttttatccccacaaaggggagtaatgaatgactacacagagtccctgactcatgatggcccaacttaaatttttggacttcatgatgatgcacaagcaatacacactcagaagaaaccgtatataacctttctgtttttcactttcagaacagtattcaataaattacatgagctattcaacactttattataaaataggctttgtgttaggcgattttgcccaactctgggataatgtgttctgagcatgcttaaggcaggatagcctaagctatgattcaaacacagctggtaggttaggcatattaaatgcattttcgacttacagttttttcaacctacaatgagtttattgggacgtgaccccatggtaagtcaaggaacatctgcattccctagtcagactccttatgttcatggcttgagcaggaaaatattgccaaatatacccctttcaagagtaggagaaagaaaaagtttgcaattcagaaagctagcatcacagggctgtaaaaccatatcattgtaccctgaagaaaattaaacatatggaatccagcttaattccatgaatgctgagatttcttatgcctctgataagcttctgataacccatttacttcatccctcacagtcaaaaaaggtgaaatgaaacgtgatatagtcatactctgtgtatgtctttcagcatgcaggcaaaggcacttggtgcctgggtattatgagacgtttaagggaatacaaaagagacagatggttgactgagtttggacagctctatatctgagacagaacatggacaacaatgggaaacattcaaagaaagaaaaaaaagtcttttcatttttccaattccaattaagaggttaactcattgtttttatttggtaatcagaagaacatacaagtacttatgcattactagatgctgggggaaaattatacattgaaggactgtcaggctcatctgtgcaataaagatttacaataaacacatcattaatttttctgagaacagctcagtatactctgttttacatgaatccttatgatttaatcttgtatttggagatatgatgctatggcatttggataacattggttaagcagcatcttagagaacagaacactcttcctcagaatggatggccattcttttaccctgtgatgtacaaatgcaaattacaacctgcattttatctgccagaagtgtatttcacatcatggaagtacattctatcacaaccatgaaatcaaaacaagtccattattaccatcttcccttttggaagagcattctcagaatacatccagaaataccttccttattcctccaaagaattgtttattcagctagtcattggttgaggtttgggttttggttctgcttgcctctctcttttgagtcttgctaaatgttcttgatagtaatccagatatttctcacaaatccagctgaacagcagcaacatctaaagctgaggagatgagttgagttttccattcatatatggccagtgccctcatcaggaaagagcctacagactcaaggtgagtagggtgtctttaggatgctatgtatttaatgcatagggtgctacgcatcctaaagagaaaaaccctgtgagagcaaaaactgtgctgtacactaagggaggacaataacaacatcatattcacctctaggtgactcaccttgctttgggtaattgatttcccataaagatttccttttttcctgcttccttttcccaagctatttctgcctccccatctatccccagcgacctttgacacccaaaactttcccatacgaattgcatggaacaaggtgcttttatttttcccattattttgtgtttgtacgtgctaaaatgatactgcaagcagaatgggttacctggacagaagcaaaagaaggaatttgtgaagggtagaaaaatgggaggaaaaaaaaaggaaaacataaaggagagtttgaaaaagggaagacatttaaattagatgaggggaatctggttgtacagtgggcacaagagctgataaaaacctaaccaagctctacaaatgaaaatagcaaatatatttttgaaaattttatagcatataaaattgtataaaaatatcatcaaagcaagaaaaaaggaaatgtatactctatagttctacctctagaatcagttattggacaatacctatggctgtaggtttttcctatccatctatatatattaatataatatgtgactgtatttctgtaccatcacacatatacccactcaaagacaaggacagtagtacacaaattctactccaagataggtcatgagagggaagcaaagactatacaatgatgtgtctccaggacaatctatttaaaacccattctatagccatggggttttaatgggctttattttaaatgaattaccctgcaccataaactgactgagaaatgatcctgcaggttcagaagccagcactcatgaagaatacgtggctgaagctgaccaaagctgagaggatgagtctccagttggcactgcctctggcctgcaacagccagcattcaccccacaaagggggacaaggtctcctcaggggagactgaatgagtgtgccctgagcgaacttaaagggcccacaccccactccctgcttctcctggctgagcagatggcagcccaggctgggtgcaagtacagttagtgaagccagccattgccagggttaatccacttctgcttgggaacagaagccagaataaacatgaattcatgtcaaatatgtctggcaatattttccaaaaaatgactagggtgggtatttaagaaaacaatcaggaattaatatgtttaaacttgaccatcatacatctttcagtccaggtcatccactgcacaatcgttccttgtttaatataaaaacaagaagctatttcagtggcacaattcttgcttaattcagacattcctggagaagcagccagcctttttacaaatgtccaaggaggatctttagaggcctgcttcccatttttctaatctccctgggaacatgttcatgatcagataaactgtctaatgcaaatgactctggtaacattctaactctagtgtcacctctgtgcccactagtgtctttggtgagagagaggaaaccttaaaaagtaaaatctggccttggcaggtaatatgtctcttgatacccagagggaggttttataggaatattgtcattgctcattataatttttttcattaagttcattttcttagtgataatgaggcctttaatcatggatcacagttgataaattattactttccatttgttcatgcataagatccaatataacatcattattgcaacattatgttctttaacatctaactttgccatggtttggtgctgtaccaatcatattattggtggagcagaactatgcagtgattcctcatgctgcacatagagaatctatttgctgtaggagagtctgtttaaggttttaaaagtttccactcggattctcagtaaatccactgacgttttatatagattggtgtcatcttcccttttggaaagacattctcagataaatcctgttttagtgcttttttttttttgtattgttctgtttttttcttaaatcaagaggccatagagaagtttttattttattttttccataaatttggctatgacaatttctcccaaattacctgcaatttcctatctctggtaataagctatttgtgtgagtagggtatgcctgcatatacttagaagataagcctttagcagtgtgcttggcatatagaagttgaataaattttcagggaaatttgaattttgtttgcattcacaagtggatagtggaattcagttagacgattttgaatgtgtttcctgaatgctgaccgtgttccaaacactgtggtgggccagcactgcgtctcctgtggggtgtgtgggcatctcaggatcagaacaaagtttccaattaggaaaaaaattgttgcctgaattccctaaattctctttatttgggatagaacaccacatacacagatttccaatcttagaatcttctctatttcactatgagaaaaagatttcatgctttttttctattgtttttcctaggctccatggggaatgttacaaagtaatttccatcatcaaagtctctgctcataggttaagaaagaagaaaatatattatattatctatctatctatctatctatctatctatctatctatctatctatctatctatctatctatcatctatctatctatctatctacctacctacctatctaaggaaaagtgacccatgagagaagtgatattaaaataaacagtatccatacttccaaaatatggataacaaaaattggtcttcaacttttggattaccgtctcacatcccatgataatgttgctttttactttacacttttgtatctaaaggcatggttccaagtggaaaatataatacaatggcttaaattctacaaatgaatgaacacgtgcactaggttattctttggctttcagatgtttagatatcattttactgtttaagtgtatcagatccacaatgggatcctgtcaaatgttttcggtagtttataacagctccaaaaatgaaatggacagtggaagaaagtccatttgaatttaatgggttagaaatgagtctcttgtctgctgccataaactattagggctcataacctaagaaagattggcacaaataaaatatggaacaaaggcctcgataagaatgggtcattatgccactgaaacgtaccacattaacacaacttaaatatagagctatttggtgacatggggacccaaattcaagggctaacttgtcacattttatccagggacgtgtagagcgcatggtttcgtctgtggtaggactatccctattgctgtccccacatgctagttaattcttaattcaggtgtgtaagcccttgctctgtgtgtgtaaaccagagtaagatgccataatctgtgcaatagaataatgtttgtcccaaattgctgctcaacttgaagaaagctatttcaagggaattaaaagaccgcagaaaataagctagagctttggaaatattgcttttgcagtcagcactgatttggaataattactttaatgttttatcagctccagtatcaattcatagcatcatataatatagcattttgtatttttaatagataactgcatttttactcaatatcccttcgaaacactttttaaagatttaaagctaagagtgagttacatggagttttgttttgcttcactgagagttttaggtgaagttctttatggaatgaaattctctttctattctttttcagctgattaatgacttaaagcaaatgaaaaacatttccatttttattggtgctagaaaaaatggctatattcctgtttctttttcaaatgttgtttcttgttgcttgttagattataaaatggaagctgtagactttctattttgactggccaaaaagccccacatacaaaaatacagaatataaatgaggtaaaaggtccaggttccaaggtcaaaaattgacatactcttggttatatttaatttcaatacaaaatcataccacctctaagaacatagcttgcaaaccaatgccccatggattgaatgcagctcacaggcatgtttcatttgattagcacagtgtttgtaagtttttgagttagttgtcaatatgtaaaaatttggagagagcttatatcaaatcctaggtatctaggacccccatccccacacagctcaaattcagttgctgcctaccaactaccctgttttgacagcacccaccctctccaatttctcacagtccccattgctccttcctgtcttgctgatacaaaggcccactatgaattgccatttaccacaatgactgtgatattacatggcttgctttattcatttacttgacctgctaggcccctgaagtcatttgaatttctggccacattatgtggtgaggtcattgttatgaacacagggagcacaacagaaaaatctaagtgtttctccaaggcaaaatgtaaagctgacagaagaaatctgttcaaatatcagcatgctgttgtgcattcgatactacaaagttcttcagatctttctgttggggaacattttggcaaggcaaaggtccaggaagaccacatacagtctctttctttctgcctgaaaaaatgccaatatttcaccttagtaataaaaggacgtttaaatatctgttctcgtgctttttcatgtagaaattaaatctgtagtggggaatacacttaaacctattgcctagctctctttctattactaatccccacttcatcatcagcatattcatgtgcttcactcttgggaaggactcagagattcctgtgtgaccaataaccacattttaagaatcacttttatctaaatcacatcatttagactcataaaatcccactttacttgcactcccttagatcccacctgtaatttggtctcaagggggctgcaatgttattctctttccatgctacatctactattcttattttttattcgtgctattaatccacttctatcttgtatttttaaaaactcactaaaatgcaaagaattatctgccatatctccctgatactaattcccttagcactttactgaataaaaagaagagtgatgaaataaaaccacagatatccaaaagaagatgtccagccagtggtaaaaatttcagtaaccacttagttatcaatgctaccagtggaaacaatgggttcccactcaacagtacagtcaccagctgaacattcaggtttatactaatgaatgcacagagaaaataaattagccatcaaataaagattcctatagaataatcttttttagaaaacaaacagaattctgtattacagaagtgggaaaaaaagcataagaacaattttaagtctgaaaggaaattggagaaaacaaatgttcctgactcaggaaaggaaccagagactggaatcatcatctttgcggtgatgaatgtcagcatggctgtatcatcagtagccagtgcaaaaatgacaacatttaaagtaacggcattgacagtcataaaatggcaattactgtgtgtgtggcttttttcaggcctctcccagcatatccaggatgtccattctcatcaggccagacagatgccttgaaagccaggtcattagcaaaggattttgaggatgccccttcatgttttgtttctgtttgagtaaaaatctcacgttgtttgttttgctcaggggaatatcccccagagttctaagacctcaaaccaacccccaaagattcatcccctggaaggagatggtgtgagggaaggccaagggtcagggggtggggggcttgtgtttgaaagttgtacaccttctccagatatgggtctttgtggaagaaggagaagaaggagaatgaagaagctcagctagaatgatgcaagacactggcagcctcttttattgtctatgaggtcttttttactcttgtgaatctgaaaaaaagaaaaagaaaaagaaaagtgtcaatgctgcctttccccccgcccacctccaccctccaagtctgaggagaaggaaatctaggggaccaaaaaaaatgggataaccaattaaacatttccatactggtcattgctgtctcccttgtaacaagatttgttctattcataaggggaaaatgtcagtgcaaaactgtaatatcagtacatttgaaatcttaatagttgctgtaaactagattagcaaacatttggtcatgcagtagggatattaagccaccttcttttgcaatggagatgacggttttgttgccagatctggtcaatctgtctcaagggtcagtgggattggaagaaatcagattcatctaatcccaactgttttcatatcaaaagcaatactcctccctctcagaattcttgccccaccctcagaagtttcccagagacatttaaagcaagatgtatcctagcccaaatcattttgcagatgggtgaatcacctgagttctccactggacccagagcaagggggtggaggaagacgacaaagatggaaaaaggactaggttaatgacaatagacaatattgtatttcttttcaactggcatgctctaccccatgtaacctcaaaggtcttaggcagaatttaaaacaacaaccacaacaaacccaccatattatttcttccaattggtgttgcatgctctgcaagtcatcatgccttatagttagaaagtgttcccttctatgcagggctccagttggcttggactttaagaagggtaacactattatctacagagatgttagaagcctttacaggacaaggaaagtttcccattcaactttaaagactaagatactctcctaagatttaggtgaatttagcagaaaactcattgggagataggagaactccttctgatctattgtaattacagtcaattctcaattttccaggggccattgatccaagcttcctgctgttcctctaactttattatgttcttgattgttcattatgtttaccctccattaacaccttcacccatttgagagaaataacagacaaaagtgaggcttcataccaatcactttactccaatactagcactgataaacttgccagtgagagaaggaggtgaaacaaaagctgaaatcaaggatgagaaattttccattgatgttgatagtctatgcacagtttggtccacatggaattgcaatacatgactttgtccttagtactctgaccctgccattatcaacttgggatcatacgtcatgaggcttcttttagagagtcatcataatactaaccaccttcagagatgtccccagaccctcaaatgtaaagcccaattttgttaggatgacagaaggttgggtttgattttttaataacagacccattggttggaaggaagctagagacagatagctggggacagctgataaagaccactatttaactcagtgagcctcacctggccaacaaggagaatgatgcacctcctgcagactgggttagcagagacccacggtccagactgctgggtcccagagatggaaagaggcctatctagggtcttaatgaaatccaaaggctgctaaaacgagatattcctccatttctaatcactgcttatgggtgagatggtggagtgttccctctggctgtggatctccatcctcccctccagctttgtgtcaaggggtgaagggaaagggtgaataaaagaagtttgtgtgtttaagctgtgcctgtgttcattgtcattaaataccaccagcagtaaaagaacaagaagcatatgttctatagctgggtctgtgacgtgatgacctgagtcatcatccctggccttcccaaacacatgccctctaaaagtaacttctgtttgtgaatttcttaagtcacttaagaaataccctaaggtccctatatcatagctacctgcaaaataatgttccaacccagactgctgactctttgagaacagggaaaacacctcatttatcgtttataacacttcttgcatgtagtgcaatgcctgacacatagcatatgctcaacaatatttttaatgaaaaagaagagaattgaataagcatgaggaggatgggactgataaggtgtggtgatgaataggaggtttccctccaccctttttctaattttgactttcacagcatgaaacaaaaatttaaaagaaaataataaacacaccaattatatattttattcaatagtaaggtatgatatgtcaaaatatttacattccctatgaagaaacccaattatggatggctttctatggagctaatctcacagagaaggagcacctgctatccaggcagctttggcatggtttgcaaatcaggcctggtcctcttttcactccacatcctatctttcattgtgttctggttttatgtatttgttttcaatataaactgaaattcagtaagcatcagcaagactacaaagtatatgaaaatgaggaccctgaagacaaagtgttaataggccactctgtgtgtaactgagatgcatgactttttgaaggccacaaaaagtagttaaatccttccactttttaaagagtgactgatgaattgaaatggaaactttcttgccacatcttggaataattcaggaaactatttaagtgcctgccccttgacccaagactttttatacctcacaaggtaaagctgtgagaactttaaatcctgaagtgcaaatacatggtatatgaattcacagaaatgtatttactctataggagcatacaatcatgtttcagcaacttcatttagaaaaatgggagacggacttaaaacaatgtggccttatttatggtaccatgctgctcccaaaggtaagtgcagatgctgtatataggtcttaaaaccatgtgatttaaagataattggttttagaagaagattgaagttcaatttaacatgacttgattctaaagatgtgtttatccattataatgtttattcctggatcacaaatggagtgtcaatgaggcagccctcataagaatttgccactgggcttaaaaaatattttaaatgcatttctcttccatttttcttggatttgatgtttttacagcctgattcaactatcacctaaactcaaagaagtaagttgacttggctgaagagagagatggggttcaaaaccagattttcaggtcctaggaactctgtaccatagctgcctccctatggagtcaactttctgcaaaaacagcaaagtgatacagcacacacctgacaagttataaaactctaaatagaaaaaaacgaatgaagaataagtgtagagaaaccaaaaccaatttgaaatgtcatgtaagacttctattgggcatatgaatgggtcctcgttttttttttttttaaataagaagaaaacattaagaaaaaacaattttaaagtatctgttaggctttatccaggtatggacttaattgtcctaggtcacaagtacatgacagctattttaaagcgttattttcaacatgtgcatgctttctccttgccctaaataatagagcatattattataataggattatattttcactacaaataatatccatgctacagcactgctaagacaaaatcctctcatcatgtattattccagcacagaaaaataaaacagaaggacagatagacagacacatagataaaccagatagatagatagatagatagatagatagatagatagatagatagatagatagacagacagacagacagacagacagacagacagacagacagacagacagatagatagacagatagatgggcaggcgggcaggcaggcaggcagacagacagacagacagacagaagacatttgtgggaatgtaacttcttaaaaccttgcctatgccattaactcctaaaatttacccatttgatccaaacacacagaataagaacagtacaaagaacagttagtttagtgcaaaagtaattgcggtctttaccattactttcaatggcaaaaaccccatttacttttgcagcaatctaatagttcttaggtccaaccctttccctctttgtctttccttttgctccactgcatctgtgctaccactgaaaataacaatgatgttaaactcttcctctctacccttgttgctttctctctttcatttagcatgttctttctttccaaacataaaatatgtgaacaactgtctctgttcttctgtctcacactgcccaaggtgtcttactgctatcatgctctgttttaagaatgtagcacattaacacaaagacaatgattaaaacactgaactctctaaatgcccccaatgcctggcccacttttagcagacaagtaaaagtcaggcatcagtaactcctacaactcctctgatgataagtcaacatccctgattcacagaggtgcaggtgagggtagagttaagcacccttgtctgcacaaaagagtttagtttctgatcagtctttgaatctgtgaagtcaggaagaagcccaggaccgtaaagaaagtccttcagatcagtaagtgaggcttggattttagacatgaaacattctgactactcttcatgtttttctcaattttattatttcaggaaaagcagaaaagattctaaatgatgagaaaaccaaacaaacaatcattttctcatgttttcactatggctccagggcatagaataaaaatagcatatattgcagcggactaatacttaagaaatgtagacatggtcacttggagagcaggatgcccatcagtggagaatgctaagaaaaaatgcaaagaggggaagcttgaatacttgctgaatactgcatttaatagcttttttagcatgtgagcgtctagaaaagaaatggcattaccaatgtagatagtgttaagttctgcctttggcacatatttacttcaaaggttccctttattttaaatatttaaatataatgttaatagagtttcttttggcaaatatattgttacttgtgtttctccaatcccttgcatagaatctgacaaaatatcatttttttccaggagaaaatatttatttcatgattactaagaagctttattttaaacatcttgaacatcagtattaaggaaaaaagaaaaatcacaccttgccccgtagttacaaaattttaattccctctgtcaaaccagattcctttaaaaatacagtggtacattagtagttccacaaagtatctagaagacagagtgaaacaatgaaagcttatgtagcaataattgcaaaagaaaagttgttcagaaagtctaattttatcattaacaaagagttcataatatacttttatttgacatttctactatggagttacttggtaagagactgggatctaaacacctacataaaaaacatgaattgatgttagaagtttcccttagtataacacaatttatttaaacccatcaatctcatataatatataatataatccacatattatggattggttaatagatattccccaaattcataaaataaaaccaattatgttgggttaaaacatcactgaattaataataactctcatggttgggtcaacctacagcacagcttccaaaattaagtacaaaatgacaatgaagtatctaaatcaaaatgtttaatcgaaaaaaccttttagagtttaattagtgaagttttaaccagatgcatgagaataacagacacctaaaaataatattacaattctctcctccacttattgactttttgttttccttggacagggacatatatatatctatatacacacacatatatatatatgtatatgtatatatgatttaagatgtatgtaatatagtttatcatagagggtatatattatgtatatatgatatatattaatatatcttacatgttatatgtcatatatgcatcatatatcagatatatcatattgtatcatatatcatatgtatgatttatgtatgtgtgtacatatatatgtgtatgtgtacataagtgtgtgtgtaatttcagttgctattttcatactacaaacatgaatttccagacacaaaaatctgcaagaagacaatggtagtcacctgccatcttgttcctttataattcctttatattcattatataccatccttgaaaagcacaaggacattcactgaacctaaaagtatataaaaaatgcattgatttgaaatggacgtttattaccaaaagcgctaactgttctgattcactatgactcagatgaaatgctagaaccatgaataagtaacaggttttgtacgtccatgctcccaagactaaaagtccatagcaaaaaaggaacaaggtgctttttcaggttaacaccgtttggccacttcccactcacatattatggattggttaatagattttccccaaatctataaaaaaaaccaattacgttgggtttaagcatcactgaattcacagtagctcttattgttgggtcaccctacagcacagcttccaaatttaattacaaaatgacagtgaagtatctaaatcaaaatgtttaatcaaaaaaaccttttagggtttaattagtgaagttttacccagattcatgagaaaaacagacacctaaaaataatattacaactctctcctccatttattgactttttgttgttttccttgggcagggacattggagtggagagtttagatacttgtcaaactacttgagaaaataaggttgtaactgctttagaaaacacctgctaaaccatggcatttccttactattaatgttccacatgacataaatatgttaaggaaatgggtcacaggagttttcatggacaaatggctaagggaaatgggatattagtcagaatttgtgttcttatgacgacttaattggaacccaaagcactccagatatttggtccctctttgctcatgaaaaataacctacgcagatgctggattctcatgctgaaagcaattccttcattaaagaaatgtctactttttgtcactacatagaaggctgcagtgggataccttcctagacctaagaaatattatcctttgagacagaaacaagtttaaaacctaaaggatgggattaactatatgtataaactgcctcaaaatagcagattttgacttcagtggcatgaccactagtgaagtatattacaaatgattcattactaaaaacagttaagcactgaagttataaagggttaatttttaaggtaagtagaagagattcaaagttattgctatggcaacactatcttgggtgtgagagaaaaggatggggtaacagcttgtcttcccaattcacattccttggcctattttacacatcacatgatctgggcacaccttcagaggggtgtagagctagtgaaaatctggtagtctaaagtggacaaaaaataatgaggaaaaaaaatcgagaacatctaccttaaaaacaacgcagtatcgtcaagattaaggcccagaaaagcaatcaaggatgactgaaagtgaacaagaataataatctactccaagatattaacacatctcatggctgaattaatgtgtggctaaaaaacaggcaagaaaaggggtgccatagaggggtgcctcttgcactgtcaggatatagcacatgcaagatgacccatatccactcttcttggcagctccgtcccaatgatagaaacagatttcaagatattctaccttaagatcacaattcatcaactaagtccccttacatgttcagttcaccaagcaaccttctgatacaatttgactttccaagtaagttttccttcaagaagaaaccaccaactggccagttgacatgaggatcccagcatatgtggagtatatatttcacattgtacatcagtaaactgtcagtcaaaactacgcactggtcacaagtattcatttcagtgtcaacaaatcctctccagcataatcaactcttcctttactgtcaatatggaattccttgttctgccattgtgtagagctcttctagctaatcagcagcctctctttctaatcatcacatatcccgagctcccagatgaaggaattttgtgtttcccaaatgagaccattcttatataaagaacaaaatgatgaatggcaaagtaaatttcactaaaaagtcctatgtcaagaattctcaaaatgccaaacattttctatgacttatgtgtagtgacgcaacataaactagagtagaagtctgaacaaaaatggtcactaagaccaccatcctctaagaatggtaaatccattagaatttggtcaaaaatcatatcaacagttccttagaaacaaatagatctttcagaaattgagaaaaatattaaaggaattacaaaattctccataacatcttctatatcaagggggtataagattcattcaaatatgagtgtgctgaagacaagtaagtgtgttcaagtgttgctatggctctgcatggaccaatgcatagccagtgtcaactacaagtgataacacgaagccctgtgggaagaaatagcagagattggaaaactaaggtgataaaatgaaacatcaaccaaaagaaaggttttgaggtgtctaaaatagggcagttctttattctggcatataaagacaatccaaaactatcgtcctaagtagtatggggacattttttttttggaagaaagaataacgtgagtatgattccttgagatgagaaaactggaatacaggtgtccatgccagtaagaaaactgataatgccctcagggtccgtataaccagtgaatgcacacctgctgaataaaggtcatgtgacaaagcatttattgtttctcaaatctctggaaatgaacctaagacagaaacaatctctagtaaagacatacatgtgtcagttctacccacagcctgctgtttgactcttttctccccagatctgcaaagcagggcatacctccacatctgtacaggcccctcctatctttcactaccagcttcattgaagagcaggtcatgatgcctcaccctataggcaactaacatttttcaaaatatgaacatgatgaaaattaaataccactcaagtgtaaagttgtattcttctgctgttttcattaatggcttggcaaatcaattcaaatagaacaaaagatgccttaaaagctcagagtcatccattccaaattcatttatgtactccatttcaaactaacttgttaggaatcatctattttttaaaaaattaaaaaagaaaaaaacagaaaaaacacatacatttcttcaggtgaccactgtgagccatgtagcaagtcaaggtcatgagacaacagccttgtgaagaattatataatgtagatatgattagaggcaaattcctataatgtacgcaataacccttttgatcacagttatttgttctatgcaaactaacaagaatactggctaccctgcctcctccattttttctgtactaagattctaaataggagaatatgattatcttgagaaatattcagaaagaatggttgtaagaaatacaatttcctcattgagaaaacaaactgacaaagctgtgtcctgacagccacagtgaaatgcagagctaagaaattattatgtggatgtaatatacatatcccctcatacaagctttgttttatcttaatatggttttaaatttggcttttaattttcacatccttaatgatgtcaaggatcttttaatgtgcttatttgctagttgtatatcttctctagtgaaaagtttgttcaattttttgtatgtttttaattgggtcgttttcttattatttaatactgagtatctatatttaatgaatatcagttatttaacaaatatatgttttgcaaatatccccccagaatgtgaactgcctttttattctcctaatagaggcttttgataaagcataatttatcaatttgttttttatggtttgtacttttgtggtcatgcctaataaatctttgcttaacccaagatcaaaaagagtttctcttatattttcttaactagaaactgatagttttacattttacatttagctttatgataaattttgagatgtcgcttgtatgtgatgtatagttagaaattccttattttgcatatgacatttcaagcagtcatcatcatttgttgatgactatcattttcccttggaattgtctttgccctttattaaaaataaatagtccatacacatgtagatctatttttggagtatctaagctattctgttgatctgttggtctgtgttgatgccaataccatgctgccttagttaccatagctttatagtaagtcttgaaatcaaaccttctctgtagtcctccaactttttcctttttcaaagttgctttgtctattctggatgttttgtatttccatatgaattttagaatcagcttgtcaatttctaccaaaaaaaagcatactaggattttaattgagattgtattgaacctatagatcaacatgggaagaatttacatgtcacctgtctctggaaaatccccaaatatttggaaattaaacattacacttctaaataactcttaggtcaatgtagataccaaatggaaattagaaagtattttgagctgaatgtgaatgaaaatgcagcatatcagagtttggatcatgatgctaaagcagtacttaagaaaatctacaccactaaatgcctacattaaaaaagaaaaaaaaatctcaaatcggtaaccatgactttcaccttaagaaactatgagacaaagtaaacccaatagcaagcagaagaaaggaaataataaagatggatattaataaaatagaaaacagaaaaacaatagaaaatattaatggtgatgattaataaaatatattaacctttagccatgcagatcagggaaaaagagagaaaacacaaactacgcatataaaaaatgagagtgataacattattaaaaattctacagatattaaaagaataataacataatacaaacatcctttcaatttaattctatcatggtccatgaacatatttgtttgccttgaatccttttgaatttattgggactaatttattctcccagaatatagtctatctttttaaatattctgtatgcacttgaaaaagatgtgtattcttctatggttgggtattctaggaatgccaattatgtcaagttgattgacagtgttgtagaagtctttgtttccttgctgattttcatatctacttagtctattaattattgagaaagagataataatgtctccaaataaattgtgaattaaaaatgtttttgtagtttgtttcaagtatttggtgcataaatgtaaaaaatgattatattctcttgataaacagacaacattatcattatgaaatgaacttctttattgctgaaacttctttattcctgtctttgttctgatatctactgtcatatattaatatagccaccaggctttcttttgattagtgttaagacagtataccaatttaaaaccttttacttttgtgctgtttgtgtccttttttgattgtttttgtttttatttgtatatgtttatgcgatacaagtgtaattttgttgcattaatatgtttaatagtggtgaagtcaggaattttatatttgtgtctttttgtataaaggcataatatatttgaatattacaatctcacaatctctgccttttaattaaggcacttaagtcatttatatttaacgtgataactgatttgctttgttttaattctgtgatcttcctatttgttttctatttgtctcacctgttctttgttcccttcttactctttttctaccttgttctggattaattattttatgatttcattttatctgttgctggctaatcagctatatatctttgttttgttgttttagtgattgctttagagtttataatatatatgctcttaatttacctcaatcctccaatgattttataacacctcatgcatgatactgaaccttacaatagatatcccatttctcccctactggactttttgctactgtagtcatatatttcatttttgtatatgttataaaataaacagtacatttatattattttgtttacctagtcaattatcattaacataaattagaaaaatcgtatatatttacctatgtagttgccatttttaatgcttttcattcttttgtacagatctatattttcatacggcataattatccttcacctttccttaaaatttcttgcatggtgcgtctactggtgatgaattcattaagtttttgtatgtctgatgaaaacatcttaatcacatcttggtttctgaaaaatatttttgctaggcacagaattctttgttgattttttttcctttcattaattaaaaaatttagctccactgtcttatttgcattgttccccacaagacatctactgtcatccttatgtttgtttgtctgtacatatgtgtaatttttctctggcagtttttaaatttttctcttcatcactggttttgagcaatctgactatagtatgcttttgtgcagttttccttatattccctgtgcttgagatgtattgagcttcttgaatctgtggatttatagttttcatcatctgacaaaattatagcccctgatttttcaaatatttttcctcctctctcctctacctggggattccaagtacacatttattaggctatttgaaggtgtcctacaattctgtttttattctttttttctatttccttttgggtagtttctattgctatcgttttgctactcttttcctctccgaagtctaattccatccagtgtactcaccattaatctcatctaatgttattctgtcaataccatcaatcacatttctcatatcagatattgtagttttcatatttagaagtttgattttagtcttttaaaaagatcttccatgtgtctacttctgaacatatgggctacagttataagaactgcttttatgtatttgtctgctaattctaacatctgtttcagttctgcattggtttcaattggttgggctttttctttttattattattattattattatactttaagttttagggtacatgtgcacaacgtgcaggtttgttacatatgtatacctgtgccatgttggtgtgctgcacccattaactcgtcgtttagcattaggtatatctcctaatgctatccctcccccaaccccacaacagtccccggtgtgtgatgttccccttcctgtgtccatgtgttctcattgttcaattcccacctatgagtgagaacatgcggtgtttcattttttgtccttgcgacagtttgctgagaatgatggtttccagtttcatccatgtccctacaaaggacatgaacgcatcattttttatggctgcatagtattccatggtgtatatgtgccacattttcttaattcagtctatcgttgttggacatttaggttggttccaagtctttgctattgtgaatagtgctgctataaacattcgtgagcgtgtgtctttatagcagcatgatttataatcctttgggtatatacccagtaatgggatggctgggtcaaatggtatttctagttctagctccctaaggaattgccacactgacttccacaatggttgagctagtttacagtctggttgggctttttctttattgtgggtagtgttttcttgctgcattgcatgcctggtaattttttattggatgccaaacattgtgaatttcaccttgttgggtgctggatatttttgtactctatgtatatccttgagctttattctgggatgcagttaaattactttgagacattttgatcccttttatgtcttgcttttaagattgttagatagaaccagagcagcatataggctacagcttattattccccatgactaaagcaagacaaatatgagtcttttacctaattttctttaaataatgagatatataaatctggctagtgggaataggcacttttccctgacttgtgtgagcatcaggactgttccctctaatcctcttggatggttctgttctggcctcaggtagtttcctcattgcatgggttgctcagtgtagtagtttccctttacacacagaggatattttctaagactcccaggggatgtctaaaacctcagatagtgctgaaacctatatgtattacacacacatttcttttttcttcttcacaattgcattgatagaagatttcattcttagcatagatcttagcagcctcagtataattttttttctttctttattaagtcaagaactttcgtctttttacttaaaagaagtactttgtggcttctctttggcatatgtgaattgccaacatctccattcttttgctttggaaccattgttaagtaatataaaggtacttaattgcaagcactgtgatacttcaacagtcaatctgataaacgaggtggctattaagtgacaggtgggtagtaagtagaaccagtacagtgcggataatgctggacaaagagatgattcacatcctaggtggaatagagcagtgatatggttggctgtgtccccacccaaatctcatcttgaatcatagatcccataacccccatgtgtcatgggagggaccctcggggaggtaattgcattatggggatgagtttttctcatgatagtaaataagtctcacgagatgtgatgattttataatgggcagttcccctgcacacactttcttgtctgccaccacgtaagatgtgcctttgctcctcctttgccttccaccatgactatgaggcctcctcaaccatgtggaactgtgagtccattaaacttctctttcctttataaattacccagtttggggtatgtctttattagcggcctgaggacagactaatacaagcaggatggcatgagatttcatcacattctcagaatggtgtgcaatttaaaacttataattgttgatttctggaattttccacttaatattttcagaccacagttggctatgggtaattaaaaccacagaaagtgaaactgacaataagggagtactattgtactcttatattcttcagacctctagagtttatctctctgtaatcctcttctctccagtattttattctgttaactaaagccatcttggtcttcctggatttttattcaacttctcaactcagagagtcactgagatgtgcctatgtcactcctctctatgctgtctggaagtactctcaatggctatgggtaattgaaaccacagaaagtgaaactgctagtaagggagtactactgtactcttatattcttcagaactctagagtttatctctctgtaatcctcttctctccagtatttttcctgttaactaaagccatcttggtcttcttggatttttatccaacttcttaactcagagagtcactgagacgtgcctatgtcactcctctctatgctgcctggaagtcctctcaaggcagtaagctgagacaatcgtagggctcatttcatttatttcctggctcccaaagatcactgttctccatttcctgatgtctggtatcttaaaaagcactcttccacatatgctgtctggggttttgggttgtttcaggtgggagggtaaatccagttcttgttacttatctttggcaaaagaagacattcatagactgtcttgccgaccctttccactcttcataactcacttttcagtttcatgagaccatccataaacattccagttaccaggatattcaataaaggagaaactcctgctgaattccctccctaagacttggtttataaccacgcagggcctaatcataatctgttgtttgagaggcacaaaagatggctatctcttatttctctgttaatgtgatcaagtaaagttaacggcaagtttgtatttctggatagctataataaattatggcaagtccatgaggctatgttattacaaacatgactaaaaatgcactgaaaagagtatatttgtgtggtaacccacaaatcttccgatgccaatggaaaagtttaaagatgattagaatcttggctcagagacctggatctttttatgtcaatacatttctccctaggggtaagtaaggtactttcaaaggacatccattctttgaagtcagttagaaaattactgctgcaaggtatgaaatagtactgcagtagacttacagagataatgtacagctgcaatgtgttcattatgccaggatgtaatttacctttcagcacatactacttccccctgtgcatgccctggctcatgggagtttgggaatagccaactgtgattcagtttccactgggtttctctctcaatgttcacattgggcatgaattgtacccagatactccctctcaaatattaaagagaactagtcaccaatggttcccagggattggtctaggggtagggacattaaaaattgttaaattgactcccactcattacctgacataataggatccaaaaagaaatgttcaaaaatgtatccagttttttctacatagttttaaaaacaatcaatatatctcctgatctacatatttcctttttaaatttttctgaagtagagagctttaatgaccaaaaagaaaaggataggtgggactcatcaaattgctttccacttcctgccaccaagaattagctttagtcctgttaaaggttttggactaaaatagtgcaagtcactgaagctcaatgctctaagttctattgataccaaagcagtaatgatgtcatattagtccatcaatgaatataaaatgcaaagttgttcatgattatgtttgtgtgcaaacttccaagtatacagacacaccaggacctacttgaggaagtggaagaacaggctatggagggaaacagagacagacattaaaaaatgtctcttttatttatagcagtctgcttactgccccatgagatccagaatcctgctcattaaacaatcaaactttacacttatttgcacaatagaacataaaatctattttatcacttcccccctccccccaaaaaaacctgtttaattcttttaaatacttgggtatgattcagttacaaagggcgcagttaaaaaggctttatgaaggtgataaaatataatccacaatgcccacatgacatcattatagcagatgtttgtaccacaatatacaaatgcaacaagattcaaaatggcatacgaaaaatttgggacttgatttattctgggcttttatgctatagaaatttaacaggaagctgtgggccaatagttggatacaggatggagaaagtgtctgggttctgggtttgaagttgacagcgttcctccactgtacattttctggctttggttgccttgatttggtattgatggctggcaaagagcctctggtatttaaacaaaccttacctataatagagtctggctcagagactgtcattctaaattctattttgttctgtgtaatttacttcttagtcacaattattcaagaagggtacactcattaggtaagtgatttccatttgcataagcacattggtaaaaaaaaaaaaattgcaggtatgtgttccccaggtattatgtaataagacacctggagttaattatttgcattgtctttttagaaaaagtttgagaacggttttcatgcatgcaagcaaagacagcatgtcataacagcttagggctgaaagctaaaggggctgcttcctttataatagatgtgcaaagaattacgttccaatttattcttactcttccacctggttacccagcatttgttcttcaaaggtattctaaccaaatgattcaaagaagagtttagcatcaaatatgatgtctccagggaggtatgatttagagagtctgggattctctcaaaaaccactccgtggaaactttaatttttagcttaatatgatgtctgtgtatgaggggataactagtaatgaacctgtgtgatagctgaaacaatgaagtttatgtaaaaggccagggcaggtgtttcaatcttatagttcaaagtgtgaagggtaatataatttgaactttcaggttttagaaacagtaaaatgttgttaatcttgcgttttgcattgtcattgcctttaggacttgttcttgctggcaaaactgtattttacaaccatatatgctgcctcccaacattagcactataaagacccctgtttttgtttttgttttaaacaaaaataagaactagttcaaggaaaaaaaacatgaaaacataaaacatggaacatttcttatttatgctgcatgattccccatcaaaaaacttataaatacattagcagtatatgatactccattctagctgtctgatcagcaagtctaaaataaactttttatgatgtttaagatgaaaaatggcaagtaggaaaagaaagggtatagaaaacatttgtgatggagaaagtggggtgaaggggaagagatacagcaataatttataaattattgataaagggataatagtaccctttaaatatagtgaagggtttttttcaggatataagaatatattcacaaccactatttcaattttgggtatgattctaacaagcttacattaaactgcacattttatggaaaaatgtaatgagaataatactcttaccatctgttttctttgaatcatttccgatgttagagtgatccttcttgtctgtcttatttttaccatctttgaagtcacctgaaagtaataaacatgacaaacagtatatgtatgcagctgagggggttgttataaacatctttaagtctgccaagttttgaaaaagtgcagcataattttatagtcataagagtgtatgtgtctgagtgtaaatatcttttgtaatcacgttaggtcctggaaattggattgtgatgcagaaattgaggctgaaagttcttgttaaacagagttgtagttaagttatgtgcttatcttctaagagaagcagttaagatttactgttaagctgtggagtgaggagaaacccgagctaactgtaagttctaccaattaatagctatttaacttctctgtgcttcagttttcctatctgtaaaatgggtatgttaatacctaccttataggcattttggataaattagaaggcatatcactcaatacagttattattattctaaaacagagctagaaatggtattttaataaatgatcttgtcaaaatgtagtttgtaaaagttgtaaaatgctattcttagaacacgtgtcaaaaatgtatttaacccacttatgagggaatagtaagaggattccaagagtactggagctgggtattgacaggtattttagaaacacgtgaaaatatatttgctaagttagagacaaaactgggtatatcctacagggcaataaaaccataacgtttggggttatcttctctctcagtcaaaaatctataaattagcatataacttcacagtacctaggcttgaatcaaatagtaagtaaagttaaacacagtcatgttcttcaagagtagcattcagcaaattaaggcccctgggtcaatggtgcccaccatcgattatggcaaatacattttcttgaaacatggccacacttactcatttacctattgtccttggctgctctcatgctgcaacagctgagctgaatagttgcaaagagacaggcaaagccagaaatattttctctctggttctttacagtataacagtgctgcatccctatctaaaataatttaataatccctgggcatgtgtgttcaacaatatgccagtattacatgaaaaggtcaggggcctcttcacccagccttattttcaagtgttggatattttcttaccagtcttactaatggaagctttctttttagcctgcataaaaccaagaacacattctcactcaaatactggtacttattgaagccaaaagatcccaataataattggagtgagctgggcctccagggaatgtgtatgagggacaggatttactcttgtttactttatttgtgccaggcagtatgctaaatgctttgcatgcatcattttattaaatcttctaatagccccattatgaaggggctactattattgaaagtagacaacttcatcaaagattcattcactaaatgtccaatttgtaaaatttgctgaatatcccactcaccaaatgattgaggatgttttccaaatttaagtttttttcttgaggttcctgcagccagttagacaaacacaggccattccatctatgttaaggggtatggactgcccacacatacatttcataccccaccctgaactcacatctgccacaaccatgcacctggatctccctcttggcataactgccaagccctcaactatagtatttgcaacttctctatgaagttcaagttttagatttcagacttctgtttactatttccatttctaaatgcctttggcctatgaatttataaagaactgattatctaagcatgattcaggactattgggggctgtaatatattctacaaaccacatacttgcaatggaatttgacaaatactaagctaagctagaagtcaataaactcttcaggttccctctcattcttaattctgaaatgggatggaccgtgatatggtttggctgtgtccccaccaaaatctcatctttaattttacctcccataattcccatgtgttgtgggaggaacccagtggaagagaattgaatcatgggggcagtttcccccatactgttcttgtggtaatgaataagtctcacgaggtctggtggcttcataaggaaaaaccgcttttgcttggttctcattctttcttgccaccaccatgtaagatgtgcctttcaccttccaccatgattgtgaagcctccccagccacgtggaactgtgagtccattaagcttcttttcctttataaatgacccagtcttgggtatgtctttatcagcagtgtgaaaacagactaatacacactaggtggaagaattgaggagcaggggagtctactctggccagggtccaaacaggaggattttaagtgcaggacatggtcatcacctcttccaccaccaaaagagaagaaatccttcagaggtcccacaaaacagtccaaatactggcttttccctattttaatgaagccagagatggactcaaggatcttgagcactgtagtcaaactagttccttctagttcattcttccctcaatgagcccccacactcttaatgcatgctttttaagccctctaggttgctctgaactggagctttacccacagctacagcaacaccaggatgtcttctggaagtcgtggagatggttccctttgctggttgctaaccagcagcccatgatggttcctgttctcagccagggatggggaggctgtgggaggaagtcatctcaacagagggcaaagattagaagatcctgtcactgccagtgggtgcccaaaccttgaaaacccctccttcaccaacaaccttcagctctaacttggaagatatcctgggcactccacaaagaagggggctgggacagtgacacatgcttgtttgatgatgttgcctgagcaaaatccattaagtaatttcccatgggttgtatctggagtaatggctgacgtgagctgttactcaataaacaaggggaagtgaaagagactttctgtgcagttataaatcattttaattaggctgctgtaatatagtcccgaaccaccattaggctttcttattattgctctaaactgctttcttttcccacctctcatttactgcttactttttaagggaaatggtagactgttgcttatttcaggaaataagcacagttgtgaaatcaagccagccttgttgaagactcaggttcctgttttgtttctttcaggctttccccttaaccaacttcaaaatgaattattatttccacatctgccctctctgggtctttgtttccctatggtagaattcatatccttctttgtgactagcttatttgcatttattggtttctcccactgactagacctggggttggcaaactatggcccatgggtcaaacctggccctactgcctggtttttcatgacccacaaactaagaatggcttttacatttttaaatggttaaaagaagacaaatattttatgacatatgatattatgtagaattcaaattttaatttctataaataaagttttattggaaaacaggataactcatttgtttgtatattatctgtggctgctttaaaatggcaatgttgagtagttgcaatagagaccttatgttctgcaaagcctaaaatatttactatcttgtcccttatagaaaaagcatgccaatccctggaataagtatattgtaagcctcttataaacagcagttaagtttccatatttctctgatggcccctctccctgaaggcaccaaaccacagggacaagctgtttacctaacagagcattgagactcacacagatcagagtttaacctgagatctctacttaatggttgcttgactttacacaagtgatttcacttctctgagactcagtattcccacccacaacatgggaatgagtttttctacctcatagaattgttagaacttttacatgatttaatgtagatagaatctcaagtacaatgtctgatacatgttaagcattcaataaaatggtggtattattgttattgcttttactaagggcaagacatttctaacccactctgttaaaagaaaaagcagagggaagaaacacaccttgcctttctcaccaccccttacatgttcctcttttgagaggagtgattatttatctgggaggtagggttgagcatgcacagcccggcccagccacccacatcccagactgctttgagatatgttttctgtaagacacacaccttttctgtcactctagaagcagcctgccagggtgctggggtgggggaaaagtcctgtgcctggctatacagtgtctggttgtgtaaattcatttcagagcaaaatgtaaagaagcccatgtattcagcagaccaactctgtgtttcccaagttccagttttagtggagctgatgtcttgatcattgactttctgattttgttacctatctctcagttggttcagtcctcagaaggggtagcaaggaggggcctgtactgccctctaaaacagtaacaggtacataataaatttttgttttaaaaaatttttgtatgaacatatgtttttattttttttaatttttatttccataggtttttggggaaaagatggtgtttggttatataagtaagttatttagtggtgatttgtgagattttggtatagccatcacctgagcggtatacgctgaacccaatttgtagtcttttatccctcacacccctcccaccctttcccctgagtccccaaagtccactgtatcattcttatatttttgcatcctcatagcttagttcccacttatgtgtgagaatatacaatgtttggttttccattcctgagttaattcacttagaataatggtctccaattccatccaggttgctgcaaatgccattatttcattcctttttatggctgaatagtattccatcgtgtgtgtgtgtgtgtgtgtatacatatatatgtacacacacgcacgcgtgcatatatatgtacacacacacacacacacacatatatcacaatttctttatccattcatggattgatgggcatttgggctggttgcatatttttgcaatagtgaattgtgctgctataaacatgtatgtgcaagtatctttttcatatgacttcttttcctctgggtagatacccaggagtgggattgctggatcaaatggtagtttgggtacatgaaaaattcttattaaattctttataacttttttttccagactataatgcacttgaatacaaagcaaatgaattaagagcaatctccagaagggggcaggacgagtcgggacaatggccttctgtgcctcctagggtggtcaccaggattaactgaagtaatttttgcaaggttcctggaatatgatataagctatcattattattacatgtgttaaaatattgttctctgattacatgttataaatggttaattataaaaataattggagaacatcgtgctaagcactttctacatgtagaaatcattgaccacggccctgtggcataatagctagaacacggttctgagtagattacctggtcgcaccaggcaggcaagagaatgaatatgtacaaagagaacttaaaacagcatctagtgtgcagtcaatacatgctatttgttgttattctcttcactgtttttactatcatgagtattactgaaggttccatgaggcctgtgctgtgaataggtattactatatacattgtgtagaaacagtagaaggttaagtagcctggccaaggacactgaaaagggagaagcacagcttgacttgaatctaggtctgttgactgctaaattaccttgctattcagccacaacctgtcaattgcaagctctggagactcagaacttcctgcctgcccctaaacaaggaaaccaaatcaaagccctgtgtacttgctcatcttgttctctccactcagaagtatctttagcccatctgaccagccagcttcagcattcaaaaccccctcttgaagcctactctgacatttaccccattttataatccccagtccccaaaaagctaatgtgtttttctctgcacatgttcctcgggcattttatctgccatgtcactactttcacttgcacatttcactagaaatatttggaggatgtctctatcacctttgatattttgggcttcttgtggcctttccatttctaaatccctagtgctaagcatggtgcttggcacgtagttgttaatcgatatttgttgcattaaatataagaaatcaataactatatgcacactatggtgaccagcttaccccagtttgcctggagctcttctgtttttaaaacagaaagctctgtgtctcccagtcccaggtaaactgaaacagctggtccccctaaagtacacacttgtacacacacagatatacagatatctattacaggaaaaggctcaggcaaacctgaggtctggccctcatagagcgatggtatatatgggaaaatgactttccatttacccactttacactcaggaatgtgctggggttgatcatggtaattttcccccagctggcaggcaggcaggcactggctagagtctccagggcagctggaaatggccagaaaggtatcaatctccctgaagaggatggcacaggtgagctggtagctgcttctgctggaatcctgcagcccaatgaggtgggatcagaaggaactggatgagcagggaagccttgccctgtgagctgaccccatcagtagggttgttcaccagtttccattcattatgtcattaatgccgcgaaaagagcccttcaccagtgtaagtctactcaccattctgttgctgttctcctgatgacttctcggctttggagtttttcccacgagggttgtcacttttgtttgcccgtgttccattgacttgattcttagtttctccagacgtctttttctcagctttgccagatgcgccttcttcagcctggcttttggcttccatttccttttgctgctcctctgcggccaggcgagccttttcctctgcttccttcttggccttctcctctgcatccatggcaagttgggaaagccacagaaaagagaaaaagaggtcatgccgttaggagaatggcctgttttagtacacaaagagtatctaaggtgtttactgagtgtttgggtacatttttgcttaattcatcagattggcatgtatacttaggaaacgaataaaataggttcataatgatgtcattctgaaaacagttagaggagaggtcagggagaaaataataaggataataattaataaaccaatattataattgtattattaatatcaccgttattaatagcttctattgaacgtgttcgctctgccaagtattatgctgagtgttttttggggattatttattttcatcctcaaaacaaccttacagcagctactattactgtgactcaatttgacaaatgtggaaatcaaggctgagagacatcataaaactttcccatagccacagtaaaaactgcagcttcatgtgggcttgcttaagacctagagtttaaacacaaacaattgattacaaaacaaaaagggaaaatatccaacactagagcaattgaagacaaacacactgaggacactgtttgttaatttaaaacaaggaaggggataattgagccttatgaaaaaaacatggtcttcaaactgtccacaagatgagaggtagcctttagtttggccaggtacctggtctgtgtctttccttttaatgaaaagatgctagcattatttctaatccagttgattataaaagggcttggctctgtgcttagtcaaaaccaccgcagaaatgcgtaggttaagtatttatgaaaagattggttcactcatccaactcatatttattgagcagttgtagcgttaagcactgttttaggtacgaggaatacagcagcaagcaagtggatttataaagaggagatcataattaagtaaacaaatgactaagatacttgcagtttataaaaagcgctttgcagaaaaccaagcagagtaatatgctggaatataatcagcataggggagggaaattgcagtagacaaggaggtggagaaggaaggcctccttgacaaggtgacatttaaccaagtcctaaatgatgaagagctggccatgcaataatctggacaaatagtatctcagtcagaggaactagaaaatgcaaaggccatgaggtagaaatgagcttggtatgctcaaagaacattgagtatggttaaagtaaatttgacaagggcttagtgatagatgacgtggtcaaatgaccaaggacaagcagggttcagatcatgcagggctttggaggcaatgaggtggcattgcattatggagaataacctacacagaagacacataacagagcccaatcctccaaggttctagagactcatcccatgcagcgcttaattcactgccaaggtcttctagcctgtgccatcaacttccactgggaaaagtattattacatttttctctacatgtgttttaaaatgctccacacatcattatcaggtgtttactttatttcttttgtgttagccttggtcctagaaaaaagctaatgctcataaataatccatttgtttttaatctaatggacaccagagtgactatgcatctatcatgtttccctttgttttagttgctaaagagctcaaagcccaaatttggtccagattcacacgttcacgaggctttatgacatgtattttgtgaaagtctatgatatcttgtttagtctacttctcctgactttatatttgcttacctaagatgtcttccttaatatattatgttttcattcattgatccatccatccatccaaaccaatgccctagcctcatccccaaacaaattaaataagattctggagaaggaggggcaagaataggatagtttgaatgttttccaggtgatttaaacatacagagttgagaagcactgatttaaatgttaaatgtttgccattcagtatttcatgacattctactccccaaaaggatgtatttgtaatttacattgaaaaggtgaggaaagatttctttacaaataacataattatgtgcatgtaaagtataatgtcttctggcctttatagaaaggtacaactacagagtgaaagaatgctcttgcagaagaagatggtgagatggcattctcagtaggatgcaggaccacaaaaggttccctggaatgttcactcaggctttatctcttccttcttcagtgactgaggatggggtttaaatgtcatctttgctactgaattcccagtgcttagcatggtgcctggtgcgtagcacacactcgaagtatttgttgactaaatgaaatgtaccctacgggtgtgatttatcctatatgcaagtgtaaccttatctgtatgtatcttcatcagtcctcagcaaattaaacaggcataaaatacagaaagtatataaactctaagtcttattctgaaagagtagtcatttgacaaatgttagtttccttaaccaataacgtaggtgagtaaaaagatgactatttttactacagagtgggaaactgaggcaaggaagaggagaattcattcatacccagaacctggtatcaattttagaaaataatttataagcccctcacagaatccccactgaatccatggcaaattttcaatattcaaaataaccccaagttggaaataattttgataaaaactgaaggtattaaatgctggtttgctataagagagtataaaatattatctgagcaagagaaattcatttgacaactgagtcagaccaatttcccatgggaaatctagctaaaagcatacaaaaaactggtggcggggggtatatttcagaaacaaacctggtttttcctcaactgtagctatcgggcaattcaagtttacatgaatgaatggtagcccttctgacatcatgatctaatcagatacgagcctatcctactgtatgatttctctacagcaatcatgttccagcaggtggtcctgcagcttttctactcaatttccatctcttagtcacatctctgagatagctgacattagtgtgatcgactgcatgacacccaaagtggtacaactcaaaatttgtagactgaaacaagcaagcacataaataagaaaaaagaaaatatattgacaggaggtaggtctttttaactgcaatcagattcctttatattttctgggtgaaattatcggtatagatgaaattttcgtataacaagaaaaaggacttgagaacagttattttgtacatgctcacagcttccaacgacagcaagtatacagagaattcacttttcaggtcttagatttagcatctactaggcttcttgactagtagaaagcaagagatgtgcggttcatttctgtttcctttggcttcccatgtcagactgtctgtggtgttgggacttgggatgaaaacagccaagagcaagcagctaagagttaaggtagagcagagccctcgagatccataaatttgcttcctcccagtggagagccagttctaccccacaatgcatgtccgtacagttttggggaaatacattgatttctttgtcttcctgaataatgatactatagggtctcagttaaaaactgtattgggctaattatcccttgatataattttctgaaatgcctacttaaactacctacaaccagagagagaaagagagagaaaaaacagagaaaagagagagaaactgaccagaaaacccaaaatactatatgaattttgactatttcaaatctcagttctatacaagaacaaagaaaggtgcttctagacatttaagaacatagaaggtgttcccgcttcctgaaaattttagtcaaagaaagaagtgctccagctgacagaaaacttcaatcaacattaaaaactcaaaaatgagaaaaatatgtaaacgaatcatatactgtaaatctaaatattcagtatcagaataaaatattcaaaagaaaggccaaatacaagacaatattatattatgatcccaatttgtcggcaaaatttttacttatacatatgtacagaaaagcaaattacaaagaataacatcagaattttaataatagttatatatgtctagagaggtaattagtaattttcattttcttttatatatattttttatacttcagcatttgtaacctaaacatgttagtcttacaccagaaaataaatgttaaaaaaaagtactaaatactgaatggaaattaatcaatattgatcagacttgaaaattgttatgtccatacatctttagttggcaatagtgatttttaactctaagggctataaaaatatttatttaatctttcctaataattatcagttcttgcctacctagttttgtaaatcaggttggttaacaaaaccaagacccatttccagtgcatttactaacaatacatgttcaagtgccccacggaggacagcctttcttgaaatcagggtcatctggaaaaaaagagcaacaaacaaaacagccaccaccaacagaaaacagatgcgaactagatttctaattagcaccagtcaaccagtcaacagcattactgagctgctaagaatgttataaaatattagttacaggttgctattttcaccaccaccttaacttcgtattcaaacctttaaccttcttttccaatttgcatacataacagctactacttaggtaccaaccttgtgcaggctgctttctcagtgctttataggtattacttctattcacctcaattctgcgatgtacattatcatccccaaagtgagtctcaaagaacctatctgaatttgccaaaaaaaaaaaaaaaaaaccttgcaagtcaagactcaattctctctccccttccctgctaattgaaatgtgccctgataaccaaactattctcccacaagatatccgtaacaccaggctctgtgcctttgcccaacccctttcttcttgttcccatttctaaatataacacctccttcaggtcttaatcccagaagtctgctacatgatgccttcccaaactcccaagcaaggctacagacaacttctttgtgcttccaaaatagttcaaacacacagttatctctatccccataccaaatgcatttaaaaattattagctgtttatttatctgttctttttaaagggccagttttctcctgaaactgtcaaatgcttccccaggtgattagtttctgaaggtaattttagtaagccagataattgcaaacaaattattttgaagtacctctttaaattgcatgttgtcagaaattgaattttcaagtgtaatgagtgtaattgattataagagagtgtttctttgcagatgatgcagtagctgccatcgctgcttgcaatgcctgccaacagggaagattgaaatgtttaaagcatttgaatggactaggagagggtgcacttaaaatatggaaggtgttggctccctccatagctcagggtgcaacatctgtcctgaaatgataagggttcaattatgccctaaaagtgccataaatataaaccctttgcctcacctgaaatgagcagccacttgaacagaattttatggacaagtcacaaaattggacagaattttgtgaacaagcctttgaataactccaacagtgaggctgctgctttcctacactagaagcagaacccccagccccaacccaatatatgggaaccaacactgctagaacatgctcttacccaccgtccccacccttctcacctggtatactgacaccaggagggtaaaaatgtgagatgttgtgtttggggaggggataatgtgtttttgtctgatgtgagggcctagggcttagactggtggtgctggtggcaacttcagggctttgactgaacttccattcttcctttgaatgaaattctgtagtaatgtctcttcccttcccctgccacaagattgtgagttttgagggcaaggatgtctgttactcatctctgtaccctgggcaccgggcacaacctggcacacagtaggcatgcaatagatgttagcaaaaaccgactcttgttgaaggctcacctctaggaagcccagtcccctcactgggctcccagagccaccatgtctttgtccctacctggaatcagacatcacagtgtcagaccccttatctcaggtttgcgctacctgtgcacaagggcatctctccctagtatgataatgtagaatgtaccgatcatggaggacatgctcagtagtcacaaatgcacatatgaacaaaggaatgtaagctttccaaatcatacaaatttccatatttttctgttgatagtaccaagggccacaacttttagttttgatgatgtctgcttcagggaatttctgtttaccgacaatttaccatcatctcagaagatcagttatatggtttgagcaatgagtgaagggaaactgagaatatgaaaggaatataaaaatgcctgtaagaaaattaaagctccttatatcccaacataatggccaaggcaaggtggctattagcgggtctttacttaggtaaaagaagaaataaaagcctcacagttgtgccacatgatatcaagtgaaaacgacaagatgtttagcagaaatcaagaaataataacacccatgtcctgtagagtcttcatactagaaaaaggagtttagtctcacagcataaagggaatcatgtcaggaggcttgcaggtctgctgcattttatcatgcattgattcgtagatattatgaagatcaaaagatggtagattctaatattcggcaatttgaatctgcatcctgagcaactgtgctttatttgtaacacacataactcagagaggacaaccttgttttatgctgaattggtttggacaggtctgtggcatgttacctttgggtaccttggccctccatctctcccgattgatgtgcaccacttccgtccaagtagctttaaagctcttatagtcaacggagatgacagaattgttgatcggggcacttccctctgaaccagaggtcttgacacctgatcgcttggcatctgacgagctgatgctattcaaactggaaaacaaaaaaatcataccaaagaagagagttagtgtttggaaaatgtctgccaatgagcaagcccagaggaggaatggttagcactcctaaagttattgctgtgaaatatctggatcctgaggtttataattattctattttccacatatgaccggtgggaaattctgaattttcagcaggaaaaacatcaacattgcagtctcaagagtctctatattcttcatatttcttctttgctatttggcctcttcttttttccccataaccagaatcccctcatgtgaattttctctgctctgttctctgaaactgactaatttgaactgggacatctacttaattccacagttcacctacctgcttccacactgaccacttttccaagttacctagcaacttgctcctctttctttccagctctaccattcccctgcaagggtctttctgatcccagcatacccaagtccaggggaagtgataatttccttaagttgctggaagaagatggaaatgcggacagcatggagattgtgagggactaggtcatgcaaaagaccttatgggtaactttgtaaatattagaaagcaccatctttctggaaaatctcaaagaagtaactactgctaccaagtggttaaagaagtgactggtaggaatacaaattcatgatggactagacaagcagaatatatttcagtcactgcctgaagagctgtggggccatggggactctggcagggggctctgtcctccttgttagcaaacttaagagggtctatccatctggagcatccctggggtcccctgtcctaacgcctgtctttctttactccttttcctgctctttgcttcttcttttcctattcattccacttctcttcttcctcctttatgacaaagcccactgttctacatgaacaaggagattagtagtagtcgtaatagtagtagtatatctaataaagactttatggtagctagcacttcctctgttctagatcctgttgtaaggtttaacatatttttaataacttatttcgtcttcccagtcacctctgagtattataatccacgttttctcagatgggggaagtgagacaattggcctgcgattgcacagctagtaagtgatgaggtcaggagtaagtgatgaggagctgcccttgatataatgatgtggtggtagaaggtgatttcaagctttcgattctttttctctacttcattctttgtgcaaaccttgaaatgaaagtcagtttcatttctttgtaagtattcttgatgagtggtactgtctttgtggagtattacatgagcaaggattgtctgggcacagcaggtaaacatgcagcaaatagggtggcaggggggcagcaccaggtgcctgctggtcacgatttagaccttggtcaccctttacagtttagcctggagagtacggataatacaatttcaactcctctgagaaaaggaaagaggcagacaaatttttctgagaaggagctaaggcaaatgccattatgaaataccatccccatccccagcaaaagaagaattctatcctcaaggacaggccaacctcaccctcagccctcaagcttccccactgacctcgaacgcctctgtcctgtcccaccagtttgagaggtttcatcgattaatggactcacaatcttctcggtcatgtccgtaagcacagtgaaggtgggttccacgatgaaatcaatgaaacctgaagagaaacagcaatgcttcagaggaaccacatattaccttgggcctttccatactttccagaagaaactgatctagaagttccagatcagattaaaagagaatggcttgatcttatgtactgtatgtattccttgatttgaatattacatgtcagtttcatttctcctacataacttcctatgacttttcaggatacagttcaataaagtgcctaagaaatatacactcaacacccactatagaacaagcactgtgataagagctgtgtaaaagaccaagactgaataacacaacctgcctgaagttgtgacatttgagctgaacccttaagaatgggtggagaggaagatgtggctattcactctgggcggtgggaatggaaaaagccaagtgacagagatgggagggtgtaagatgtgtctggggactgactagggagtagggattcttttggatttggggaaggaaagcttgggaaggcaggttatcgacagctctaggaagggaggcttctaagtgttcagatagagggttgggacttaggtggacactggaggctcctggagatgtttgagccgcattgtcataagagtttttaaatgttctttggaaagttaatctggcaagatagataagaaggaagaaagcaggaagggagaaggatgagaaaatcatttagaagctattgcaattgtttaaacaaaagataaagaaggctggaaccagtgccactataaagtggaaatgcaaagcaggcacagatacctgcacagcaggaggtggtactgcctctgtatgggatctgccaaagacactccaacaacaaagcagggaaaacaggaaatagaaggagaataaggccaagaaaagacaatgggctcagtttcagatttgctgactttgaggtacaggggggcacatctagatgggagagggcaaacagagttggaagaaacaggattggaaagtggaagagggctcaggcctagaactatacctttgtatagtgatagagagatggctgaagtcgggctacagagattgtcccaacagctcagacacccaaatgttctgcgacaatcaggagagaaaataggagctgaagctagtggggatgctggtaattcattacacagtcacatgaaaaccggaaggaaactaaatatcaaccagaggaaatgttgtccattctccttcgaagggcatgtttggaaatgtatgaatgcatatttagttttcacaatggcccaggtagaggtaaagctggcattaatgcccagcagtaaaggatgttaaaagtcctacaatgtaattgacaaaacaagaattgtctcaaccaaataccaatagtatcgtgattgataaggaaacagtgatagccaaaagtgtattatggttaatacagtgttgtaattgtgtatgtgtagtatgtattgtgtattatggttaattatagtgtagttttaagctgaaactaaagtatttgatgacaccatttttgccttttttttcctgacaaattaagctcaacatgtccaaaccagaactaactcataagcttccccacaacctttgtaaatgggatcatggtccaaccacttaatgtagagttctgcctttatctcagctttgcgttcagccaaatccttgataccttatgtgccacctctcttctggagaggccccgttactaccttagttctgatattcatcatctcttctttgtaatcctgtaggaggcagtcaactactttccttgcctctaatcttactgaaaatcctccaattaatcctctatgctactggcaaagaaatcttctaaaaacagggtaggcaaactttatctgtaaaggaccagatagttattttagactttgcaggccatatcatcgctatcaaaaccacttaactctgccactaaagtgctaaagcagccatagacaatatgtaaatgaatgcacttagctatgttgtaataaaactttatttacaagaacaggtggtgggccagattaagcccacaggctaaaacataaatttatatatttttaacctcacttaaaattctttagatatgccctcatttcctacaagaaagtataaacacatgctattattaacactatataaaatctgggcttgatacgtccctcactacatcctactccgtacccaatgttcttgccatatggaaatgtttagaatttgctgaccataccaggcagttttaagtttccctgctttgtatatgctacattctctgcctggaatacccttctacccacccctagctcacctccaacacagatcaccatttgcccagacaatgcctactcacttcttgggactcaattcaaatattatcccttaataaacctaatggttcacacactctgttgtgtaccttatcgtactaggtacaaaagtctaccttggcattataacattctaatagatttttgtttttgtaacattttgcccatcacccaatactggtttaatgtctttgagagcaggtaccatatataatttgtctttgttcctataacatctattatcatgtctagcagtgcccaatatatgaagactcaatatacattataaaaaaagcataagcactcaaaacacaagtagaaaaatgcctaattcttattgaattttcttaaatgacttcagactcttcaaaggtggagatcactgacaacatttaacttagatagggcactggtgtcctctcccacagatgaagatttttaaaatgcatatattatggttattagcaattcaaaagttattcttaccttaaaaaagtgctttaaagaaaagaaaggatggaaggaagacaggaaacaaggaagaaaacattttaaaagatccattcatggaagtagattcaacaaggaaatggggctgtcctgaaaacagggctaggagaagcatcagtgagtagaaatgccttgttagcttacagtcctgcatgcagaatggcgggatggagtagaatgggcttcctgccaatgacacttgttatctccttggaaagttggggccccctctttctcttgacagggaatgacagagacaccaagagtatcattgtccaattctcccatgaacaagccacattccagggaaaagaatggacagagtggttccataaattgaatcaggcagagccatgagcacaacatggcagaatggagccagtttcccagccaaagaaccactgggatcatctgtgcttacttctacaggcttcctgctttggtgcttctatccaaagagctgcaaacacgtacctacttgtgactgagcaaccatagtggactttcggtcacacagaggagaaaaaggcagccccagctctgcttctctgtcaccctggaaaaataaaaggtcatagtaaattaaggaacagtaggctgggtcacccagatttcatttagcaacttctgccgccacggaggccactggtctttattttaattattacaattacattataaaataagtctttatggagcctgcttctctacataaaagacaccaaaaggctgaagccctctgggatccaatagttccacccaactgcaaagttcatgttgctgtaaagaaagcctcattgggcagtactaggacctccatggaaaataaggcaacaggcaatatgtcttgtggcctgcagccagcactgcaggcagaatttctgtgttttctcaagtcatcctgggtcaacctgtggccattgtttagctaatgaactcctcccagatgtgggcagtgtctgaaactaaaattcaaactggactgattcagactgattcttctagtgctacctaaagccacacacacttggagcaagtgcttctgggtttttaacctcagagaccagtccataatgaaaagtggaccaaaaagagaataaataattgcttgtgtctatgaagttagacaacaataaaacacaattgtctaaccaatatattctcaatctcaccaaaaagcatcaccataataagcattatgaagagtctaaataataatggagatgttttctaaaaacttgggccagaggcttaatacttgtcatacccccagaggaaaggaaaaataatatgtcacccttcttatagtagtgaagctgtgctaattcattttactggctcaggataatagctactgacttgtgcttgaatccctttctcctactagatgtgagatagatcacaggtaagttattttccttccatacattttagtttttatcacttgctaaatgtgagatagtaatctctacctcatagggttataaggatgaaagaggaaaatgcatgtaaataaataaaaagaactactgttgtttcccaacaggtggctctaatatttaaggccaagactcgagaaacctttagtgaatttgttcacctaatacactccgattgtaataagtactgtcaataaattaatgtaatagcaaataaagggtagtaacaacctgcaaccaggcctggttcaaaactggatgattcttccttctaaggcatgctaccaaagagaatggatattggctcacatgtagcattaactgaaaggacggaaaaggggtgtgtgtctgaggcagctcaacagtggggtcacaatgggagctggggacatccaagggtctcaggaatagtccctaagtggctcagttccttctgcaccctcttcctatatagacaccccagcggacacaatggcttctttatttcaagtacgcactactgaaaactgctctctcaagtggcatgataaaaatgatttcctcctgagtgatttctacctaggtgatatgtagaaaaggaagtgcatttataacataaattctagtggtgtagatggtttggtgggatagttcagctaaaacaaacaaaaccctttttattcccatgtagcagggatacaaattgttctgtcagtacattttaatggggagggtgtgaacactctccatgactattaaaatataaacactaatttggatttcattactgaacaatcacctgatactaaataactcctaattccacgaacttgtctatacccaaatatacacataatttacatgctttgtatttaattgagctgtgtagactcgactaataaaagcttatttttaaaacagaggtacttgaattccctttggaaagcagatatacttacgaattgaaaaaaaaaaacagtgctgataatgtagaggaataaacttctactcatgagtccaacttgagtgataacacaatactgtatgactctacagctatagcttaaaattattcatacacttcctctttattgaagaggtcaacattttcaaaagagggcaaaagtctctatttacacaaaggatttttaaaaactcactcatttttttttcttccaggacagcgcagaaaaataagtatcattcctgcagtaggggttaagataactccaactgataaagccacatagttggcacacagaaggaagataatgaatatttgttgaataaatgaaaagactaatttggttagaaacactcaagttcctttggccactcagacattcatgacagacaaactaaagacagcagttaggcaggtagctgttcaccacatccctattcttctcctcctccatttcctgtctacacagctagaccccattgcctagaatcactgccagttagtgctcaataacagaacgagagaagggatgcatttctaccacagttcaggcctacaatatctcttatgcctacttctccatgttttccccagtttgctggtttgatgtagacaagcactttggaagcaaggtagatggcagaatacggtctaaaatcattgcttatcatagaaccatctgctaatcaagaaacatgagtcctatactgtacatgagtgagttcaaaacttctgtttatgtgtgttgttatacatttgggggtagctatatgtaagcagcaaaccagtcaaaagagacaagggctccatctgtattggaagttcacagagaagatggcacctgtcaatgcaagagcttccaaagacatttaggtaatatctcaagtgagtcttttcaggtgaaatgaagaaaaagcaaatgtttgggaatgcaacagaaggatcaagttgaacaaagcacagcaatgtatattcttctttcccaggggaggaaggcacaaatataacatatgagaaaggcattgtgatgttggatttaagatagcatagtaaagttttagctctttcagaaattatcacctcaaaaataaggagagtaagaaacagaaatgcaatcacacatcctaggaaaaatctgtaatctaaaatcaaaactatatgagaaagggctgccaaatgctgtaaatatcagagaggaataaggcaagatgccaagaggctaggcagagaatagacattgaattgcaagaggccctacaaaagtaaggaagtaaaggcacacacacacacacatgcacgcacacacacacacacacacacgcacatacacaccgcttcataggaccctaataataaaccaaggacaattctagatagcttagaatactactgctctgattgccctgtggtacaaatctgcaaatagttggtctgaaaagaacacatttcactcaaagattgtaaataacaataataaaataaagtgaagaagaaaagagaggaggaggagaaggggcagacggaagagtagaaggaggaggacaaagagatgatggagaagatggaggggaagaagaaaaaggtgaagaagaagaagaggaaggaagagataaaagaaaaagagcaaagggaggagaaggaagtattataccatcagcagcagaagcaggaataaagaacttcaaacaaacaacagatggggaatactcatcagataaatggtgccactactaacagaaagaagcccctgaaattgttaagaacaagggctcaggggaatgagacctagcagagcacaggaaagacattgaaaagggaagaaaactagaactatcacattaatgcagattgtgctggaagcagctcaaaggagaactgaattgataaaaataaaaaggccagtgaaggcactataaacaaaaagagaaacaataaaacaatctgataatttcatagagaacaaaggaaaaaactcaccaacacgtgtaataaataaaaatgggaaaaatactatagacacggattaaattaaaagaattgtaagagatgtttgcaaaatataaaattgtacaacaatacaaagaaaatgaacctcacagtttttccaacatgacatatttaccaacgaggtgaacttatacttctttaaagtcaatatttcatcaaaaagtaccctgaggcagtggctcggattttgtaaattatggttataaaactgaagatgtaacttactctcttagtaaccatggaatgtgtggtccatcagcactgagactatgcccttattttaaaatgtaacccaactttccaaatgtaatttttaaaaacactctatagtgccattgagatttcccatttgaattgtccaatttaaaaatctatagttaagaactgaggcagcatttctcttacatgtgttacttactatagcttatggcatctaggttaaaatattaagtcaataaaaataatttactgaattttaattactaaaaaatagttccagtccaatgagttaacagtcccttcccaacaggcaagaaattcaatatggttattttcatattgcctctagcacatttttattcgagtatatgtatgtgcaaacaagttttcctttacgaggaaaaaatgttcatatgtttaagtaattcatttttactttctcataattagaaaaagaatcactttaatacctcaaactatatgagttagctattatctatcctttcgccatggaccaaatactcctagctgtagagggtttgttatggtttggctgtgttctcccaccccaaatctcatcttaaattgtagctcctataattcccatgtgttgtggaagggagcccgtgggagataattgaataatgggggcagtttcctccatactgttttcatgatagtgaataagtctcatgagatctgatggttttacaaggggaaacccctttcacttggttctcatgctgtctctttgctggctgccatgtaagacatccctttgtttttcctttgtcttccaccacagttgtgaggcttcctcagccctgtggaactgtgagtcaattaaacttctttcctttataaattacccagtcttgggtattctttatcagcagcgtgaaaatgaactaatacagtaaattggtactggtagagtgtggctctgctataaagatacctgatatgtggaagcgactttagaagtgggtaacaggcagaggttggaacagtttggagagctcagaagaagataagaaaatgtgggaaattttggaacttcctagagacttgttgaatgtctttgaacaaaatgttgataatatggacaatgacatccaggctgaggtggtctcagtggagacgaggaactagttgggaactggagtaaaaatgattcttgctgtgttttagcaaagagactggcagcattttacccctgccctagagatctgtggaactttgaacttgagggaaatgacttagggtatctggcggaaacaatttctaaacaggaaaacattcaagaggtaacttgggtgctgttaaaagcattcggttttaaaagggaaacgacacataaaagttcagaaaatttgcagcctgatgatgcaatagaaaagaaaaacccattttctgaggagaaattccagcctgctgcacaaatttgcagaagtaacaaggagccaagacaatggggaaaatgtcacacatcacagaccaagaggcctaggaggaaaagatggttttgtgggctgggcccagggtccccctgctgtgtgcagcctagggacttggtgccctgcatcccagatgctctagtcatggctaaaaggggctaggtacagctcaggccatggcttcagaaggtgcaagcctcaagccttggagatttctgcatggtgttgagcctgcaggtgcacagaagtcaagaattgaggtttgggaacctccgcctagatttcagaggatgtatgaaaccacctggatgtccaggcagaaatttgctgcaggggcagggccttcatggataacctctgctatggtagtgtggaagcaaaatgtggagttgaaacccccacacagagtccctactagggcactgcctagtggagctgtgagaagagggccactgttctccagatcccagaatggtaggtccactgacaacttgcaccatgtgcctggaaaagcagcagatgctcactgtcagcccaggaaagcagtcaggagggaggctgcacctggaaaagccacagggacagagctgcccaagaccatgagaacccatctcttgcatcagcatgacctggatgtgagacatagagtcaaaaggagatcattttggagctttaagatttgactgccatgctggattttggacttgcataggccctgtaacccctttgtttgcccaatttctcccatttgaaatggctgtatttacccaatgcctgtacccccattgtatctaggatgtaactaacttgcttttgattttacagactcataggtggaaggaacttgccttgtctcagatgagacttcgaactgtggacttttgagttaatgcagaaatgagttaagactttgggggactgttgggaaggtatgattggttttgaaatgttagaatacgagatttgggaggggtcagggtggaatgacatggtttggctgtgtccctacccaaatctcatcttaaattgtagctcccataattcccacatgttgtgggatgaacctggtgagagataactgaatcctgggtgcggtttcccccatactgttctcgtggtagcaaataagtctcatgagatctgatggttttataatggaaaaatccctttcacttggtcctcattctctctctttgctggccaccgtgcaagacatctctttactcttctgccatgactgtgaggcctccccagctatgtggagctgtgagtcaattaaacctcttccctttataaattacccagtcttgagtatgtctttatttgcagcatgagaacagactagtacagggtgatattgcaaaagtattatcaaagaaagcatatgacagggggagtggagatttggagaacatcctcctactactattagaaaaacagcctttggaaaaatagctcaaaagaagctcttggtgaaggatgattttgcggagtcacctgtatagttctagttccccccacaccatggagtcccctttgagaattactctgagagggtgagcaatgactctgcaaagagaattaaccataaactaaatagggtacctgttgacatacacatataatagctggggggtgctgcggtgtgtgtgtgtgtgtgtgtgtgtgtgtgtgcgtgcatgtgcaccatagacagagtgaaggaaatgccttgcatttcctaacaaaagggtcttaagaaaacatctcgtccaaccttatcctaaatccttccctccccccgctcccccaacataaatcacagataagaccatagggaattagagaagcaatttgattagactcaggccataaatcagtggaaataaactccaataaagggtcttctggcatttgtttaatgtgctgttaactctagccctacttcattactagatagtttcagaaggaaaacacacacacacaggcacacacacacacaggtgccttctacaatttctgcattcagacttgaaatctaagagtaagaattatcacaatctaaatttattcagaaaactaaataaatagcaaaagagcccatctcttgtcagtttgcgggacgaagttgtgacttgtgttattaagcagtgttttatggaatcagaagtctctgaatccatgctgttgaatctcttttcttgaattagcaagaattaactgaattagctgtattaacttgaatttattataatttaggtcaccaaatctatgtatcatgtcttcaatctcaggcccgcatgtctggatgcagatgtttgaatggcagcacctctagagataaggttagcacatgtgcctgagttggaaagacttcggtcttggtgctatgcatttatttccctatttctctagttccatgcaattttaaaatttgtttttaaacaatttataataattaaagatcctgcctgttctttttttctttttctgagacagagtctcgcgctgtcgccaggctggagtacggcagtgcgatctcggctaactgcaacctccatctcctgggttcaagcgattctcctgcctcagcctctcaagtagctgggattacaggcacccaccaccacgcccggctaatttttgtatttttagtagagatggggtttcaccatcttggccaggatggtctcaatctcctgacctcatgatccacccgccttggcctcccaaagtgctgcaattacaggcatgagccactgcaccagaccgatcctgcctattcttatagacaacacaactctggaacttaggatggagtgaagtttaaatacaactggaatggcagtttctagtgatttcctgaccccaaattgccacatctggtttggaattttgcgtcttggacttgtccattagaaagaaacaacccaaccaattataatagagacatgagttcaagattaacatcttaatcccatagggtgatgccaaagtaactgtcattttgtcgagccactagaaaaaaaaagtaaaagaacccctcaaatgacattttgacaaaagactgctacaaggaaatactttttttcccccaaacagaaatgcataggataaaaataccataatgtcctaaaaagcagtatttaggtaagattcaaatatcacatgaccaagaggcaaaataatctgtggagcccccctcccctctccaaaattactgtaatctcaatagtccttatcctagcattgctgagatataaaattcataaaatatccaatgatgacagtcctgatggagagagagcaacaaggtacctgtctgaagaactcctccaggagtgacattgtccagcgatgatggaggtcccatgcttttgctggatggctaatatctgctgtatgcagcataagggataaggcttttggcttttcaatgctgtaaaccaaaagcacccaaacacatgataaccacactcttcagaacctcagtaagagttttttaaaaatcattaagtttttaatctcttttgttcttccatctcaaaccccacttcagctaaattgaggaaaagacatcatttcatcctacaactgggatactcattaacttggtctccatatttacggaattggactctctggactcaaatccatttctggaatgactgcatccttcaaaaagagagcaagaatccaagagtcactgacttttattggttgcttctgcattggggatctctgataatttagtttcccacagggaattatttttaattctcactggggacaactgatgctgcctctattatttctttcaaccctgatgagaacataccttattgtggtaggtacaacttttatgctttctccttcaaacataatcattgcataagaacactctataaagttgtgttaaaggagatgctctttaaagggatagccacatagacgaggacccattcaaacacctatacaaacaaaaacacaagccacaagcacacttacgcttctggctgctgcagagcagtcttcattgctttgatttgttggaagtgacaagacatatctgtggccatcaccatttcaattaccaaggttcgaaactcccttttagagacaaccatggagaaaaaaggatggaagtcaaaaatggaaagtaaaaatcagtgttttttttttgccactgctaatgaaaatcagtcaacgatttctgacatttctaatctaatttgggtctttaaggtgagcttttcaaataaggaataaatgaaagctaagtattaagaaaatcatttattaggaatatgatacatggaatacacatatcatttggaaaattaactcacaggaaaaaattcaatgaaactgaaaattgtattaaaatgctcttttctccaaatgaattcagagttttaagaaagaattaacttgaaaataatccttggaggtaaattaatcatccgtatttcacattggatacaggtattccatctttttaaaaatagcttgatttttaatagagttttaggttgacagaaaaattgagcttatagtatagctagttctcatgttacctcacttccagcacagttttcttatttttaaagtcttgtgttaatgtggtgcatttgttacaactagtgaatcaatattgatacattatgttaactacagtccatagtttacattaaggttcactgggcatgctgtacagttctaccagttttgacaaatgcataatgccatgtatccaccatcacaatatccatacagaatagattcagcaccctaaaatcccctgtgctccttcgattcacccctctcttttttccctcaacccctgccaatcactgatctttttactgcctctaacgactttattgaggtataatttacatagaataaactgcttacaatttacataaattgcagaatgtaatgagtttaacagttgagtaagtttttgaaaataccactgtaatcatgataccaaatacttccatcatcctcaaacctagccccaggcaaagtttgatctggcttatgtctatctaaaatagtttgaattttctagttttatacatgtgtacataaagtatacacatatatatttagtatatatttcaaatatttaatatatattatagatttcaatatttatatattatatacacatatatttcatacatatatacatatttattatatacatacatgtagacatacatagatacacatatatgtattatatattaaatatgtgtgtatatatgtatatatagattatgtatatatgtatgtatacacacatacatatacgtatgtatacatacatacatacgtatatgtgtgtatacatacgtatatgtatgtatgtgtgtatatatacatacatatatacacacattattttaaaatagtcacacattgaaaatatacacacatattattttaaaatataatagataatacatattatacacacatacatacgcattatatattaacacagatactagatatatacacacgtgtttccatgtatatacatagacacacacacacacacatatataatacaaaatgtactctttctttactcagcataatgatttacaattcatctatatagtggttcatcaatagttcattttctcttattgctgagtggtattctatcatatgagcataccacagtttgttatccatttactagctaacggacattcaagttattagattctagtttggaactattgtgaataaagctactatgggtattcatacataaatctttgtgtagacacatatgttttcatttatctggggtgaatacctagaagcagaatggctggtttataagacagctgagtgtttataagaaactgccagccgggcatagtggctcatgcctgtaatcccaacactttgggaggctgaggcaggtggatcacctgaggtcaggagttcgagactagcctgaccaatatggtgaaaccccgtctctactaaaaatacaaaaattagctgggtgttgtggcatgcgcctgtagtcccagctacttaggaggctgagacaggagaattgcttgaacctaggaggtggaagttgcaatgaggtgatatcatgccactgcactctagcctgggtgacagagagagactgcatctcaattaaaaaagaaaaaagaaactgccaaatatttgtgaaagtggttgtatcactttacatttgaccactagcatataacattttcagtttttctttgcctcctctaatgagtctttaatttcagccattcttctgatggatatgtagtgttatctcatcttggttttaatttacatttctttgttgactatgtcaggcacattttcatgtacttatattccatttgtatacattttttagggaaatgtctgtttcaaacctttctcattttaaaattgaattgtttacttattattgagttataaaagtaccttacacattttggattcaaaacctatgtaaaacataagtgttgtgaataatttctccaatgtcttggcctgcttttttttaacggtgtcttccaaagagcaaaaggtttaatttttataaagttcaatttatcattaaaaaaatgcttcatgctttttctctcctatctgagaaaccgccacctacttccaaggacttcagtattttcctctggaagtcttgccattttagcttttacgtttaggtttataaccaattttgagctattttttgagtatggtatgtgataagggtcaaagttatcttttcccattgttccaaaaccatttgttgaaaatattttcttttccccattgaattaatttggcatcataaatcaattgatgagtcaatttcaaaactctcaattctgtcccatagttacgtatgtccatctttcaccagtgaaatgctgccttgaatactgtaacttaagcatgcttggaatcaagaaatatgagtcctctaaccttgttcttcatttaaaaagtattatttggcatttctatataaagtttataataatcatggcaatttccaacataattctgctggaattttgattggaattgtattgaaacaataaataaattttggaagatttgacatctttataataccgagtgttccactacatgatgacagtatatctctctatgtatttagttcctctataatcagcaatactacataatctttagtgaacatgagctgcatttgtttttgaaagctactactaagtattttatatgttatgtgctattgtaaaaaattattttattttccaatggtttgctgctagtgtctctctccctctctctgtctctctctctctctctctatatatatatatatatgtatatgtgcatatatgcatatgtgtatatataatgttttttacattaaccttgtattctgtgaccttgcaaaattcattatcggttccagtagctcctttacagatccttaggattttctacttaggcaatcatgtcatttgctattaacatcttaacaatgttgatgaatgtaagatcaagcatctttgtcttactcccagtcttaaggaaaaaacattcaatatttcaccattaagcttgatgttagttataggtttttcacacatgcactttatccagttgaggaagctcccttctgtttctggcttgctgagagtttttatgatgaatgtgttgaattttgtcaaatgcttgttatatatctattaagatgactgtatgattttctgtttgtttttaaatatggggaattcttttaattaatttttgaatgctgaattaatcttgcattccttggataagcccaatatatgagtcaggattctccagagaaaccaataggatagaaagagatttattatgaggaagtggctcacataattatgaaggctgacaagtcccaagatctgcagggtaaatcagcaagtggagatccaggacacccaatattgtacttccaacttgaaggctgacagctcaagacccaggaggagccattgttttagttcaaagacaggcaaaaagaattctctcttacttgggaggtggtcagcctttttgttctagttaggccttcaactggttgaatgaggtcaactcatgttaggaagggcaatctgctttactcagtctaccctcttatatgttaatctcatccaaaaacaccctcacagaaacaacagaataatgcttgaccaaatatcagcacacactgaggcccaggcgagttgatacataaaattaactatcacacatgatatattacctttttagtatattgttacatttaattagttaatattttactgagaattgttatagctatgttcataaaatacattagtctttaacattcctttttatgaatttttttccagagtgtggtatcaaaattatgtcttataaaacaaattgcacagtatttcttccttctctaaatacatttgcataagattggtattatctgttctttacatattgatagaattcaccagttaaactatccaaggctggatatttctttgtgggaatatttttgatgacaaagtcaattttttaacagacataggattgttcagactttctgtttcatcttgtgtgaattttggtaagttgtattttgcaaggaatttatccacttcatcaaagttgtcaaatttattgagataaagttgtttgtaacattttcttatgtatttcatatgtataggatatactgttggtactttgtgttctctcctttttattgaccagtctaggtagaaggttgtcaatcatgttgctcttttcaaataacagcttgagctttcttaattttttctttttattttttctattttattgatttttcctcttatcattactaatttcttctatctactttgaatttacattactgttttggtctagcttcctgaagtcattgtgtttggaacttttttctttcctactatgaacatttatagctgtaaatttcctctaggcactgttttaatagtattgcacacatttttaatatattgcattttcattcttgataaatttgaaatgtttcctactttcctctgattactttttgatccacaaatgatttagaagaatgttgtttaattttcaaatatacaggattttcctagatatcttattgatctctaatttaaatccattaaggtcaaagaacatactctttaagcttatgatattttaaaattattaaaacttattttaaaatgtctcagcatgtgtacttgaaaagaatatgtatattgcagttgttgcatggtgttctataaatattaattaaggcaaagtggctgatgttgttcaaatcctcttaggtccttagtgatatttttgtccagtttgtctatcaactgctgacgcaagaatcttaaaacctcctatgattgtgaaaatatatatttctcctttttctcctatcaatttttacattttatgttttggaagtctacagttacctaatagttatttatgactgatgtatctttctgatgacactcttattatcagaaaatctcctttctctttcacaatatcctttttcttgcagttcattttagctaatattaataacaccactgcattctacttattcttactgtttggtacatcttacatacttttactttgaacctttttgtgtatttatatttaaagtgtatctcttgtacaattgcagttggagcttgcctttttatcaattctaataaccttttccttttaagtagaatgtttagtcctttaacatttaatgtaattattaatatagttgcatttgggtctagcatgttattatttgttttctaattatcacctttgcttttttccctttgcattaacttttctgcttgagatattttttgtattatttattttttaaatcaattttaatttatctactgctaaatggtcaatttaaatttatcttttgataaataggtaaactttaacaatctttagctattatggttaatctttttagtggttgcttggggattacaacatacatctttaattttctgtctactgtataactttatgtaacatttaaaaatcctgcaacagtataggtccatttactaacattaactggtctttatgttatcattgtcacatgtattacacctctctacatacaaacctcatgagatggtgttgtaatttttgcttcaaatggtcaaatgcacaatttaaataagtgaagaaaaatggtattttacatttacccagatatttatcagtttattcttttctaaaagtctgatttcactatcatatcattttccttccaataaatatttagatttattaatctaaaaattaataaaatataaaataacaaaataatatttttgaaactaccttaaagaaagctctaaagaaatttctttagcatcccttgtaacgcagctccattagtgacacattcctgttgttttctattatctgaaaataattttatttcatcttcattcttgaagttcatgttcacaggatgtagcatcctgtgttggctttttgttttctttttagcactttaaataaattattctattgttttctggcctctatagtttctgatgaatagtctactgtgattcaacttgttctcctaagtgtaatttgtcatttttctttattttatctttgcctctcagcagtttgactataatatgtgcctcagtgttcttttcatcgaatttaacctgttttaggtttgctgagtttcttgaatctgtatatttatatgtttggcaatatttggaaactgttcagtcattatttcttcaaattctttttctttcccattctctctcttttctctccttctgagactcaaattgcccttatgttggctcatataaaattatcccacatgtccctaacttctactcatttaaaacagctttttcctcttactttttcaaatcaaataatttccaactttgaaacctgaaaaatgaatttttaaaagtcactgtttccttcttctgtcttctctatcatgcactaagcctatgtagcaaattctaaatgtagacattttatttttcagttctaaactttgtttttaatttatgttttcattttactcataaaccttataacaaaataatatttttgaaactaccttaaagaaagttctaaagaaatttctttagcatcccttataacacagctccattagtgacacactcctgttgttttctattacctgaaaataattttatacacaagcacatttttcattacctcactgagcatagaaataatagttgttttaaaagtccaaagtcctcatctgataattctaacaatggcttatcctagagtgtgtatctattgattgtcttttcccttactaagaaatcacattttcctgatctttatatgtcacttagattgtatcctgaacattatggatataagttgtagggaatctgggttctgttatattgctctgaagattgttgatgttttgttttagcaggcaattaacttgtttatactcaaaatacaaactctgtataggttcagtaagcaatacatcagatatcactggacacaaggagggaaacatcacacactggggcttgtcagggggtcaggggctagggaaggcatagcattaggagaaatacctaatgtagacgatgggttgatgggtgcagcaaaccaccatggcacatgtataaacctgcactttctgcacacgtatcccagaacttaaaatataataaaaaaaatttttaaaaaggtttgaaaaaaataataaaaggtggccaggcacagtggctcatgcctgtaatcccagcactttgggaggccaaggctagtgggtcatttgaggtaaggagttcgagaccagcctgaccaaaatggtgaaacactgtctctattaaaaatacaaaaaaattagctgggcctggtagtgcatgcctgtagtcccagctacttgtgagactgaggcaggagaatcgcttgaatttgggaagcgaaggttgcagtgagccaagatcatgccactgcactccagtctaggtgacagagtgagactctgtctcaaaataataataataataaaaggtttgaatatggcagagaacagcttcacacatattcagatacatcatggttttgaaggatttgtgtgagggcttatttagatatttagatcgtgtataatcctggcttcctgacaatctagtaaagtgttctaaagcttgcataattgcctcttaacatattttccaaacatacgtatgctacttctgttatacatacttttacttttctttttttttcttttttttttttttttgagacggagtctcgctctgtcacccaggctctgttctgtccaatggaatagaacagaggcctcagaaataatagcacacatatacaaccatctgatctttgaaaagcctgacaaaaacaagctatggggaaaggattccctatataataaatggtgttgggaaaactggctagccatatgcaaaaaactgaaactggaccccttccttataccttatacaaaaattaactcaagatggattaaagacttaaagtaagacctaaaaccataaaaaccctagaagaaaacctaggcaatagcattcaggatataggtatgggcaaagacttcttgactaaaacaccaaaagcaatggcaacaacagccagaattgacaaatgggatgtaattaaactaaagagctcctgcacagcaaaagaaactatcatcagagtgaatgggcaacctacataatgggggaaaatttttgtaatcaaaccttttattataacttttaccaatagtaaaattggatagagggttccttttttcctgaagtggtgcaatgattaattgaattgctctgcatttttcagatgctggctgagtctagcatattccaataaaatttaagtcaaatattcccatatgttttaataaactaaagctacatggaaactcttagccactcttaataaaaatcagcctctcagattgttcagtaaagttcatttctctaaatccttgaaagatggtgagcacacaaatacccaataaacagctgattatttaattaaaatatgaggactatttgagtcacaacggattcagagttttgtaaggatttagatgatctctgcctgcagggtttgaagtaccttaacctatatttatagctacgatgatttattggcttgctatatatgagacaaagtgtgctaagcattttaaaatgattatgtcatttatcataatctatcccaactgcagaataaatgttactatctattttcaagaaattaaaattttaaagatgtaaagatattgagtcacttcccgaatgtcatacagctagtaagtgactgagtccatattcaaaacacaggtatgtgcctaaatccaaacacacaatttctgtcattcatgcaacagaattaagtgtacataatttttttaagtgtccaataatttccttagaaaatgtcaaaagattgataagaagtccaaatcaaatatagggtgaaaaacacatgttattaaataaaagataaaattcagatttaaggaattcagataaaagcaacacaagtttcctaaggttaaaaaaaaaagcaaatatatccaaagtgtcctcagttgaacactgttagaagtgatttttcaaactttcttctttgagaatttttaggacaatattgaattatttgactcaaactggtttcacttcccaattcatcaataaaaagcaatgtaaagatggcaaaataaagtagttggaacttaatcataacattccatagcctttatttataaatatttgaatatctgtataaagaaaaaagagaaataagacatacatacatacacaaagagagggtgagagtgagagaaagaaagagagagaaagcaacacgaatcaacattttaagcaaggtgttcttttctcaaaaacagcatacttcatccaacttcaaagttccttccctggcctacaaatctctctcttttctcatccttacctccagtcatcctttgagaggttaatcaaaatattcatttcctcgtcatcttgcagaaggcgataagctgcacttaaatggtgattctccagtacagatctgtcattatacagaatagctggatcagacctgaacagaaagccaagcaaaattcagaatgttaaacagttgtgatttacttgggtaattctaacaggctagaacgcaccaccacttttttccatgtttagaaattatctttgtccccatgccagttatatgaaccaaaagctcaactaacactacaaatcatcaatagatgaatgtagggtatgttatatcagtacatgtgtgggcaggaaatatgtgacatccagcctgagaactctctcaaaactgttttacaaccagatctcaattacctatattagttgcaaaggtgtttttttaaaaatatgggtcatgtcaaacttctttatattttctggaatgacatttatttttatttttattttattcaatgaatgcactggtttatttattttagttgtaattttcagaacacatatcacctggtgggtactatctgtaagctgcctctgatagtggcttgatctcaacatttttccatgcaaaagccacatgtggaaaattgagaataaagaatataaagattataatgtcagtttttagttcctatctcaaagaccatactatagctgaatgtcactaaacacacgactgtataatattttaagatcttaaatttaatgaaagcttagattatttgtttctcaccaaggaagctgagtttcagagacttaaaaaaacttgttagagccctttggtggccaagtggcagggctgggatgaaggcaagatcttctgacagttgggccagtgcttccccaagataacttccacctgccattggccaaactttgggctgtatctatcataccttgaaactgttaggcttaaaattttattcatcaaaggattaagggcctggtcacagactttgttttctgaacagggatcacacaggctgagaggctttggataaagttctgttgaacagggccaatgtttaaatttcattccaaaccaagcttaactgaacacattggaattttcccactcctatggagataacgcagaacattcaaatcccgaggtgaaagatctgctgttacatctgttgagtaagttagataccaactgatgtatatttcgtgacacttttccacctcctgtaataaagccattctcctctgtgttgggactggttttgatcctcgtctccaggcaagacccacatatgttcaacccacctctcttccttgggcaggtgatattcaccatggtctctgtcctcagagcaaaggttccacccacagacatacattaaacagtgctactctatggaattccctgtattaaagggaattctgttcccttggaacacaaccacaaaaagctgcttttctgtggctgagactaagtgaggaggcaagaaggtggaactgaagcaagtagctgaagttcttttgtctgcttccattcaattaaaattctccttctgaacagagatcagacaatattgtcttcttttgtgtatactgtaatcaagtgttgagttcattaaatacatgtagattgatttaatgaacacaaacctatctagagtgtgcacctgctttttcaagtgaaatcagcaagtatttatttggtgttaaactctcatccctccctgctacattctttctctttgacttaccacctttccccataccctagctccttttgattactatgtcaaggataatgaactaactctactgtcagactctctccagttccacatcattgtcttaagagagggcaagttcttaggctaggagagggcaaggaaagttttatcctaagtagaaatgacaattgactggtgctattgcctggaattctgtgctgagaggaatactcagaataaacccacagtttagtaagaaaaagtaccaaaatcaactaacagtatctgttacaggtcaggaggttccgagtggggcacttggacccatatttaatgtctccgacgggaggtttgtgattacctgtgcagtccattaggaaggatgcacaggttgctcacggtgaaagtagcctacaggagacaaacttactcccggggccctgtgccagggagtggtgcaagcactaaacagagcagatacgaaatcagagaggatgagaagagatctcatcagaatctcagagatcagagggtaagattggtcaatgttgttaatgtcaacaaaaacactctaatcctcactgtccttattcttttcctttatgtgtcatctgggcctttacgtaaactgccccatttcctgttagaagtaggtcaagtatgtacagaacatacataaacaaatagcgaacattagaatagagaagaaaaagatatctatatgagatctgaacaaaataggagaattaggagcagatggcttcttaaactctaagtcttgattgaagctgatcagactgatctctcatttagaggttcattgtttcagaaattcaaaataggaaacctatgcaaaagaaaggtgactaacacctttctgatttctaaaactgtctctctgacccctcttgcctctcttccaaacatttaaacaccctcaccgagtctgaatgtggaaattgttggtggttccggtatgctcgtagtcatggatggcagctgagaagattatagcaaagatctccagctccgtcagccagttctgaaaggagattacagagcaatcagataatctgtttctttctcaaagtcttcagcttgctgacaacacacccacagtgctgcctttctaccctgcagctggtaagctattgccaaacacaagttttctgagagacagaaataagttattttcctgtgaagagacttggagacttgtgatttgttaacaatgtgttcagcaaggttgaataagctaagtagtagttttatctttttcaagaaatcaaagagaatgaacatgaagacttgaaaagccctcattgcatcctcccccaacttccaaataaagttcctaggtagacacacacacacacacacacacacacacacacacacacataaaaaaattagaaatttgaatgcaataccaagaatgaagagtaatagaaaacctaacgtctgattataggaggatatccactaggaagtgggtagagacagatggaaaaatactggctttctgctctatgcatgctgatgatgtttgaaaggacttctccccatccacaccatcaacattggctgtgggtcagtggttcacaaaatgtgttccttggacatgcagatggtgtcagctgggagcttgttagaaatgctggcaaattcttcagccccaccccaatctcactggatcagaaacgctaggttgtggcccagcaatctgtgctttaccaagccatctagatagttctgatgcacactagagtttgaaaactactgctgtgtttcaagcttccttaactgacttccatttaacggactctgtggatttacttcctatcgcttctgtaaaccatcctgccccatgctcacacgacagaatatgcctgactcaggccaccttctcatatcctttgctcacttttgctactagttaaattcatgcctacatgattcagtatgatttattctaaaccacattttaataaattgtatttgttattataattatgtaattaaatatgacacaaaccaataaaatatggacacaaaattggagttgttatttctgtagaacctaagtttaatgctttggacagtcactaaaagaactgctatcaaaatatgtgtgacaactgtgaaagagcagaacacatttatagaaaagttagagagcttctgcactcagtttgcttcatgcacatctttaagttcccacttaactttaaagagatgagactagaaatcttagataggggcagggttgatgtaagacaaatgtgagtatccaaactggtgaactcataaaagccctgtggtctgaattaaagatcagtgcataaaatagattcatatgatttaagttaacgcaaaatgagttaaaatgaacatttaagtgtttctaatttcccacttaagccatatctttcaattaactactaattttggagaattattgccttctttaaaaattggtaaggggaaaataaacaaatgacatagaacttatgaaaaatacttcagagtgagcataaacataactcatgaaaaaataaaccactatacttttgaaaatgattcctaacagaatccagcatgaaatgtcaggaagctttctggcatcttcaataatatacctcaaaaacacaaattgaggtacacggaacagaaagtcaaagagaaaacagactaagatgaaaatcaacaaaatgagatgaaaaaaagatgggcaagataaggaaagattgcaagaaaaatcaaagctgcaaaaccccttgtaaaggcagcaaagagcctcctcatcagcctcttcattgtctcggggggccccccatgtggcaggcactatgctaggtgcttttatatagaaacttatataactctcacagctctgtaatcataggtactgttgctatccccacttgacagataaggaaacaagccaggggtaggtgcaggactcactcaaggtcacacagccagtcatctgacaagccacacaccacgcctgcagaattctcactcataatcttacattgtattttctttggatcattgttcatgtgtttattcaattttgcataaaattatataggcataaatttatattgcacatttttcttgatattatccatacatatattacatatgcagttttttttccattttggcattgtctttcttttcttccccaatattttgtccccacccatctgtccctggttccctctacctcctctcccacatatatctcttattctaaggtcacgtaaagttaatttcactttttaaaataagattatgaatgggagacagtgtaacatctcaacgaatcctagtcacagaacatcagcccaggcagcagaaagcatctaaataacagtataattacagttctcacattacaaccatagtgatgcttccctccttacccaaataattgaacaaaatcctatcttagatataacctacttctattaaaccaaaaacaatgaatggttaaacaggcattcaacaacaacaacaataaaaaacaaaaccattgtctttaaaactcattttaccaccttagtttttcaacaaacgccatgcatgcttagaatcagttatgctgctttggggataagaagaaagaaaagtagtatctgggagaaacagcttcacagaggagagatgtttaagatgggccttgaaaatttgacagagaaagaaatgaaggtgggcattttcagaagaatgaactaaatgagcaagtcccagcagcaaaagcatgtccacctcaggtaagaaaatgatgcccttgactggagcgggagagaaggctgattgaggccctatgaggtcaggcattagaaaacacagtgagcgaggaatgtaaaccagattcagcaggcagtgaagttcacacgcaagagagtcatgccatcagctccccacttcaggaaggatatttggacaggaggagagaagggagataaaaagcagggtttttttgttttcgttttgtttttgtttttgtttttttttaaacagggtctcactctgttgtccgggctggagtatagtggtgcaatcttggctcactgcaacctctgcccccagggctcaagcaaacctcccacctcagcctcccaagtaagggctgggaccataggcacccactgccatgcccagctatttttttttttttttttttgtatttttagtagagatgggagtctcaccatgtcgcccaggctggtctctaacttctgagctcaagcaatccaccaatctgggcctcccaaaattctgggattataggcgtgagcaactgtgcctggctaaaagctgtatttttagattgaaaagttcatataggatgtacagacagtgtggaggtagaagccatatgacttagcaattatctgaattttggaagtggtaggaggaccagatgaggttgcagttaaggagaacaatatgttagatgacctcaacactcctagcctcactgagtggctaataaacccctcaggtgatattagatagcatcattaacagaaacagagaaagtgggagaagctattttggaggaaattgaacttcctattttaatatacctcagatttccttgcctcttccaaattaactactgtgaacccagaaggttttatgtcaacccataagaagtcagaaattaaagtcccactggtattttattccagaattaccaattggtggcaaggtacaagtcacagatgctatcagtattttcctatctacaaaatatgagtgtcacaactagttcatttgaaaggatgctttgacaagtggtaattggggaccttgagttttgctgtgtatgactcaagaaagcaagccacttgttcccgcatataggggcagatgaggagacatggggtacaacagagcagaggaaacctgaagggaaaggacatggccaatttctcattgttagaggagatactacaagcaagttgtgacttttctatgtgaatgatagagtttctttagtaatctgttagttttccatgctaccttaacaaatgctcagtcttggaggcttaaagaacacttccgggcctggcgaggtgcctcatgcttataatcccagcactttgggaggccaaggtgggtggatcacctgaggtcaggagttcaagaccagactggcaaacattgtgaaaccccatctctactgaaaatacaaaaatcagccgggtgtgctggcgggtgcctgtaatctcagctactcaggaggctgaggcaggagaatcacttgaacccaggaggcggaggttgcagtgagctgagatcacaccactgcactccagcctgggtgacagagcgagactccctctgtctaaaaaaaaaaaaaaaaaaaaaacttccgtttattggcacgcagttctgccagtcagaagcccaggccagtgtggatgggttctctggtcagggtatcccaaggctgacatcaaggttgggaaaggtttcctttctggtggctctgggggaaaatctgctcccaagagtattcagggcattggcagaattcatttccttctaaccttttccacagtttccctcttcaccttcaagctggcaatgactgttgggtccttctcacacttcaaacctctgactttggccatatctccttgactttgatgaacttgtgtgattacattgggcccacctggaaaatccaggctaatctccctatttaaattcttctgattgttagccttaattgcatctgcaaaatctcttttataatccaatgtaacatattaataaacacatgtgacaccagagaacaaaggttgcaggagccaaatgtctaccaataacaaccccaataaaattatttggcactcttcaaacaaaatgtaattttgatatccttagtctttcctgttaatacattgatattatgtattaatatgttaataatatgacattatggtaatgtcataaacgaccaaaaaaataaaaaataaaataaataaaaaataaaaataaaaaaataaaaaataaataataaataaaaaataaataaaaataagatatgcagcttctcctttctggaaaaaaaaaaaaaaaaagacaaagggaaaattactggcaccttgcttgacaaaagcaaggaaaatggccaagggatagctttggagtttgaaatcttttcacctaaatcaaaagtacactagagcttagaatctaatgaacatctattcaatcaatagatagctcttcaatttatttctgtctaaggattttctcttggaaatgagcaaaataattctgaaaggatccaagtatcttctaggcacttaagttaaacaataatgagtaatacaaacagattacaatgttttacatttacaaagtatcactgttgatgttgaagcccagacaccactttatcaatgggttgttttgattctctacgtgtcttacaatttataacactgaaatgatttaaagcgttttctccctcttggtttgtaatgaaaggttagagtaacagtatgttctccattcatcagaatgctccccactgtttttgtaagctcacaatgaaagaagtttgttttgagctgcatttcaaagagagagtaggtaggaaatagtttctatatttaagaatcattctaaatatggtctgaatcgatcacggaaattcaacggcaaatgagaaatgagctcatttaagaaagcatgcagtaaatcatgatcactgctatgatacaacatttatgttaatgataacttgtattggcataaatgctgggtgtttttggtgagagttgaagaagctgtgcatgattcacttttatgtccccagagtacactctgcacaataggtgtgttgaatagatgagttcaaagtgcatttttgcatccattttcatcctcatcacaatacgtggaagtaagtgcacatgaggatactgaggtgtaagaatataagaggctttttttttttttttttgccaaaggcatattgtagaagcatgcctaatatttaaatgcatggcctctgaagtcagagctgggaccgaattctggctcccgtactgtactcagttgctcgggctgccataacaaaataacacgggctgcgtggcttaaacaacggaaatttattttctcacgtttctggaggagaaaagtccaaaatcaaggtgtcagcaggactgttttctcctgagacctctctccttgccttgcagacagctatattctctctgtatcctcacaatggacccttctacctgcaagtgcatgtctgtgttctaatctcctctttctctaagaacaccagtcataatggattagagcccatccatacaactttattttaccttaatacctcttcaaaggccatctctccaaatacagtcccattctgaggtcctggggactaggatgtcaatatatgaatcaatgagaaatacaatttagcccatatagctactttgtaatagaataattttaatttctatgaattagagatttatcttccttaaaataagaataatattacttgtaatgggaatcacttttgattgcccaactgccctttttttccttactaacaatgtctctgattttgtttgagatggcagtgtgtcagacttccctatatatcgcagtggccatgagacacagttctggccaataaaacagaagtgaaagttgctggttcggatttctggatagctctttaaaagtgggcagatttatttggtttccaacttttgtgctttgtattctgccttatcttcttacctggatttgcaaaggtacatcagccattttacaagcataaggacaagagctacagtcaaagaggtgggaaggacactgagaagactgttgctgatgaagagctgccatgccctccctagaagtctctctggacagaccacacaaacacagaggacacccacacccctgacccatctaacccacctggacattcacttacaaatatgttccaacaaccaaacttcactagacattttgagggaaaaaagccaatagtgtaagaagattctcataaacaaatagcatattccccatcagttaaaagagataattctgtttttaaaaagacttttaaaggaagttttcaaaacgtgtaggtacattcataaatatgtaagtttgctaagacaatagcacattcaaagggcaaaaaaagaggagttcctgaaattaaaaatattgctaactaaaaatgttaaataaacaggttgaataactagaaggacatatcggaaggccaaactgataatgtggaagaaagagttgaggacatctctcaggaggtatcattaaaataccgaaagactggaaaacatgggagaagctaagaggtatgaagatgcattcagaaggtctaagagaagtgccagaagcagacagaagagaaaacagacagggagaaataaataaataacagagagtgtttggctttcttctttccaagcatatagtaggattagactttctggcccctttatggttgggagggactgtgtgagtcattttggccagtgagttgtgagcagaagtgatgagcagagtttctgagccatagaatttaaatacagatataggaaaaccagagcccctttctctctaccataatgcctgacaacactcaggagggtggctgtttagaaaacctaggcccttggagtgagaatgacacaggcagattctttaacttactgttacgggaagtgaaaaaaagcagatattatttctaaaccattgagatttggggattgtttgatcctgtagcaaaatacagcctaccctaaggaaaacactccaaatgaatgaaacccttaggagtgaagaagatgcattctcccactaatatgttaccttatgttatttttaagaaagtctatatataaggtcatacaattaaaaggcaatcacaagttttgaaatatttcacatatatgacaagtgttgctagtcatgattacttatgtttagtaataataataactatcatttactaatattctactgtatgctaggcattaggtaatcatttttattaagaatactgagaaattcaaacattttctcagcaaaatattaagttctcaggaatggagatgttataaccaaagaaaataaaagtggttaatacataaggaaaatgtttaatttactagtattaacaataaaaagtaaaaacacacacatatgaaactttagtgggaaaatattgctatgcaaggaggctaaccagaatatcatttacagtagtgaaaaaaaattttaactgtttaagtgatagaataacccaataatgaactattaagattttcttataataaatatataatgacatagggaaactatcataatatatgatgtattgactatatatatatactatatatatagactatatgtatattgactattgactatgtacatttatgatttattgactatatatagactatatatatatgtaaacagcctatatacatatagagagagtgagagagagtcaggatcacagtattagagacttatttatcctgtttgtttcaataaatcccagtattatagacttatttatcctatttgtttcaataaataggacattggccatatatatagccaatggtacaataatgtacaatgtacagtaatggcacaatatcctatataatatagaatatattatatatcctataactttaataatataaataatataaagttatatcataggatatatgatataatataatgttacaatagcctgtaatgttatatccaatatcctaaaatgttcacagctcactttacctaagtaatggtctcatagagaagtaattttacaaataacatttaaacaatgtttaactgtttaagtgataggatgacccaataagggtccataagatgatcccactactgggatgacccactagtgttaacaaacaaaaacttcaaacaatacagatataaagttccctttggccattacttcaggatgagaatctccccagaggtaaccactatcttcaatttactgtttatctttttagatgtttttcaatatactttcatatatatctatgtgtatatacatgtgctatgtttaataatatacatcatgtagaacatatttttctacaactttttaaactgaataatacatcttgaattttagtcatagaaatctatggtattccagagttctaactccctattgataggtatatactccgtaattgttcactatggcaaacattgctacaatgaacctgattgtataggcctccctgagtacacttggaagtgctggaggattggtatgtatatttttccttatagtaatcactgcaaaattgttttcttatatgactataccaatttaccctcagatgagcagtatatgagaacataatttcttctcaatcagtggttctcaacctgggacaattgcccctccaaccagtggtttatttggcaaggtctggagacattattggttgtcataactggagtggggagtagtgctactggcatctcgtgactacaggtcaggcatactgctacactacaatgcatagaaaagcaacaaagaattatctggccccaaacgtcaatagtgctgaggttgagaaaccctgctctacatcctaaccaacagttaatattatcacactttcaacatttttacccatatgtatataatggattaaaactgtataagtttatatatccttagatactaatgaatggtgcatcttttcatatttcttttattgattaaatgtattaccttttctgttaattgcctgctcatactgtttgactgaatttgtgtcattttcctgattcatttatacaatctggatcttaatctatgttctctatgtattttctccaaatgcttacttcattaatttgtttatgatgctttttatcctacaaaagcttttaactttaatgtattcaaattaatcaatattttgttgtataacttttgtgtttaaaagcttaattttaaaaagaatgtcttttttcaaggccataaacatattctcattttttcttctaatatgatcaaatttttacttttgtacttacatctttaattcatttgtcagattttttgggggtgaatgactcgaagtagagtgaaagcattctcttttttctaaataaataactgtagccaaaacattttttaaactgggtgattttccctattaagttgtctatagtcatgtcttcatgttctcacctgcaattttttttcttcattatactctagtcagtgttccattctcaccaaaccactgagatgactcatgtcaaggtcaacaatgacttccatgttgccagagtgaatggtcatttctctgtccttatcttacttgaccatcggcatgtcccatgcaatgcaccactctcttcttgaagcattctctttccatggcttccatggccccaaactcccttggtttataccccatgtcactggccactcttttttagtttctattgttggctctaattctttgccttcattttgatctttggagtgttccaggactcacttcagagccccttctaactatctattcactctgtctttagataatctcatctagttccatgtcttcttatactattgatatgtccaagactacctaatctacatgtttatccctgatctcccctggaactctagcaccctttttctttctgcttggcctctgtaaatggatgtctactacggatcttaaactctacatgtctaaatcagaattcttgatcccctttcctccaaaacttggtttgccaccaggcattcttgtcaactgtttatcaaaccaagaatctaagatgtattctcgattcccctctttaatgttccaaatcctattcaccacagcagtcctttgaactctgtctcagaaacagcactttcttctctccatcccagcagcatccttcctagtccaaactatcagcatctcttcactagacttctgcagaattttcctagcaggctgccttaaaatccattcaccacagtaatcctttttgaatctttatcaggtcacatcacttccctgtctaaaaccctgtagtggcttcctactgactgcacttaggataaaattggaactcattagcgtggcctgtaaagccagacctgatctagctcctgcttcttcctcagcctcataatgcaccactgtccccatcatgtgctgttcccactaggcttgccttacttctgctccttgaatgtagcaaagttattctcttacaggactcttgtactaaaaccctgcactaactctgtggtcacactcttctttcactcttagcatggctgaagccaaaaaacacaattatctcagcttaaatactatctccagagagagtcctttcctgactatgtaataaaacacccagctttccctgggtaggtcctctattttaattctctacagagtattaataacattttcttgattgcttcccattggtctcttctatctgtaacttcacaccagaatgttaagttctacaagagtactgataccctcttaacttgtccattatcttagtccatttgggtagctgtaactgaatgctataggctgggtgacttataaacaacagaaatttatttctcacagttctggaggctaggaagcttaagatactgaatgccataggccgggtgacttataaacaacagaaatttatttctcacagttctggaggctaggaagcttaagatcaaggcgctggtagatttggcatctggtgagggcctgcttctggatttatagatgactgtgtcctcacatggcagaagagggaagggaactcatttttataaaggcactaatcccattcacgacagctccatgctcatgacctggtcacctcccctaggccccactacctaataccatcacattggaagttaggatttcagcagaggaatttgggagaacacaaacattcagtctatagtatcccataataaaggacccagcatataagttctcaatacacatttgggtttattttttgaaactctaatcaattctattgatatatttgcctattttttcacaagcagcacatgctcagcttcagtatgtattgtaatatctaagagagtaagaactattccctattagattgttcttttacaaaattgtcttttctaaggttgtgaaatacctattttacatgaatttcagattcagattatcatgtttcatattaaaatccttgaaactttgaatagtattgctttgaatttatagattactttgagggaaactgacatctatatagtactgaggtttcactcacattaaaaacatgatgccttttccatttatttaaagatcatttttgtgccctttgatttaattttagtttcctttttattgtttttgaggctctttataggtgatttatatactttttaaaaactgctgggaatgtacatttttctattacactcgttaatttccagtgcataggagagctcttttgtctagacctatcgaggtattttatttgatctaaaagggctttattttctaaaggagatgatcacattatttcacagaatatatcttcaacttttgaagatatcatattgcatactgcattcttgaggctgagacttccagaaaaatgccaagtaggaatattaatgtgggtatccctgtcttgctccatgtattcacggaaccatcattcaatatgatgcttgctctaaatgtttggtaaaaatcttttattgagttaaaaatgttccctttataatcttgttataactttaaagatagtgttttaaatactatttttaagaaatcagctttataataaggaagaactgaaaaaatgatcataggttttacaaaaattctgcaacgttttaacaataatgcctaattgttgagcttcctttatgaggcagagtacttaatatttttgatactttattctaaccatcagagcacttctacaaagtggaatatttttcaccattttaaaaaaatgaggaagttttcgctcagagactcaagtaatttatcataggtcacaatatctagtaagcaattaggcagggatttatagccactgtatctagctccaaagcccacaatcctcccacatattccatttttaattcagtgagatattaggccaagtctttcaacagtcactggaggaaaagataacaaatgtgccctggatttatgggataattgataactatacccaaagtatgtctatcttaatgccaattctaaaggagatttcgaagtaaaaattcatacagacctgtttttgcctttaatggctatatctttttaaatgaatggcttacatcaaggaaaaaaagaaaaaagcaaagacaaccaagttgagcaggtcagtaaacacagaacacagattcaaaaacaactgaagatggtgcacgcccatagtcccagctactcagcagcctgtgatagcaggaccacttgagcccaggagttcgaggctgcagtgagctatgatctcaccattgcactccagcctgggtgatagactgagatttccatgtcttaaaaaaaaatttttaaagcaaaaccaaaaacatctaaagcgctaaaatgttgggccaaaagaagcaaggaacatttcaaatggttagaagtaaagatttaccattaggttaaaataatgaaaggcatacaaataggatgtgaataactatagtccctgtgaaaaagacttagtggcttaaaccaaaagctaactttgcgtaacacggttgccaagtacattgaatacaatttcagtatacatgaatatcattgttattgaccatagcaaaaggttaacagtaccactctccatatctagaaatacatatttagttgtagtctttatatttaaattggttataacccagtgaagacgcaaatcactactaggtatttatctcatcaggctcaggatggagaaaatttcagaggcaacggagaactccaagactttccatattggttagattactcctgggaaacaggaagtccataaaacaatgcatgactcgtggcctccacctcatcagaattggaacagtcaccattaaaaactcatccttacatcttttggggaacctaagagttcctatccctacttaccgccactcctgtcttatagaggaggtaatgcactgtctgtgtaacatcggcagcgtgcattaagttatggtaaggatttttgtgcttgctgtatcccacttccagggcctccacaaatgagacaagtgcagaaatggggatctgaaagagagcagtaaggttaattaactagtgacttcactgctttcaatggagacacagaagtctaaggcaccaggactgctttttctctgaaggcataacacatgaggaaattggaacttacacagttaataaaaattactgacaaaattatcagataatttgaaaatctaacaggaagtccttggttgagaaatagcctgccttgtaaatttttctttgttgctcattttagaatccctgagaaatgacatctgatcattttaagatacttagttttagtaacatgtaaagcagtaatttttaatacacacatagaaaactgagttgttggtgactatgttaattttctgtatttccttgtcctcctctactcttaaatacccttcccctctaaccctaagggaaaaaaagatgctacataggacaccaaacaatgttgtaaataacactgaggaattcaaaaataatactaataattagtaaccatttgtggaatcattcactatttgtaatgtagtatcagtagaatgaaatcttccaaattccaagtcactaacaataaattgccaagtaacaaacataagaacatagcctgtttctgttcccatatataacagactatcgcattttggttttgagttttgtttttgcttggttttgggttttgattttgttttgtttttcttatgtgtccaatgtatataaccactcctttcaaagggcattgttttcaggcagtttatatttgttttgcaataattttataacttaagatttttgtgcactttgttttcctacaaatgagatatgctgcatagtatgtattcatttatttctcaacgaataaaatacttcagtctttatttgcaactaccagtcactcagaatatttccaattagattaattgttttgtcgtctgaaatatgtataatatacatgccttccttttctatgtaacagcgaagaacattgcaaaatgcatatacaaaataagggcatccagaaaactttcattgtattagttttctggatccattccatggttcagggtaaattatacaatataaggctaggggaaaaggagaggatatgtcttcctgaggattaacaattacatttgtgaaaaaaaaataaggaaaatgctaagttaatactcctgagattccataatctgttctcccttggtcatattcttccattttaccatttgcagaattttaaaaattaaaatacaacctttaagaggtcagagatgaattcattaccatttttaaaaataaagatccaatgaacctgggctccttgggttgtttcacagagatctaagagtcgctgaaagggctgtgtgtgtgcacaggaactttgttccaaggaaagtctccagcatcctctccagcatccacaagattttcatacagatttccgatgcaaagaaaaattaaggacctaaggaccatggccatgaagtatttgtggtcatgtaaagacatatttcctcagtgggaggggcttcaagatggctaactataggcatctggcactcacctcctccacaaaaaagaaccaaaatagcaagtagataatcacatttcaaatagattatccaacactagaattcaacagagaagtaagaggaaacacctaaagcaaggaaggagagagaatcaaggcatggattggctggaatcctggagaggctatctctccagcgaaaagaaaggtaagtgagtgatggctagcagtccacattcccaccttggactcctgtatcctagccaccagaaagcccctaaaccctggcagaccctgagactaagacagggagctgtctggagatcacatgaagacattgctccatacagggagctcatgctgggtcccacacatcccctaaccccctacccagctacagcaaggcaccatattgagagcccagcccccaccagactgcatactacctgggggctcaatagtccttgtatccccataactctggagccccattgacattctctgcctgcagccacaactgtggctggctgttgcctccagggatgaagtatgaaccatcagcaaagactgcactgcccccaggaacaaacccaccatgcaagttcatgcaccctaaggacaaaaccccccacctgcagcagcttccatggagggctgctgcagccatgaccaaagcacaagtgaagtgcatgctccccagccacccgtatacagctgctgccactgaaagcaacaataccctccacagtagcagggctgcagatccaacaggcccagttccacaccttccagtgcctcaacacaccatctgggggcctgaggatagcccagtccagtccactactattgggaactgagtactcatctcaagcacctgaggtcaggcccactcaaactgatgctgcatcacagctggcacccacctatacatgccacctgtgagcctggagactggcccacctagcctgttgtagccacctctatgatgcttggaactgaggggttagtctcaccactgctacttccaatgctcatgccatgcctactgttcaggggactgagaagcccccaatccacttggcccactgctgccaccactggctcctgagcaagccacctggaagcccaagaatcaggcctcttggatctgctaacaccagtgcaagtgtagaactccctggggcccaaggcatgggacaggcatgcttggcccaccactgccactactggggcccaaggtcaggcccaactggcatcccatctccagtgaaacttcaccacagcctccactaacaattacactctaagctactgaagaaatcacgtacactgctgacacggtttacagccaaaggaatcatacaaagactgcactactacacacagccagaattaaagccaaagttctctactcaaccaacatcatagatacttcttcaggaaaaagtcttcccatgtgaaagcaaattttaaaaatggaaataagtgactgtttaacaagatgcaaagatattgacacaaggacacaataaacatttataaagcaaggaaatatgacacttccaaatgattgactaattacccagcaagagaccccaatcaaaatgaaatttacgaagtcttggataaataattcaaattattgattctaaagaagctcagtgatatacaagagaatacataaaaataatacaaagaaatcaagaaaacaattcaggatattaatgataaatttaccaaagagatagctatcatacaaattagcaaagagaaattatggaatggaagaattcatttaatgaaatacaaaatacatttgaaaccttcaacagtagactagaccaagcaagaagaaaaaagttcagaactagaagacaggtcttcacaaaaaatgcagtctggcaaaaataaagaaaaaagaataaacaaagcctatgtggcgaatggaccaccattaaacaaccaaatatttgcattttcagggtccccaaaagcaaagaggaaacaaaagagtcagaaaacctatttaacaaaatactagtggaaaaattcccaaacgtagcaatagacttagacacccagacacaggaagctcaaagattcccaaacagatacaattcaaaaagatctccacagcacattagagccaaactgtcaaaatcaaagacaaaaaattctaaaaacagcaagagaaaaacatgtagtcacttataaggaaaccttcatcagatgaacagaaaatatctcattagaaaccctacaggcaaaaagataatgggataatacagtcaaagtcctaaaagaaaaaaaaaaaagccaaccaaggatgctatattgagcaaaggtatgcttcattaatgaaggagaaataaagcctttcccacacaagcaaatgcagagggaattccttattacttgaccagacctacagtgaatgcttaagggagtcttacgcctggaaacagagaaacaacatctaccatcatgaaaatgcaaaaggaaaaaactcactggtaaagcaaatacacaaatgaggaagagaaaagacccaaatgttaccactacagaaaaccaccaaaccacaattataaataataagaatgtaagaaaggacatacaacacaatctgaaattaattaataaaatgactggaataagtcctcacatatcaatagcaaccttgaatgtacatcaattaaacttcccactcaaaaaatagactagctaaatggattaaaaataaatccatgacccaactatatgtcgcctataagaaactcttttcacctgtaaagacacatgtagactgaaaagaaaaagacataaaaaatattccatgcaaatggaaatcaaaagcaagcaggagtagctatacttatatcagataaaacagactttaagtcaaaaatggtaaaaagagacaaagaaagtcatggtataatgaaaaaggaatcaattcagccagaggatataacatttctaaacatacacacacccaaaagtgaagcacccagatgtataaagcaaatattactagacctaaagaagagagagactctaatacaataatagtttgagacttcagcactctatcatagcatcaaacagaacatctatacagaaaatcaacaaagttggatttaaacttcacattagaccaaatggacctaatagacacttacagaacattttatccaacagctacagaacacaaatttttctcaccaacacaaagaacattttccagcctagaccatatgttaggacacaaaataagtctcaaaaaattaaaaatcaaaataatatcaagtgtcttctcagatcacagtaaaataaaactagaaatcaataacaagaggaaatttggaaactgaacaaatacacggaaattaaacatgttcctgatttaccattggattaagaaagaaattaaggagaaaataaaaatatttttaaggcaaatgaaaatctaaacatatcaaatgctatggaatactgcaaaagcagtgctaaaagggaaattttagcaataaatgtgtacatccaaaaagtagaaaaattccaaataaacaatctaacactgtacctcaatgaaaaagaaagcaatatcaaaccaaactgaaattagtaaaaaaacaaaataatgaagatcagagcagaattaaatgaaatagagactaacaaaacaatgcaatggagcaatgaaatgagaaaagttgtttttttgaaaagacaaacaaaataaataaattgctagctagactaacaaagaaaaaaaagagaagatccaaataaacaacatcagaagtgaaaagggagatattacaactgataccacagaaacacaaaaggtcatcagagactattatgaacaactatgtactaacaaactggaaaacttagaggaaatggataagttcctggacacatacaacttaccaaaattgaatcatgaggaaattgaaaacctggacagaccaataatgagtaatgagtttgaatcagtaatacaaattctcctgaaaaagagaagtctaggaccagatggcttcactatcaaattcctccaaactttcaaagaaggactaacatcagttctcctcaaactattccaaaaaattgaggggcaatttctccttctccctaactaattttacattgccagcatttccctgataccaaaactggacaaggatgcaacaacaataaatcaaaattacaggccactatccttgatcacactacataaattcaaaatatgttacaaggctatagtaaccaaaacactatatattattttatggtattagtataaaatagtattttatggtattagtataaaatagtatttttagtatacttttatgctaatagtatatttttatactattagtataaaaaatagtattttctggtattagtataaaaacagacacacagtccaatggaatagaataagaaacccataaataaatccacgtatttgcagctaactgatttttgacaaaggcaccaaaaacttacagaaaggaccccttcttcaagaaataactctgggaaaattgaatatccatatatagaagaataaaactagacatccatctctcatcatatacaaaaatcaactcaaaatctattacggacttaaacataatactcaaaactataaaactacaagagaataaaacacttcaggaaattggtctaggcaaagattttatggctaacacctcaaaaacacaggcaataaaaacaaaaatagacaaatgggactatattaaactaaaaatcttctgcacaggaaacaatcaacagagtaaagagacaacctgttaaacaggagaaatatctgcaaaatattcatctgacaagggactaatacccaaaatgtacaggaaactcaaacaacttggtaaaaataacaaataatcccattaaaaagtgggcaaagatatagacatttctcaaatgaagacatataatggacaatgggtacatgaaaaaaatgctcattatcactaatcatcagggaaatgaaaatcaaaagcaaaatgagatatcatcttaccccagtaagaatggctgttatggttaaaaaaaaaaaaaagatgcactggtgaggatgtagagaaaagggaacacttctacaacgttggtgggaatgtaaattggtacagtcactatggaaaacagtgtgcggatttctcaaaaaaaaaattctaaaagtagaactaccatgcaatccagcaatctcactactgggtatttattaaaaaagaaagaaagaaagaaagaaatcagtgtatcaaagagatatctgcaccctcatttttattgcagtactattcacaatagctaagatatagaatcaagctaagtgtccaccagtggatgaatggataaggaaaacttggtatacaaccataatggaatactattcggccataaaaaagatgaaatcatgtcatttgcagcaacatggatagaattggaagttattacattaagtgaaataatccaagcatggaaagacaaacagcacatgttctcactcacatgtgagagctaaaatttgatcttatgcagtcagagagtagaatgatagatactggaggctgggatgtgtgtgggggtatagggggttggtgataaagagggattggttaatgggtacgaacatacagttagatagaaggattaaagtctaatgttcagtagcagaatagggtgactacagttaacaagaatgtattgtgcatttcaaaatagctagaagagaggacttgaaatgttcccaacacatagaaatgataaataatgcgggtaatggacaccccaaaaaccctgacttgatcattacatagtctatgcgtgtaacaaaatatcacatgtaccctataaatatatacaatatttgtaccaattaaaaaacagatacctctccaaatacacagtccctaggagaaaataaagaaccacatctccggagaaatcaatatgtggtacagaaaaagacttgtgttttccagaggctcatccctttgatgagggaagtcagaggagcttgataccatagatgttggcagatgactacatcaactccctgaggatctgaccccacctcgagagtctacagtattagaaggctgtagggagttgaacactggaaatgattcaagttctttatgtaaagttgaagaatcaatttgaagcatgaatggctggaaaataccaatgacctgtcacagatgataagtgatagtatttgtctgaatgagccaagtggtgggaaaaaaaaaagtttacagagacagcagatgttcactctgtctccactactgcccctctgacagcgttggtcaataggacacaaagtcatgtggaaatgagacctttgggcagagcctgaaagggagcttggttattacaggctttgggttgtacttccaggaagaccagaatctaaatgggtctctcctgtctctcccatgccgctgagacccaccagcaagggcgcaatcaaaatcaccctccacagaggaattcacagcagtggctatccgaaggatgcttcctcagtcgcctggagcagttttcattccgcatattaaaatagtctgaacccaaaagtcatatgaggataaacatatgcatgtagtttatttattttttctttttaaagaggtactgaccttgaaacggctgatcagatcataacgtgtgagtagttcatagaaaataaatttcagtgcatgatccccactggcctcattgagggaaaagacgtcaaaggaccacttgtccacatcctgcaggacagggtggggagaaagaacacattagcccacagacacttacacacctaccagtctcctcactttcaagtccgcctgcagccctcactggagatttcacagtgtgacactcaaacagactttccactctcaaactttttccaatctggctagtctacatagtatctactgttaaaaaaattaaatagtcttattactaatacaaatagccataatttattgagtacctactgtatgacaggcattatggttggtgataaatatgtaaattatcctgaaaacaactctaagtgatagatattagtcgcattttatggataagaaaactgataaattacctaatttccctaacacccaaggtgcgtaagtgctagagatacaggcagggccagaacacaaacataggttggatgcctaagatcagttgctttccattaagccctgcagctgctactgtttaattcactacagcctacgatgcttctcttctctgaacttctctgcaatcccttgacactatccaatgacttcctctaagtttacagttaagaatgttaactcatttagaagtgttcagaaacatgcatgatgtagaacacaaaacaatatgccacatcaatcgaaactgctgagctgaaaccaaaaagaaagcattcatttcatatgacagaaaaatgctaccatttctggagtcactagtctgggatcttgtcctcaaatctgttagtcactttactgaaaaaaagtaaaaggaaaaactaaactgaacacacaccttatataccatccctgaagttcaaagtctttgcctgtaaatagctactccaaaatatatgtaaatacagtctgttgagctttggcttatcataaccaacttcttgtggatgtagtaaacaaagatttatttaagcaatggttaaagcaacagtcatttggcttttcacagcaccaaaatctcacttcccgtggttaggtgaagcatattcacttgagcttgacagcaaggattcacatgagaccacactgcctacaggcaaggtgtcagatggtacactggcagagaccttggttctcatgagtgactctcaccccagccctcactgaattccaacataatccatccatcctaattttgttcctgaccaaacattccaactgtcaaattcatcccaaggccatcaagggtctccctcctggatgctaataaactgttttcagggaaaatagaattgcatataggaaaatcagacttttccagaggggtttaaattgaattgttccaattcacacttagtggtaacctcacttaagtcttcaataactgcccctccattaaaataaccaaagaaatagtgacaggcacatttctgtgagcacattttctgtgctaggcacagtgtgagtgtttacacgcatttgcaaaacctcgcaagtctagagataggtgttactttctccagttttatagatggcaacctcagagagattaattgaaatgtctagtgccataaggtagcagagccaggtaataacctcaccaatgacccttaatgatctcactgccaacagatgaaattgtaaatgccatgaatatgtgctgtgacccaggcctcatccctttaatatcccactagggcgcaggctatagacagcaaggacacttaagattaacctaagacctaaagctttaccttggttactatcattggcactgccatgagtcacatacattgtcttatctttagtcctaaggaaaaagtcactgacaactgagtaggctggaaaatgctgtgtcacttctgacaatttttaatcctagtgtccagaaaggaaagggctctctatcactagaaataaagagattatcatgataaaaagccaagatttattctgaatatcaggacttagagaacaaagaggatgagcaaatagagacagtgagacggatgtcctctttggtccctcatgttagggaaggcttagctgtaattctcagtctaatgttcttcagaaccagttgaggggcttggccaaaatatggaccctccagtggggactccagagaatcctgctgtggggcctggaatccgcatttttaacaagtacccagtttaactgccttcaaccattcttcctcattcaccaaattttgcccaaggacacttcctgtagagaaattgcaggaacttcctgttagtctaacacaaaggaagcgtgaacctcctcatctcctcccactttaagcctggagtctttccaaggtgtcacttcctgagtcacaaaacagatgcccttctaaagaagagcacacagctacatttccattaggctaatctcagaagacaagaggtagaacacctcaagttagaagcttacatctatatatatatatatatatatatatatatatatatatatataatggaaaaagtaaaataacataatgcaacatgtttcaaatttagagactgattcattactatcttacttaaatatcattttatgtcatgttcttacgttaaccacaaaggttaacatgacagtagcataagggttattttagggaattgtattctctcagtctttagggaaaatttctgtaataaaagaaagcagtaatgattccatatgaacttctggcaatgaagtggaaataatcttttttctaacatgtagtacataaagaaagaaacaaaagagtctatatctgtgatcgctccaactcattgcaaacaaaatcagcctctggagaagtggaaaaaacattacattgtaaaaagctttgaacttccccagtaaacaggggacatagccaagagaaatagcagcttcagctttaatgcacatatcaacaatatatgtgaggagaagtagcaatttatttagagagctagtaggtcttccttatctgaataatctaagtacctgtcccctcagacaacatgtgtgcatctgagattttcttttctctaagtataaaataacaattcatgcacatcacagtttgttccaattctttctcagttattctgcatagaaaagaggcttcaatttggatagaaaagaggcttcaatttggaagaaacattttcgtaaatgtcttggtaccagtataccctcttgtatttatgttcccgataaaggaaaaaattaaagacaataatgatgcttttaatgtttctaagagtttgattgaacattcaggttcaattatgaaaattaatacaacttcatagtggatgttaagaaatatcagatttcctgaagtgatttcactgattaaaatgggaaatatcactgtacattacactgaagtattgggcatcagattaggggttaaagaggaatgggagaaaagatacatcttcttgctgggtccttcctgagtatccttcctgcttttaagattaggtaagaagagacggaaagggtagagacaaacaaaggagaaatgagaatctgtgtatatatggtctctcaaattcagctagtaaatgtctctgagacaagagaaaggcctatgaatacataatcaagattgtcccaaggggctctttcttgacattaaattaatcaagaagcactccccaccccctaactccatgaataggtaatttagcttctgaaaatatcacctttttcaggttttggagaaagaaaacaatggctttagcaaaggtcaaaatgctacaatgtccctaagcacatggcccaagtccatacatagacaacatgtgatgtcaacaaactcagtgatcttgggctacaggatcagcaacacattggaatccagaagccaaatcaagtttagcaaatctcaaataccctcagaccaatgccttcaggaatgcatctgctttggggctgctggagatattctatacaattccaagaacttgcctgactagaggtaattctgcaggatttagcccatttaaactcaagcatttgtatgacttccatgggaacatttggctcagtgagagtctttggaaaacaatgggctatatagatgggacaaaggctctcaggccatacgttcatgcagtaaaacattactaagagcttaccatgtgctgaaaactctgatatcaaacattagctctgtctctaattaactctttttttttaaatcttgctgagtctcggtttcttcatctataaaatggacttggagtaggtaatcagataatgggacaattgcaaatactgaagatcctcctaatgctgaatacttacagccataacatatttgatctcgtatggcaaaatcagataactctcataatgacagatcactgtataaaatctaaactactctagagtactagaaagaaatgaaacccacacagagtttgattgtttttaaattgggaagatgaagggtgaaaagacagtgatactgttagaacaaataataaaaagataatgaaagaataaagtcaggaataactggaaaagtaactgtaaatgaaagcctcttattttctaacaaatttaactctactttttattaggtaccatgtacattgtaaaatcttttcactcgtattacctttaatgcctcaataacagctggtggatagctcagtccaaccatgtttgatgtccgtctatacattctgaaaagccaaaagggaaaaatgcaacatgatatcttataaagtaggatttgtaatccacagactcataccaagtattgacaaataataagaagtcaagtggggtgatccaaagaacctaaaattcattttttgacatttttaatattcactcaggtggtctaagtgttaaattcaaaagaaattaaagcaatcccaaacatatgaaccatgggggaaaaaaaacctaactctataggccccagactggaaattgaattattaaatgggtcacttcttccgccagagtgaattatagtacagaatagacagtaagcagagtagtaatttagcctgaatgaagaactcctatgggtaacccatttagaatagcttgttctttagaactgtcaaaaacaagaaggaaaaatgtcccaggtaatctttaaacttaccgtggtgtttctaaaatgtataattacactataaggattataggaagaatatatctatttctggaatctattgctgggtaaggaggtcaatttgatttcaaagagtaaaatagctaataaaactgaagtgtcttggggacttcaaaccactgaaatgaactgtcttccctgggccagcaacctcaaagcatcccagatctgtttcaaatggagacatcatccacctatttcaaaagatgatagatgagatgatttcctgctttaaaaattagagactgaactcaaactaaatcttctctggtaaacaaaaaaattctgagcaaaagcaaaagcttttcctaatgatgctacagagattaaaatagatatgtttttgccatttctcattcaagactatctgtttctacccacaattttcagtatttataaagataggaaaactacattaaagcaaagcttccagttattggaaacgtgttgctttggctgctttagtcactaaatgacaatgaatgacatctttacctctccacaaatatcccagcctgcactgcgtgaacgatgctcttgaaccggggcttctcgtcgctcctcctgagcatcatccccatctgccgcgtgaaggtggaggccagccagtctcggacctcagaaggcacagcatctgactgaatgtcactgagctcatcctctgtatccaggagtctcctgaacacaagaaacagaatcagcacactgagattaaatctgaagttggagctctctgttcaaagcagctgctcctctctgcctcacctgcatgttaggtgcaaagaaaccaaattaaattggccacaaaaaatacagtgcctttttggtaaggcttatgtaagctcgccatgtgtgtttcgcgatggtcttggcttccactgatatttcaggatggttctctctaccagactggacaaaggaactggtccattgtacccagaagcactctgtggcatttgagtgaaatttaaaccttctatttaaaaatgccttcacagggagccttgtattatttcatagatggaccatgtgacgttattttgtttaaaaatataaatggatacttaagagactttgcaaagtatttaccaaatcacagcaacccagtcctctgaagtagtgatcctaagtgatgacaattaagattctttccaggttgctaccaaaatttaaatgtctaaattcaaggaaaattttcaaaataatgcagttctttatttgcgcacaatgatttaatcatctaatagctgtgttttgctgatttttcaaacttgttcataggtcagaccactagaatcgaacacaaagagcaatgttaaaataaaacctaaaatagcatgtcatatttacagtaaacccaactaaaaatcatcagtaaaagtagctgccaatgtaaaggtgtttggattttttttttcctttagacttaccaattggggtggaggtaagcggaggaaacataacatttggaaaaaagctatgatatcgaatttccttaaattagaaaccaagtgtgtcagcaaaataataataatagtaaaccatacaaatcttagattactgtgaaatactttcagattggaatttggcaaataaaagacatcacaaatactgacagagaagcctgtctaaattagggggaaaaaaaaccacacctttcgtattcaacatttcaacatttttcaaaagaaatgcaattttataactttcaaacgtatgtagtaactgaaaccgctttaatacgtttagataattcaagtggaataaacctgctaagtaaatcagcgacatacgtaagactgaagagggaatgctgggtgcttaagagaacacatgcttctcgatcacttcaggagcctccatttactaatggacattatgaattaaaacataaactcaatttttagactaacactaaaaacatacaataattacaatggagctctatatctgatttttaaaatcttagtggatttttaaaaattcgtttttctcctctttcatgatctcacttccttgtcatggcggccatatgagatttgttctattagctccttttatagatgaggcggtacagagagtaagtgacttgtccaaatctatcctctttgtttgtggaaactaaaactcaaagatgagtaatttgaatgtcaccccattcctggcatgggggacaatttcagaaaagccatttaagagaaaatttactatcactatactaatctcttttgttatttttagcttaccttgtttcatcaatatacacagattcaagcactgtggctgcatattccaaattcttcttaagatctaccactgaagcttcccctctctctaattgtttgaccaaagaccgtaatctagaaaaataaaaagacataatttcattagaatagaggaaacaaagaataatcctacaactatggtgatacattttacagtcatcgaatattctcacttattctgatacatctgaaaggaaaataattatgggaccaaaggagcaggtaataaaataaatgtatacatttttgccattgtgaagtaagaagaaaaaatttctctccaaccaggcactgaccatactttctagctagcttttatctttatgaatcctaaattatcaatgattttgctttttctcaaattttcatcttttttgttctatgtggatgtagtaaagcctgaccagcagcaaaatcaccaaatacctcttgagattctgctctgttgaaggcacttggtccagcagtggccccagataatggcagccccatgacccaggcatgtcccaagacagatgaaaacatataaaccactgagaaccacaagagggctacagaaggaatagatgaaagtaaattgttttactggacagaaaaaatcactctgagaggagataaataccctagttaaaaaagaaaagaaaatatgaggattgattttaaaccgaggaattccagactatacaagagaagcaataaaacatgttttttctgttatttatatgaacattatctgcacagaggacttagtattcatgagaacaataaaatgactacagatgatcaacatgcggtaactgagaatactgtaaataccacagagatttggagattgggcaactcttcaggctgtttgataaccagcaatgaaaagagtagagactttgaagacgaactggggtttgaagctcacttcataacttattagctgtgcaaccctaggtaagttatgtaacatctttgagtgttatcttaatgaagagcaaagtatgaaatttctaaagttgacctaaagattaaatgaaattgatatagagtatgtgactcggttgttctttgaaaaggcaatcgttatagctattgtcattattcaatgactttgatcaccacagataaccaaatgagaaaaattctagcaagatatttaaaatgattgtcaaatctccacttcccgttggtatacgcaatctgttctcaccttcctgacatcaaaatatcctcaaataggttgccttcatggcaaggtatagactactcccttcctgatttgcatgaaaatgacccacaataaagaatgagaaaaaatcttggatcaaccttaaaaagtaagcaagagggtcaaccataaaataatttccaggagtttcaatgatataaaatacaaataacattagattcaggtagtatctacctgaattacgaatctgcaatatatcaaacggaaatatgcaaaggaaatcagcagaggcccctgcaggcttggaggtgaaggtcagccttggcaatgccattagcagcactgggaagagttctgaatttcagaggcagcacgagacagggagttggcagggaagggcatgccagtcactcacacagaaggatagccagcctgccaaagaatggggagacagcagcagggagctctgactgctgctccaaataaggattggaagctctttagcaaaacacattcctggctaagtctgcctccagttctgattctcacctcaaggtgcccagctatcccctaggctgtttggactcccaaacgaaaaaatgagagtaaaattaaacttttcaaagtttagtctcaaaaatgaaagtaaaattagactttttaaagtttactctcaaacataagagtaaaattaaacttcttaaaaatgcctctctccatttggggcttacaggttctatcaggaactgacatgtaactctagtagaatccatctcaattctagaacctaagaggaaatgacaaaaaccaagaaaatgatgagaaaaattataagagtaatagaagtaaaagccagaagatcctatctacctataatagaacttccctaggaaataaacaacagaagcagctttaattgaataagttttcctaggctaaagtaaaacctgtataagcagatgaaaagggatcaaatacaattttttaaaagtaaatgaaaacatcaaatgtatgctactgtaatttttgatttcaaagaataaagaaacaaacttgaaaatctttgagaaaatgaaatataatacttacaaagtaacaaaaaattgtcctggccatctacttctatcatgtcaaacatcaaaaagcaatttaataacagtaccaatttttgagaataatatgggaaacttcaagacatttatatctacatctacagagttaccaagtacataagaagccaataaatacattctcaggtgtcaacaacttcaaaatttatcattcatatcctttccagaaaacaaaacaaaaacaaaaactttaagcacagtggtcttccaagggagtgaattcgtgagtctccagttaaatggattgttgattcatgacctagatttaactaactcaaactgtaccaaatggacaagtaatttaaaaagattctggaaagaagagacagataaaataaaatgctgataatacaaggacaactaaacatgaaaatgagctgacacgtctccttttactaggacaatctcctatttctcatacaaacacttcctctcccacttttacaaactaaaagctaattctcatcagttgaaaaataattggaattattaaggacattatatggactatggatgtatagccactaatttttaacaattcccactcctgggaaagcacagtattgagagaatcaagtcatgaaggggcctcatatcaccttgtgatcagggggctgggaccccagggccagaagaggagtggggccttcagggaaagcttcacttagaatctcactcagctgttccaatgagtagcactgaaatcggctccatcagggagacccaggctttgtgccacaattagcagaaaatcagccattcagaggcttctccctgatgtagtcaccagtggtgccaggcagacattaggcagtcacatttatgcattcagtgtgaagttctgacccaacaggaagctgtaaatagaaagcaaaaccctagccaagtggtttcaacagatccagagaggaaatgacacagaaataatgcaccttttggatgcgtgggaggcactagaaatttatatgtaaccctgtctttccagcttatgagatgagcagaagattcaatcaacttcctggcagacagtgagggaacctagaacaacccgtcactctgtttatggaagaacacccagctgacattcacctttctttactcaaggatgatgaaacagaaaaaaaattcatgaagagatgcagcaataaagacagaagaaaatacagcattcaaaatgtgaaaggattcacttttgaaaaaaaaaatcactaatggaaacagaagtgaattttagggagcatctgctgtgtgttcaatacaattcaaaaaaaacccatagatctctgaaacaaaggtaaaagcccaaatcaacacaataagaagtttctttaaaaagaaaaaaacatgacaatagaaagactacaagaacttattgttaaaaagagttaagtggtgaccagctttgtatatacccatctcctgtttgggtgtcacccatgtcagatacaagctgcagctgccaactttctgctttatgtagctgccacacaaagcctagtgattccagatgcccctttcaaattctgttgagctttagcatagtgttcaggtgcttatgctccataggcccctcagcccacctttctctagctctttatccattccatttggaatatccagccctgccctgccatatcctacctacctcttggtgaaatggctattctttgggcaaaagagtttcaaattagctcttttatcattggccaatttaagttcatgagaataaggacccctctctatttgtcattatagtgaaggtattccttagatcttaatctatcttaagaagggttgtctgaaaattagccaggatctttcatacccatgtcataaagtatttttgttcaactggaaaagactagctgaggccagagggctcaactgctcttctttgttttcctagtaaagttgtctagatgcttttcatgtgaatccattccatctaaaaggcaaatgtcctcagaggccaggtcccatggtatgctgcagcctatattttgggaaagatggagatctggtgttttaatactacccaggggaatttttggtctggacacctaaggggaatttatttcatgagcatttgaaataaatttacaaggaaggaagataaagaagtaggaaaatatacaaataataataatattaataagatttctcttctgagagaatgaatgttcatagtttccagcactccatccatttctgtcactgcagctgccagataatagttccagtatagaagtgcaacaccattttaggaagtgcttatgccttccaactttggcaagatgcctttcagttaagacagtgtgcaatttcattgtggatgagccattgcatcttttcatgactcttgcatttcttggcgtaaactgtttgctttctgtatgcttcttacctgcaaggcatatgatgagatactgaatctcttcagttccctgtgccctcagatccagagcgagccctggatgctgacttcccctgaccccacaccaatcaacatgtgggatgcacaaaggtgttggaagaggggaactatgtgaggaaaggccagagcactgtattttgtaatttaaaaggatgttagggaggagagatatttcttttttttccacaaagataattcctaggaccaatggagtgagcttcattaaaaagcaacttattggttcaactttataatttagaaaactgccttatactggactaggcattattccccaccccagtgaggtcgcagaaagccctataaccctatgccttgaaaacatatacatttgttgagcattagaccctactagaatttcattcttttgcacaaataaaaatgaactataaaaagaagctatggaaacatactttctcatgtttgtctattctgcccaaggttattccctctgaggatgggggggcagctcctaaaatgccagtgtaaccaacaagtactgctgtctcagaaaggctttgttttgtttgaaaggatatgagagagaactggatcttttacagtactttctctacatgtcccaatggatcatgagccctaaaaactcatttgaattaaaaaaacttcatttcagttcatcacacccatgtattcgaacagcatactcatctctgtgtccttttcatacacctgcctcctccatgtcactcctgtcctctgccacttacctaaatgccataggaaataacttaaaacaactcttccaaatgggatgccccaacatgacttttagtcttatgctttaatgccatccaatgatgtcacccaagcatttttctggccattgtttgtttctataattaatgacagctgattaagatggccacacttgaaaaacattcaacattgggtgtcttttgtgtgcaggcactgggagagataggctctaggaatacaaagtggggaaatgcagtgccttctctcaggtagggaagacagaaagctaaccagcacccacaatgcagtactgtaagcgaaatggcagaggtgtgatgggggctaagaaagcacagaggagaggaatcttctaataacaaagccctccccagtggagttgaccagagccattttgaaggccacgtaggggtcagccaggcacagaggatgggatagggaaacggcagactctgcatggagagagcagactgaaggcagtgatctattcagatctattcagaatagatcttttcggatcttttcagaatagatcttttcggatcttttcagaatagatcttttcggatcttttcagaatagatctattcggatctattcaggggcgtgtcaaaagataaaacagaagaaggtaggaactacaccacagtagacttagaatctcaagctaaagaaatgtaattttctcctggagataatggggaacccctggagaatgttaaaatggaggaacagaatgatgagattggcattttagaaagatcaatctagcagctgagtagaggagcacacatagtgagtgagatggaaaattctatgtttccattgtaatcaggctggtctgatactctgaacagcacagtgtgaatactctctctcacatgatggaaatttgatagagtgatgcgtgagtttagtggtagtatggatggttgcttttaagaatttctgggaaagacattgttttggggcatgcggtttcctcattgagtgaacatcaaaccaaaaacaagaacagtgccaacaaaaattatgactggcaagaatagcctacttatgtagcttttaccttttgttaatgctataaataaaagagaattttacttctacagtttctaattacatctgcttaaagcagatgcacacatggattgaaataaattactggactccagttactttttcacttaagaaaaataattagtacctaggtgcatacttatgtttctatacttttatatgcctcactacataacttgttaactaaaaaaaaattagtaatgttatagaagattttgaataacgtcatgaacaaaattgacctagttggcatggaccggacactgcactaaattgctgcagaatgcaccattcttttcaagtgtacatgtaatagtaatcaaaactgaccatgtgcagggtcacagagactctcaataaatttcaagtaattgaactcagacagataatgttctgtgacaacaatgaaacacaattttgttattgattagaacccaaaacaaaaaatggctagaaatatttcaagtgtatggaaatttagaaatagatttctaaataacccataggtcaaaggttaaatcacaaaataattctaactgaacaataacatacagccttgtagtatgcagctaaagcagtgtttagaggaaaatgtgcagccttaaataaatatattagaaaaggagaagtctagcctgtaatcccagcactttgggaggccaaggcaggtggatcacgaggtcaggagatcatactggctaacatggtgaaaccctgtctctactaaaaatacaaaaaaaattagccgagtgtggtggcaggtgcctgtagtcccagctacttgggaggctgaggtaggagaatggtgtgaacctgggaggcagagcttgcagtgagccgagattgtgccactgcactccagcctgggtgacagagcgagactcagtctcaaaaaaaaaaaaaaaaaaaaaaaagaaaaggagaagtctaaaaataagtgatctcgttatgcacctcaagaagttagaagaacaagttactccaaagacagtaggcaatagcaaaaaataagcacaaaaccaaaacttaagtagcaacaaactcacagcagaaataattagcaaagccaaaacctgggtctttgaaatgcttaataaaatggataggtcaagcaagactgatcaagaaaaaagagaaatgatataaataaccaatatcaaggataaaaagagactattactacagattctgtggacatttagaaaggtaaaaggatatcataaattcctttctgaagatacatttaaaaatttagatgaaattttaaaattccataaaatattaatttatcaaaattgacataagaaaaaggtaaactattaataattctgtatcagaataatgatacagaattgtatcagagtaattgatctactgaatattgtatgggaagtcttcaccagttcaacaaagaaagaagaaataatagacataggactggaaaaaaataatatctttaaaaagcagcaaataagttattctaattaagaggtgaatttagcaatgccacttgataaacagcaataaacaattagaaaatggtaccattcacagaaacatcaaaacgaaacagtttctaggaataaatcttacaaaatatataaaatcatctacatggaaaatggtaagatattattgagagaagtttaaatgacctaaataatggaagaagaatccatgctcatgaattttaacactcaacatttagaaatatgaattctccctaaattcacctgtagattaaattacaaacaaattcaccacaagtcatttggtggaaaccgattctaaaatttacttagaaatgtgaagaatgaaatatagttgatgtggtaaaacaacaaaactgttgttactatcctacatatcaagacttattataaagcatttaattctggtcccatgtccctctaccacttcactattccaactctcttcctttcaacatccagctggtatgtgtgaggatgtgcatatgtatttttatattcatataagcacaacataagtggacaagaaaacatgctacaagaaaaaagaaaacaggcaatgtaagttgtttttgaactatcctattctacatgtgattgttccattccacatgcagggacccactctttggatacccagtcaagggcatcactgcatactctgtcttggttgccatggattttctgatgaatatttccattcctttggttttcgtgaagctatgccacagaggagccctgcatgctcagtctcctccttgttctgctctacagagtgaatctcctttggggatatatgtttgtgggtgtgagagtatgtgggcaactgtgtgtccaaagtgagtgtgtcagctcactgcatgggaacaccagccaaaatgcactgtcaagtccaaaagaagccttctattcttatggtactctagaaggtgttacgactcagggttaaagttttaatccattttgagcaataatattgactttgttcctttgcacttcttatcaaatgcagtactttagaaaggagctccctaacagtcattcttggccttataaataagtgtttcttaaaaaccagtttatcccctgtttttattgccaatcaactcacacattttgttaaaaggacatagcggatttttttttagagtaagattccaaattatgctaagaaaatctttcgtgaaggtaaacattctctctccaaagtttgtaggcgagcagaccttattgggaaaggatgttattatgaaaacccacttgttcttctgggtgaagaaataaaaaagaatgaaaaatacaacccagagcatcattcagaatccaccccaggccatgctggggactggggagagggaagcagttaagatcctgacagactaccaagaggtaagttccagaagccagtgttcatttgcagctattcatgtggaaagaatcactgtcacttctgcctgctgataaacatgccacttcaacatctgtcttaatagaccaaagaaatgagaagaactaaaaacatctttgaatggcactaatgagaacaggaagctgagcagaaatgagaagcaagtttgcaggaagatttaggaaggttgcaacccatgcctagacacgtcaagacacatctttccatgtcttcatagtcaacccggtcccgtgactcctttgctttccttttctgaatttagttcctcattcaacctcaattgcatcatgttggtatgattatccagaggagctaaagctccctcagccagcaaaatcacaggaattctaccatactacaaatataagttttggtaagataaacctaaggttacatttttctcatttctacttcttttttcttttataataacagaaataaataaattaattcatagattaaaaaccttcaaataatggctaacaagatgctgaattggcacagttccctttcttaagattaactcaagaaaaattataggaaaaaaacctcaaagaaaaccgtgagaaacctctaaggtgacctgaggctgccgctttgaatgtgtgtgtgaagacagtgcatcttcttggtctgggacaggaggcagccccaccacactggggaggaaatgatgggaaaggaactgttggagtctgctattgtttccctccactccacttcctccaggcgcacagtagctgctcccacacctcctgtgactcagaactctaaatgtcaagaaatcctggagagctaaataggggttgtctgtcccaccttgtggctcctctaagttcaccatgggtttccaagattgtcacagaaggaaaagggatgcaaaaggacatgtgcgagaggtttttatgaaccagactggaactggaactgattgctcctggtcacttccaattgtccagaagccatagtcacctaactacgtctttccaagagagaagctggaaaacacagtcctgtggtaggctcaagaggaagaggtggtggttttagtggagatccagccaatctctgccccacctagaaaatgcaatcctatcaccaatacttgttttttcctttaaacctttactttctgctcctttgaaagagtcaaatggaatgttgtatattaaagatactttctaactttaaaatcctttaaaactaagaaacgtaatcatcctaattatcagataatctcccaagcattttgacaaaaatgagacagttctcatgggaattatgttgagtgaagaaagccaatcccaaaaggttatatactatatgattccatttatgtaatattcttaaaatggaggacaagattaggggtttacagggattggagagaagggagaggaagagggagacacgtgtaagaagggcaacaaagggaacctactggtgaactattctataccttgactgtggtggtggttgtacaaacctacacttgcaattatgttgcacagaaccaaatgcattcatacacacacacacacacacacacacacacacacacgtgagtacaataaaactggagggctctgaataagattggtagattatgctaatatcagtatcttgggttgtgaaattgtcctgtagtttttcaaaatgtttccattggaagaaaatgggtaaagggtacatgggaattcctctgtattatttcttacaataatgtgactctacaattatctcaaaattaaacatttagttttaaaaagtgggacacagttatccagctcaatggaatattgatgacaaaaggctggacatagttgtcctttccccagctggttttataagtgtctctctgttcttaaatagtggtctacttagtgtcctccagatccttcggcttggcctcagcagcagtaagagagttaggggtaaatgttcaccagtgagctactaactgtgtctgatgactttggagagcatccagtgagggctataatcagtgatgcttggagcttggtgagaaccagactcatgccttgaggaaaccctgggaaagacaaatggaggttctcaggatcaactgaagaaactcagatgctagcaaatggtcaccacactaaaacggtgagagaaaaagaatcccagtgactttactaaaggctcactaattacacctctactggcagtgatcccctgggactctaagatatgaagcacgatttgcatcttccctctcctttttcagttcattctcagaagtttgtttcaatttgagggtggcttcactatggcaggctggccatgaaggggttgtaaagaatgaaattaatatacacacccacacccaacctctagtaaccaccattctatgttctgcttctaaaagtttgatttttttttagatcctgaatatgagaacatgtggtatttgtctttctgtgtctggcttatttcacttagcataatgtcctctagggagtgaacagggaaaggagagatgttaatcaaagggtacaaagttccagttacacagaaggaataagttctggtaatctgttgcacagcatggtgactatagtgaagaataatatattatgtatttcaaaattgctaaaagggtagattttaaatgttctcaccataaaaaatgagaagtatgtgaggtaattgttatgttaattagattgatttaatcactccacaatctatataggtattgaaacatcacattgtaccccataaatatatacaattattgtcagcttataataaaagtaaattttaaaaataaataagagtcgattccataaaaaaatgaaaggaatgaaatctagagctagctatggactaagggagtgagggagtgagggtagacaagttggggtgtgaaaacacaggtcacggagacggtgttttgttgtatagtcatttccaataagtaggaaaacaatttgcatattattaacatttcaagtttgtattcaatgtaattaccattcaatttccttccaactatacatcattttgtaatagctttggggtgggataaggggagggatctgaaccagtaattcattgtcgtttgtggtcagctccagtatattctaataactgaacgtgtcaaaagcctaaagctttttcattttgtgctatatttaatagaaaaagaaaagaagaattgggaagacttacttatgcagtcccatctcacttgccagcaccacctccctttctttgtagatgaagaatgggactcctttcacttttagttctattaaaatagctctggctttctctgtggttaaaaatatgagcttgatatcgctcaggtagtgacacaaggtaaacgctaatacaggaccaactcccatagctatttagaaaaaaaaatcctcctctgttagctatttctatcacaatttacaaggagagttgatttacagaagaattagcagtaatagccacaaacactgttgaatcaatctggacaaagcactccacttgccccaaacaacccctcattgttcacggtggtaatctgttcattttaaaagtattatctagtgctttggagtttgtccctcaagaacagcatgagcctccactgtaccaggacttcctcgcttagcatttctaaaacctcttaaatctgggaacatactttgtaagatttgttttaaatgatatttgaacctacatggtgtcataatatattctatcattgtgtgtaaaaagaagaattcttttccaatgagctttattgagctttagactctgacttggggactggaaagaggaagaaacaattcctttaaatgattctctcttaaagtaaaaagagacaacaagggaatcatagaatgttcaacatttgctactgactctctcaaagtgtacgtgagaatttttaaagctccagaggtggtgttcacagctacgctatcgatcgagtgtttcttgagagggagtcttcttttctccataccaggtgatgctccgtgctctggggtcacaggagaggggcatctgccctgtccacagcctgacagagccaaaggcaagctcagacagctgtgacacctaattatgggtcttcccatgaagtctgaaaaatggctgaacttggtccagccctagtgtaaatagaacaaaataagcatatttgctggaagtgaggctggtctttaaaattcataatcacacatatggctccatgaaccatctgcaccaagccatgtctgtgtgtgacttttggctctgggctatttgctattacttgctgtggaccaggtgcagattccttctttctctctcagcccccacattcacatatttctcagaaaagaaattccattggaatcagaggtgaaaagctaaaacctgtggcctgggtgatctaccattttgacttctgtcacctaaaaccctagttccgcctagtgcagagatttttaccacttgaatgcactgatgtgtgacagagaagagtatgttgtgtttatatttcccccataccccctgccaacagccattcccaccacgagaacccccagggagcagtggaaagaggaatctcaggaaagtggtgtctatgaagtacatcagagttctggggcaaagtcctgaggcaagagattgttagacagggcaaggagagaatggatagctggggaatttagccccatttccttttcttaaactcagtaaagagatgacctccaaggtgactcccaggacacccttacacaaacccaagatggttacatcagattaaaaacagctgcatctgagatagaggaaggccacagttcagaccacctgcatcttcctcagctcctaggcaggaaggaggaagatttcagaggtcccctgtgccctgcaaagggacaggaagcagctgatagtgctgactggagggattattaggggcactgccatggatgagggacagagggtcagggatcaaataggtgctacagccagacctcagctggatccatagtgccaggaggagctgaacagggacaagctggtggggagaaaggcagtcccagacattagctagagatgtcactaagacttcctgtgaccaagcagacaagagatatcaccatggagtcaagaggaaccagaggacaatacaagaccctgctgtcttggagagtaacagcgagcagaataaagaaatctcaaagtctaagcatttacatttttttaagtgagttacctaaaaagaatgtttaaattgctagattgggtggtttcatgaattggattattattagtttctctcttttctctctctctctctctctctctctctcactctgtctctctgatatggtttggctgtgtccccacccaatctcaccttgaattgtagctcccataatccccacatgtcaagggagggacctcgcaagaggtaattgactcatgggggctggttttcccgtgctgttctcgtgacagtgaataagtctcatgaacaccgatgattttataaagagcagttcccctgcacatgctctcttgcctgctgccatgtaagacatgtctttgctcctcttttgccttctgccatgattgtgaggcctccccagccatgtggaactgtgagtccattaaacctctttttctttataaattacccagtgtcagctatatatttattagcagcatgagaacagactaatacactctcccttacatacatacatacatacatacatacatacacacacaaacacacacacaaactgccccatcacccagcagggtgagctcatgaaggtcaggtcatacataggaagtaaagaaacctcagtttctctgcacatctgaataaatctggccctgctatatgtacagcactcagcaactccttagtggcaggcagggcatagtggaagcagagatgggcacaactgttgtagtttggaggtccctgctggaagggtgaagggtgtctgccccaggaccaaagggaggaatataggggtagaaacaggacctgtacagaaaatgcacagtagttgggaagacatgagacatgaggtcaccaaactacgtgaatttattaccagaaataaagattcctactctcggacttctgtctgttcactcctactagctcttttgatctacttggtaaggatttattcccaccactgttacttaaaactgacagctagccttgttgaatatactccccagaaagctttctttagccttcttgtggtatattcacctccgtagcagccagtcagcaggcactgataaagagataagaataggaaaaaaagacagaagatctcttgaagaagtaagatattggtgatactattggcattgttctaaatccagtgcaatgattcccaaagccaacattgcattctaatttcctgggaatattttttaaagtacagaaaccaaggtctgactttagaccagagtgtgaaatggcataacaattgatggtaattctgaccttgtggggtgggacaacactttcagccaagtaattggaataattaagctaccttgtcatggtgttaattgtcttaataattaaacgaccttgttatggtttgaattatcctgacaagtgctttctaaactgtataccacaggacatctagcccacaggatgttaacatgcattgctggagagaagatttctgttgcacaaatatttgagaaatccaggttaaactaagttaagcaaagtttgtttggtcttcaccagctcagagctttttacactgatgtgcgcttagactctccacgatgaagcaattgtgtacgtcatttccctcctagatctgacaaggtcttgtatttttcttgtaaatcccccaggattagagggttttattgcatgggatttggcgagtgctgctctggagtgctgtcacagggctctacttccctgctgatgcaggtgcagtcagggaaggcatggattcaatgaacttgacatgaagtgatgattgtaaatttaaaacgagacagtttttttgtcacgcaaggaaagtgtcctattacaaattaagatacaaaggtaatgggcagaaaacatgtaagattatacattcgtggacttaaaatagcaaatcatggcatacagctatctttgaaaccagtttttctattttatgaatatttcaatcacttctttggttttctctcatatccaattttgtggcattattacattatgaacctatgatctcataaattaaacaggctcagataatttgacatacttcacttttacctcacaatgacgagagcatatttttaaacatctctcccccttttgtctctgaatactacttttctctaatattgttttctgtctctctctggacactctctgaggaccagttaacgtcatgtcaaggacaaatgggtgcatcattatgactgccaaatctcaagggtcctgttacatatttggattgtttttcctgaataaagcatagaatctccaacgctcattaattcttctatattcacatgcttttggttagaagaacttctgctcaagactacaaaccaatgggtttttttaaatatatatattttttcctttcttatagtcagaaaaccaacaataatttgtttactcaccacagaacattctcaattacaatgctggtatatattttttctcaggttttatttaatacttttcctaacacttcctaagtaacagaagggtttggtttctttgtgtgtgtgtgtgtgtgtgtgtgtgtgtgtgtgtgtgtgtttactatactgaaaaatgtgagatacaaataaagttttaattcatgttcttttaaaagagaataattgaaataagtatttcacaaatacctatcattagaaattcctttcatagtctcccacaaattttcttaaattttaaaaacctttgctttatttgtatttttaaaagaatctatggttattgtgggaaatttataaaatacctattagaaaataaaatcacataaaattgtaccacctagggattacaactattaacataaaatgtttatataattattatattgtatcatgtatccatagagtttaaacttctctacaaaatttatttgatagtatgctttaacacttaatgtattataaacactttcccttgttattaagagtttttctctgatataattttaataacagcatagtttgtctctaaatatacatatcataatttataaaatccactattgcaggacatttaggttgtttctgatttttgctgtcataaactgtattaaaatgaaagttttgtaactacatttttgtacacttttgttattttggcttttatttgattaagacaaaattcagaagtccaatcaggattaaaggagagaaatatttctaaatttgttgatgcttattgctaagcatctaaacacttatagcaacctcctctttttctccagcagaacgtgagcgtggctacctctcccagtaatcacagaaacctggtaagactgtttggaaggcaatggaaatatatgtgcaaaaatgttttttgtctcatttttgtaatccttggattttcaatggaaattttggaaagggcagaaataaagggcttgagataagatgaccatctttcactagcgtggcttcctccattgcaactagatttcaactggaagaagttatttatatttctaatataaaagagtaaagaagttacctgctcccctccctgcctctgtctgaagcgctccataattcatgcagcctggcatcctgtcagtgcccttagtggactgttgcttttagtactgatccttaccaagagcatgggcagtcccacttttttttttttttttttttttttgagacggagtcttgctctgtcgcccaggctgcagtgcagtggcgcactcttggctcactgcaagctccgcctacctggttcacaccattctcctgcgtcagtctcccgagtagctgggactacaggtgcctgccaccacgcctggctaatttttttgtattttagtagagacggggtttcaccgtgttagccaggattgtctcgatctcctgacctcatgatccaccctccttggcctcccaaagtgctgggattacaggcgtaagtaagccactgcgcccggccggacagtcccgtttctacaactcagtcttgcctataggtcacaatgcagtgaaaagcggcagctgatagtgtaagccccgggagatcccaaatgcccggttattaacaagtgttatatatttttaaaaagcaatacagattttacatcatatatgagaagggtgttgaaatcaagggaagaataagagacagggtggaaaaaaggaggcttccacgtgcgggagacagagaaggacaaaggcaggtacagtaatgaaaagaatgtgtaaacccttagtatgagcaggcctatgtaaatagcagattaatctattacccagttcattttgcccaaaggctttctttaaacggatccttgaatatgttccccattatagtctcatggtaagggagtgattctcaaggggggttgcaattctgtcccccaccggaaattagcaatgtctgaagacatttcggttgttaacaacaggaaggtgctactggcatctaataggtatgcagggatgctgctaaacattccacaatacacaggacagccccacagcaaaaaattatctggctcaaaatgtcagttacgccaagaaacctcactccaagaaaagcgaaagtgtagtattttttcatattggaaaagagcaataccattggctaaatgtctctttaattaaaaattaaaacccacaaaaagaaatgttcaaaagtagaaaaagaaaaatccctagcctatcacagatactctctacttatataataattgttttataagtctttccaattttatttcatattctctctcatcatatcaacccatttgtattaaatgtctgttgcataattacaaatacacaataaattattttatcaaatgcttattgttccttatatgaaatacgccattctaaaagttacaccttctagaaaacaagaaaaagaactaagtaacattcattatctttttattcctggctaccttttttttttttactgtaatatacaatcctttattgaaagttgtgaaagtactaccaaaatattaggttagagatggtttatcttttatattaacagtaagttaaaatttactacacaaacataatgactatcaattaataaatatggaaacaaaacagctgtcaaaaatgtactagatatccaatatcccatataatatttatgtgaagaaaaaagctcggtaattttatacatattcatatatagcaatatatattcatatattgcagctatatcacaacaaaataaggttgttgtctatgaagccctattgacttcttgagtatcctagaattttctgtttcagagtgtggttttcagctttaaaaatctaaaaattaaactttttcagtgttgtcattgtttaataagttcttcagattcatgctaccaagaatggttcaatattttaaaatctatttatataatgtaccaaataaataagttcacaaaagtctatatgatctttttgacagatactaaaaaaaaatttgatgcagttcaatatttttcttgatttaaacaattacatagtaaaccaggaatttaatgacttttttaaatgataaagaatacatatttggaaacaatagccaggattatatttactgaacaaacaataaaaggattctattaaggactggaataaggcaaggatgccctctagtagcattatttacaaaaaaaaaaaaaaatggttacgaattatagtcaatgaaataagaccaaaaaagtaggtagaaggaatgaaaaattgaacaaaaatttcattacttttagattataaaaagttcaataaattttaaagccattagaacacataatgaaatattatatagtaagtgattaccaaacagatacacaaaaataagtatcttcccattaaaggttcaataacatttaaaaatataaagaaagctattctattcaatataacagccaaagtatatatctaggaaaaaatgtaaaaagaaattctctaattccatgtgaagaaaactataaagttctactaagggatataaaatgaatattgaagaaagtgagatccacatcatatttttggatggaaaagcttaccattttaaagatataaatttctcctcaaattaaattctaaactatggatttgttgcaaaatttgagaacttattatataatttaacatagaaggctaaacttttaaacatagccaagtaatttctaaacaaaaaggaattcaaaagagaagtaattttatgtcttgtcctaccatctataaaaatataaattttaaaaataaaaacaatacagcactattgtcaatattgagaaaacaatctgatagaataaatagaatttccaggaaaaaatactaagtcacaggataggacttatatatgataaatttatttcataacagtaaaaaagtctgaattattgaacaaatagtatataacgtttgtcaagtatagctgtaaaaataattaatgcatttttaacaacttaccccaaaatattttccaaatggaaaagatttaaagatttaaatgtagaaaagtaaactcatacaaatacttaaaataaatgtaagatatatattgtatttatataatttgtgagtggaaaaggtttctctaagcatggcatcaaagcttgaaagcagaaaagaccaatagagcaaacaaactaataacaacttataattgtaaaagatttaaaattatattaggacatgagaaaaaatctatttactacatattataacaaagtatcatttctaagagacttgtgaaatcaataaaaacacaaatatgctttttacggaaaatataaaaaggaaatgaaaaagcaattcacagaagaactataaatgtccaataagcctagaagaattcatgagcctcagaaatgcaattaaaatttcactgggatttcattttatttattaaattggctaggatcataaacaatagtaaaactctgtgctaagcagcacaggaaaaaatggttgcttttgtaaattgctgatgggtctataaattagtatgatcttcttggtaggcatttggcaatatttgccagaaacttgaaaaatgtaggtatcctttgatttaaaaatttctcttctagttattcatctaataaaataaataagcatatcctgaaatattcatttacagacattcatcactgttctggctatggcagcaaagatggaaaacagcaaagtttccactaacagggaattgattaaaaacattattgtaatatcacacgatgaaaaaatcttcaatttttatagctatcattatcattataacacatgcaatttagaattatgtaatatatagtataattataatattgatatactatttataatatcgattaacattaaaaagttcataatatattgagtgaaatgggtaggtacacttacttatcagttacctgatagagtctacataatagatctgtcctagtcttcctaaaccaaatgctgagattatcaaacaagtatgtcttatttctgaaatcagaatgttttgttttctgttacatatcagaatattttataactgcatatttcatttgaacaaataaacttcacatgctaacttatggtaaggcaaaagctgtactactctttcctaaggaaataatcattaactagacttaaggcattaaataatgaatagtgattttataaaaccattctatttctaatgaaaatattaaaatattttcaggaaaaatgagatttctgaaagaaaattaaaaattttgcaaatgggagtcatgggatactacataatattgttttaaaatgctaaaccaaatcttgtcatataaatcagaaaaatatctgaagttgtatggaatgctcaaaacttttagtaaattataatttattttctgctagaaattaaagtcaagagatcctatttttacaaaaagtcataaaatacaaggaagaactttttataaccttaagaacaatgctaataataaagatattcaactggtgaaaaattctaaagaaccaacttttcatacatcagtaccctggtgaattgtaaatgtcactcaaataccacaaggtcagattcttagatcaattcctgcattaatacttcttgtataacctgccaaccttcaagtactatatactctagtcagcctggaatgttgtattataataacttaaaaattaaatatcaggatagtctattcttttcccaaagcttcaaagtgaggagcccaaaatgggaagactgattccttaagagagatttctccaaagatgagaaagatttgcctgagtcaaataggaagtcacttggtcaaacccatttattattacaatctaattatgttttacagctgctcatgagatgtctaggaaattacatttgcaactttagtcaaaggaccaatattaatgcttatttaataatcagttctttgggtatctctattattgagataaatatgattgagacatgataggaagtggtcatttctctcataaacttattctgaccttcaacgttggtgtataattgcacatttatacaaatgtatgtcatttataattgcacatatgtatgtagaacagtgaactttggctggtgggaaaattcagagtgaagattttgaagattttcttggtttcatgactaatcatccttatccacaagaacagagagtgctatatgcagcctttcggaaaatgcctgtcctttcagctacacaccacattaggacagaagctggaatccagcctgaattgacacaggactgggcaataggaagataaaacattctaactcttcgtttggttctcattagagctaacagtgaatccagatctagagacactgctattataacacaaaatttgcgagcaaatcacccaaaataaaaaaaaaatctatatacaatttttaaaacttctcttagatttagagtcctaaaacaattgttaattttgcagattcttcagattctcctgaatggaggtatcacatctccactcacttaaaaaaaaaaatctaaatccactgtgtccaaatatttaaatatggagcaagttttatgtataagtattactctactgatccctgctacatactacttcgactcactatagaaatggctaagaacaactaagaacttttttccagcatttacaggtggtccatcatttctctaaagaaaaaaaaaacactaaataaagatcttattaaaactcccatctcaattgcaagtaaaattaatattttaattgtaaattatgcatcctatcctctatgtttcatgcctataactgattaactttaaatggcttatggaaaaaggtttggatcctctgtcaatcaaccatatttgttgatgaaataattttatcatcataaattaagagcattttatccagtagttgaatgtgttacctagttattattcaactaataaacatggtaaaaagtatgctagatttttttaatttttacattcttttatatattggctgaacatacttactatgggctggatactatattagatactgtggagaatacaggtgaagctgacatggaccttggcctcatacagctcacagcctaatagtatgaattcactatgaaataccaaatgattagttccatttaatataatgaacacttaaagattatcattgtgccatacagtattctagacccaagaaataaaaagcaaacaagtcacaaattgataatattccacttggtttcaaacataagagagaacatctgtattgttgtggattcttatagaacatctctatttttatagattatttaagtatcatcactctaatatataattagatgtcagtagacctggactttgttatcttggcttcctgaaaaacaaaatactggattaaaaaaaatgttatgccatctatttttacaaaacttttagagatgaaaatgtctatttgaaaagattataccttttcttgcaggattatcttgtataaagaatcagtaaaataaatcccttctacactttagagccaaaaaacaatttcccacgttaactggacaatggaaactatacaatttaatgtgcacaaatttttatcttcttttaaagcccctgtggtcaaaatttcctttatattgctatgagcatagtggacattgaataaataggttagatgaataatgaacaccaaaccaaatatttcactttagacacactttcttgtgctcaagttgatacaaaattggttagtagctgataaggtttggctgtgtccctacccaaatcttatcttgaattgtagttcccataatccccatgtgttaagggaggaacctggtaggaggtaatcgaatcatgtgggtggttacccccatgctattgttctcatgatagtgagttctcacaagatctgatggttttaaacgggacttttccccctcttgctgggcacttcttgctgcaagaaggagaattgggcacgtctccttgcttctgtgaataaggacatgtttgcttccccttcccccatgattgtaagtttcctggggcttccccagccatgctgaactgtgagtcaattatacctctttcctttataaattacccagtctcaggtatgtctttattagcagcatgagaatagactaatacactagcagtttcttcgaaaatcttcacatttgaaaccattatctaacgataaccttcttctctttatgttaaacattctcaagtcatgtcctcacaaacacccatgtttaacaccttaaatcatctcacttattcttacatcatgcttctagtttctccagggccttttaaaagtgttaataacatgagatccaattagttattatctctcaaatgtcaacttctcctaataattctcaagagcatgttaactttttgtattacagtagaagcttacacttagactaaagtcaatctgtgattcctgaattttaactttgctttaaataaatgaagtgtagagtgaggtacatttcctttgggttggtcttgatacaggatgatattcagatcagaaatccccatgcttttggccacgtgtactgttgagtcaacaacatttttgttggtgccaagtcaatggcaggtgttatataggctacaaagagaagggattcaggaaccttcaagttgggtgagagggaaaggcattcactcatgcagcagtgagcgaataaaagaagggctagcccaggagtctagcatgtgacctttagagtataatgccttccattccaaagcctggcttttgcatttactagttgtatgaccttgaacaagctttttaaatacccaatatttccatttcttctttggtaaaataggaataagagtatcttcctcatagatttgatgattacacataaaataatgtatgtagagaggttaacaccacgcttttaagccttcagtagctgctatgtgtgcacgaatgcacgtgtgtatatactttgtgccaggtactctgctgggtacataaataactatgatgcaaggcagaatgaaagagagaaactgaagagcaagaataggacttgagaatgagccaaccatttcttgatatgtggggtgtgtgtgtgtgtgtgtgtgtgtgtgtttcttacctcagggccagaactaatttcagatgatgggaaattctgaccctataggtaaatgcaaaataaatttccttgttcaaggatgccgagagcaagaaaagtgccatccaagacatattacgtaaaaattaagtctcattctctgcattcctgtgcatgatttcctccttcccaaaacatgcaagcctgcctaggtaagatcaactctgagttataactcagtctatacagagattatcaccaagaaaaatcagcaagtataaaagatttttaataaattagaacctgtaaaactttatgagaagcaggtgtctgagtcccattttataaaccatgagcctaacagagttatatgaactactgtgaggttgttctgtctgtgagcaacgatgggaatgtaatcacatgccccacaaactggactatgataagcatccttttgttagggtaataccatttatacatttatttataattttatattcctccctttcatttcattctttgttgaaagcaaatgtattgcaactcattggcaggcaatttatttcagggcgaaaagtaatctaaatacaaaataataaaatatgtgaatgtgaaaaaaatcccaaagatataagcagatttattatacatagctggaaaatatctcgtatatgaagccattcataaagtgagttaacttctctgtgcagaagttctttgggaatatgcttgtacagagtaatttactttcagtgttagaaattacctggaaagaggtgaaaattactcattcaagtcaagaagtatttacatgccaccaaataactaaggtgaaataaaaccttataggagaaatagaagaacagaatgaaaaaaaagggaggggcagggtgagataaataaataaaaagctaaagaaaaagttaaaatccacccagtatttacacaatgattgaataataggacaacttttatcttgacttcatttaaatgttttcagtaggaaagcttgacaaaagtgacattcagtcattagtaatattgctaaaaaagtgaaattcagtcatcagtaatgactgaaagtggcattcagtcattagtaatatgtcattagtaatattgctgtataaactagaaattgttcttttgaatctttaaatggtgaaaacagtcaatagtgttttcttttttaaattgttgcttcttgatagaatcacagtttctcttttattgcatcatttaatctcaatgccaagttttgaaggtggtgccaaagttcactatctgtctgggtagcagatgaccaaaacgcccctccacagtaagggtgcgtgagtactctggttccagcgtatgctccacacatcccaccactgcagggcgcatccaggtgtgctgtcatggtcagtttgaatgcctttatcagtgactgtgccatgccacatatataaagatggaaagtcaagtccatgacctccaggaatacatattctgactttgcactgataacctcatttagtccacaaaacacagatatgacgtagttaatgttattattcctgtttcagaaacgaggaaactggctaaaatactttatgtgactttcagcagggtcacacacctaaaaagtgatggcactcgactcaaacattgcagtgatatatgtccacttggctaggttatatgtccacttggctaggttacagcctgcagttattcaatcaaacactaatctaggtattgacgtgaaggtattttgtaaatgttattaaaatccataatcacttgactttaaataaaggagattgtgctacataatctgggtggaaaggccttaaagcataactgaggcgtctctgaaaaagaataaattctgcctgtggacagcatcttcaaccttgcctgagagtttcaggatgcccttcctaatggtctcccctgcagatttcagatttacctagtcagccctcacaatcaaatcaggcttttgcttgcaagaagtctcttattatgtatctcctactggctctactttctggttgaactccgactgaggcaattactcctgtcctcttacgtggtaaagggttgtggttattctagtcagttcatcgggctctactcaagaaacacacagggtctggaagcaatataaaacttagcaccaactgggacttcctacaagctttctaacgaaaaacaattttaaaaattacaagacataaatatgtggatttttaataaagaccctcttagtcatctttacatacttaataggtgcttgacaaacgcctaacaagtgaatgaatgagggaatgaatgactaacttggtttggctggagtcctcttgtgctttatctctcagattcatcactgcaatgatcgggacgcacagcatagaaatatatacatatatatatttatttaattcctccaaactctatgagatgtcatgccagagattatcaattctgagatgcattcatttcctcattttaatatttctgaaatagagatgcattgtacaaaacatagaatatcataacttatttggcattggtttgcctttcttggtagttcataaaatgaaggtatactttatgattgacagcattttattttaattgaaatatagtattatcaccatgttcatttttcagatgagttcttcaggcacaaaggctaagtacctttcccaaggtcacaaaattagtaaatggcaagtcagggtttgaacccaggctgtctggcactaaagcaggagtttccgcaaattggcaccattaacattttggactagataactctttgttgtgggggctgtcccatgcagtgtagcatgtttaacaatatccctggtctctacccacgagatgccagtagcatccacccccaagttgtgacaactaaaaatgtttccagactctgccaaatgcctcctgggaggtcaaatctctcctaattgagaaccactattctagggtatgtttaatcactatgcaatatatatttttccctaaaaatggaaacacgcccagggtgacttctactgcagccagaagcaagttgggtccaccccagaaagcaggaatacttttccctgaagatggtccttttccccaatttcttccttgactcttactcttctcttactgccctctcctctttttcaactttgcacagttcttcaggcagtattctttccaactgcttgccaggtcccacatctgttcattttgttggcacttaatttgggactgctctggaggtgctgacagcattagtactcctgttcctccaactgctgaacaatcttaattgagctgtccctgtctccttggtgctgtcttgtaccagctccaccccatactccagaagacgggtgacaggcactatctacttgctccagctttgaccaaataaagaaaccaagaagagacttttcaaaagctagtagcacagtgaaactcaggaaactaatgaacatgatttgactgtaataggttcttattcaagaatacatctgttctcacgagcctgtaagttaagaggccatgtatgtggtggatgagtccatggcctctaaagccaaatggcctgggtttcaatcccagctctgcctgcttctcagtaactgtgtgagcttgagctactcaatttttctctgcctcagtttcctcctctgtcaagggggaaaatagcagctttatctaatgtagttggtgtgaggagtaagtttataatgcatttaagagggcctggcccacgtaaacaccagaagagtgtttgcaattattagtggctcaacttcaaaacaattgtggtgcacttttggcttaattcgataggctggatttgaatttttaggttcattttttaaaacggaatactcatgttgaaatactgaacctaaaactagcaaaaatatgtaagtcaattgcttacatatattcagaacaggatatcattttagatttagtttatacacacacatacatgcaaactagtaaattccagtgatggtaaaattattagtgttttaacaacaatcactcctgactatctgatatactatatgatggtacatattggttattataacatatagctatagatataaaacaatgatctcaaatcctgaagttctatctgaatcaacaaaattaaataataactaggatgttttaatattaatattaatatgcttgattagattttaatcctttgaaaattgagagaggcctatatgatatttgtggtgctacttgtggcctttctacctgatgtgtaacttccaggaaaaggacaatctgaaggggctcagtactgaagtaacctctgagcttttcctacacggcccctcctcacatttactacagcattctgtattagccaccaaaactgagcaaacctcattccgttagctagtctccaaagaaggtagcacctgttactaatccccctgctaatctccccagcacaccctggatcttcacttctgcccatcacatgagatgtgcagcctgggaggcttccctttgggtccctctagaattagaagtcattcccatttactataagccaggtgtgcatcatttcactgaaaactgtcaccaccatcctatgagccagatgctttcattatgtccattttacaaatggaaaaactgaggctgagagaaggtaaataaatttcccccaagtcagttagaaaatctgtgcaaataccctattgcctgtatctcaaccagccactgagattccttgtttacttctttgaaagtgtgctgcctgttgtccatacctcctaaggaagcaaaattgagttcactctcccattgcccattggagaatcaccaccccatagctttctatccaaagcattacaggagctttcatattctctgttgtgctgcttcaggcaggtggtattttcagtgtgttaattttttaaatcataagttaaatccattggttcgagggcaaaaagggttactctacagaggcagaagtgatgttaacagaccaaattatatatatgtacaggtcaccatgatcagtaaggaggagaaaagtcaatgaaacctattagttctgaaacaatagataagaagagagaattctacttcaaatcaagttaaccttacaatctcacagttttattgtcatatagttattaccataaatattcagaatattttgacttaacatacagatgtcttttcatttgctcaaaaccatgcttctgaaatgagattgactttgggagaggaagtactatttttatatcatggtgtattaaaacatagataaaaggccgggtgtggtggctcatgcctataatcccagtactttgggaggccgagacaggtggaatccttgagcccaggtgtttgagatcagcctggacaccaaggtgaaatcccacctatagaaaaaatacaaaaaatgagccaggtgtggtggtgcacagctgtagtcctaactacttcagaggctgaggtgggaggatcacctgagccagggaggttgacgctgcagtgagctatgatcatgccactgcactctagcctgggtgacaaagtgagaccttgtctcaaaaaatatatatatataaaataaaaaattattttggcttgtggcatggggaattagttccctgtaattcagcaagatgcatccaagagggctgttttctttaaaaaagacaacagagttagctggctagaaattatttggaaaatagattttttttttggacacagaaatgtatttcaaagacaataaatgaagattattttatttcatatattagtactcaatgtttgcccacatagttgaactaatttttgtcttcttgaccttaaatgtctggctagaccaagcactttttcatattttaacctatagtaatatttcatattttaacctgtagttttggtgatcaagagacactagagctcagaaacagatgtcttccaagctctgttgattcaccatatcagtctgaggactccagcatcctgaacctcagcttgcatccctgaaatggagtggtggtacaggttcattatcatcacaaagaaaggatgctagcctttaaggctacactttcttccatgttatttacaactcaaagggcctgtttcaagttccattttagctccctgtgtagtacactgccaagcacatgaattttcaatgaaaatgttggaatgaaatttcagcatttcttaacagagaagtaatcaccaagatacgagttaatgctttacggaggttatgtctggctccattctattacagaatgaatcaaggtgaaaaaaaaaacataaataatgaattgtgtcctatttgggtcatgtaggaagggaggttattggtagcaatcaacactgggtcagaaagacaaagccagaacctggagccagaagggcaggcagcaggtgtgaaattagagatgtgatgatggaaaaacttagaaacagcagacaaaagacacaaaaatctgaataagacaagtggtggggtgatttcatcatttaaggcaactcaagtgatcaagtctgagagctgtggtctgggactaagacaagagcagtctagagaaatttaaagagatgctgtgtcatcccctttgaaggaccaagtgcaaacttatatttgtccttaaacagagttctccaatcccagcctcacaaaaccggttcagctatagctactgaacggcatctgtgtgctggctttccatctctgctcttgagcacaaagaacaaagtttttcaaaaggaacttgcacagtccacttcataaatctcccttcagcttgctaccttccgcccacatctcagggttgtatgccagctagatctacagcagttatatttttaaaccagcaattatcctcattcctgctcactgacatgccatacagttaatctggtttaggtccaaggtaaaaaaagggaaaatatataaattcacataaacataattcacattggctcaaaattactcaaatggttttcaagcaactccaatctgaattacaggtcagtttcaaagtcaattttatatcaaacatgcatcaattacaaaatttttccaaaacaactgtaaaagaagtcaaagtccaagatcttaattaaaatatagtttactttagagaaggtaaagattatcatgggaaaactctatcacatcaagacaaatataatagcttgaattacatgtataaaattaacagactggaagggaaagctttatgacaagaagttccgagaagaacttagtgattctacatccaactttattcatctatatccaaatgttaacatataccttgatttttctctttgttaattaaatatgaatgcttaccccagctataataagaggaatctagtgaaagcaaatagcagacctaacataatccctttccctttagctatagtcaactcactctaagtgtttccaaggcaaggatatgtagattaggtaaattgattccttttttcctattatcagttgtcttcttcagttatcacaaaggttgaacattaagctaccaaatatataagacattgcctcaagaacaacttgggtaaaagatacccatgccacacagacaattataacatgattatcttgaattttttcttctattttaaatgctgccttgtaccatttataatagcaaaaattgctgtccaattaaaaagtgtttggaagagaagactccagtttaattatgaagggcatcattactataaagcaatgacagggtatgctcaggaatgaatccattatcacagaaggaccacttatgcgacaatgatgttttctcatctgcccccaatatctccatttcgtctagttcctcctacttatcctcaccacaaggtaaggtatctgaaagtgctgaacacaccgcctgatgtaaagcaggtatgcaatgatattcattcatttatttcaaatattcactcatcccatcatccctctggaaccaatccatttgctacccaggatagaatttaaggtactttaagtatctaatcgcaagtaagccttactgctgtccactctggtctgtgggccatgagtctgtatcctttaataaattcctgcttcacacagtaagaactgtgctttcctatcccaatctctgcctaatagcccaacctaaatgcgttccagcagccccagccccatgcctggcctccagtatttccaacactcaaggctcagcttatgcatcacagtccttcaacctgggtcttgtcaagatgtggctgtatcttcctaaaaatccctgcctagccaggagggtggcagcctgccaccaaataacctcactgtgaaaatctgcccaaatgccagtgttaatattgacaaaattggcctagactgatgctacttaagcatttttctgtattaatgatatatgcatgtactttgtatttcactgaatccagagaatttttatctgggtttagttagccttaaacagctacactaacttctctgtgtcttggttttctaacccgtgaaaggcaataatattaggatccaccacagaggttactgtgataatttttatatattagcaacttagagaactgtctggtagataacacatgcttatgtaaatgttattgtttgtatttgtgggggaaaaggaaagattaacaagaggaaagcatacacatttatttaacataagttttatgtgacatgagggcctttgaaaatgaaaacccaaagatacaagtagacttgtatttttttatgattaggtttgacgaagaatgaacagttgtgcagaagtatattgggggacaaaaaggtatgatctaatagtaataaacggggaaaacttagcaaggcctgtctgttcagattttctctgtgctccatgtcttcagagataaggaagttactttctgccaggtatggggggggcacctctcaaatgagggtctcatgacctgcctcagaggagaagtgtgagggaaagccagagagcaaccttcctatgtttgccattttctcaaatgccaaggtaccagatttgggggggtatcatgtactgaaccttgttatattattaatactattactattgacttcctctagtgagtaagctaccagatgcatgaagataaaaactgtctgtttcattcttaaaacccctcaaacctacatggtgatttgcacatctcaggctgtaagtgattgtcaaataaaattgaattactgagtactttaaaaagatatctggaaatatcatgataactatgatatagctgtagaaagtaagaccacagaaaccaaactgtcttcttaagaacagaaaatcactaaaagagccaggaatgcaagtcagtcataagcccatgctgctggttcatggacaatcttcatatgacaccattttcctggtgtgagaacagatgcatttattctgaccttacgtcatgcaaatttacttatccctgggcaaggacaggttacggggtagctttggcattgctcattcattcctgtatttatcaggtaaccctgcaccaggtcctgctttaggtgtcaggagactacagtaaatcaaacaaaccgcattggctcaaaaactgacatttgggagagctagacaaaacaaaatactagtttatattaaattatgataagtgtgaagcataatattgaggggctgctccatcagatcacctatcatgacagtatcagttcctggcacatttattggcacccctttctggaggcaatggactggaggtccccaccacttggtcaatgaagtgaaatgtatggatttgatgctgagaggggtttgacattgctattcttctatcaatcctggtgtaaaaaatatacactgtattccatagcccatctagggaagaatcctactaccaggcatggacagaaacttaagtggctcaagaagacccagcagctcaaaatgaggcagtacccctggatgggaaaggtatacctcctatccagccacaggtagagagacacccgcctataggtaaatggtcccaatcctgactccatcccaaatatcaccacaagataaacagagttaattacggtagggttaaatttcttttcgcagatagaagataggttacattagatgatgtgctctaaattcccagagattattttacaggaaaagaaaatttttacagctatcaacttcactttaaggttttcgagggcccttcaagattttatgtcctctcacaaatgccacaagcacaaataaatattgctctttaaaacaaattaatgtcaacctgagtataaatgagtcagacctatgagtctccaagcattatgtttcattaccctgccaaaaccaagcctttctagactagtcttaaggctctggttctgtgaataggcctgctgaagaaatatttcacctaataacatcaactgtcttaagattcactttggataaattgctttttcttatagcaactgaatgaaaaaaaaaactgaactaacaagagaaacacgaaaaaccacagaatcaatcaataatgcttccctgtccccaattattacattaaactgcattaagagcctggccagctattggtccatgcttcataatccttcatgtttcttccaaataatcacactcttcaaagtaagatattcctatataatcatgatgcttgatcaacttgccttatcaaatgacttgcaaaaaatatctatacctctgctctgggaaagcccctgtgagaaataacatattgaatagtttagattcaaatcactgccctgatttaagccctatggaaaaaataacactagagtaaataatattgagtgctacccacaaccccatatatcaaagactgtcaaggacatttagtattgaaggccattccagtactaagccccaggagatttacaagaggtcggggtgattaggtctccttaattagaatgtaaatttatttattgatttattgtatcagacagatcaattagtagctaccaatttttttaacatgttcattttctatttcaatgatagatatcaattaaatattaatcagaatctcccacctcacctgtagtttcaatgttctgagctcaagttaagcatgacagggacattctatgttccaattttattccatcctggcttcaaagttttggaaacagaatacctcacactacacgaataaaatttgcaacaaactgctaactgaggcaaaatagtattcatttgtgtgtaggtatatgtcacgcatgtaccctcaggccagctctgtaaccccacgaagacccaagtgatttctccttcatcccagagcaaagagggagaaagagctgcttagctgtgcacgttgaggaggtgatctggaaatctgcttgttcctctgaagactatgaaccattcgttcagagcttcctcaggcctccagctcctgagtctttctgctgttctgcagcacaaatgagcttccctcttgctgcattccttctctgtaggctttctgcttttatagtctgctaagtcagttactagtccatatcatttccagctttcaattttttgttgacatctattttcttctgtcatttctgcttcccttttgttcttgtgcatttataccttcgtcattgccttgctgtcacataaaacggtttcatgaaagagtagaggaaaatccatgtatttaatctgccctgcgtagccagaagcctctactatactatgtgataccactccactccaagctaaatctatctgagccaagatggctaagttccctggtgggacagactaatgtaaaacaaactgaatggcattgcttttcttctttcctgtttcttcattgccatggatcaggttacgtgcaaataataataataatcagcaatgctataaataaatcatattaaggcagggcttacagataaatcccaaagttcaaatgtaagtatcttgccaattgtttactaacttgtcaagatattaaaaatagaaaactaacactcaagacaacagaaatagttgagccatggtgccagggcataacccaagaactcggactagacagtacaagcatatcaaataaatatttagcttaggtatcagagcactgtcattaagagcacagggccaggaaccaggctgcctgggttcaaataccacctctgccactgacgagatgcataactttagacaagttacttaacctcgatgtgtctcagttactgtatctgaaaatgggagtgataataataagaaagcctcatatggtggtatgaggagtaaacaaattaaaacttgttaagtacttagaataccctctgacacatagtaactactacacaagtattgagaaaggtagttgaggaaatgaataagtgaaaataatatggattcttctggtcaagagagaaaaaaaagaccctaacctcaagccaccattttaaactagaacttaacctgtattacccttaaaaaaacgagggcaaaccaacacgtaaaaagaaaccaaaaaagcaagatcttcacttttgagcttccaggaaatcaggcctcaagatttataaacactgtgtcttaatgggaatttttcagctgcaccaggctttaccttaaatgcttgcctaggggaaaatccagtccacctgttagaggctggccctgcaagggtaagtgttgaaaccccaggttgcttggtgacatctgggcatccacgcctgtggtgctcccaacctaccctccacttggcaggtgtaggttgcgttttctggctcctctgagcagcctcattgcctgggagccaggctgtgctgcactctccctgcctgtcttaaggaagattcctgtgaagcccctaaatctgcactcatgctcatcctctccactattcctctttccttttctacccctatttcttaggtggaatctgcctgaaaagcccaaagcctgacctggagatcaaccaatcttctgggcatccattcagacaagggctagggttggcagcctgtgggctcaacgtcctacccatacactgagtccctgcttccctttaactccctggtactagtactgtctcctgtttgctaccagtataccataggacaggagtcaatcctaaccatctggacacacagatatctccaggatgctccccaaaagtttccttgacatcttgtctctttttcccctccccctaaatctacactattctggacatccattctgctcctgtctctccagcaaagccaccctcctcagaaccagctgctccctgcaacctccaatccctgggcagaggagacatatgctcttcatggggtgaggttggggtggcctggggagaactctcctgagatagtaaaagacagaaaaagccaaaggagactgatctcagggtatagccaccttgttaagtcttttttttatcaccatttttattaagaaatattttacacatataatatgaagatctatggagttgtaaaaaataataaaattatcacatgttcctacaagccagcttaagaaataggatacacaaataattaattaaaagatcctttcccaattgtatactcccctggctccctcgaagttgatcactgtccttgattagctcttattgagcccaacgtgaggaaaacagcatggcctctccagaaaatgtggtatgactattttctgattccagctattcatcctattttcctttacatcctgtccaccagaaaactcgtagtcaagtctccatcctaacagtttaacccttctaatatgcctgatttcttaccaccattcattctattaacccttatgtgcatgtatatccatgactgagttttcagtagaagagggaatcactcaaggaatcaaagccattcagaaatgctccctcaaagcctaaagcaaactcaggctactgaaaaatcaatgtccaaatgataaggtaggttgactctcatctggcacctactctaacccttgtctggtgcatctttaggatggcacaggctagaaaacataaagtacactttctatccattcttgaaactagagttctagatgtgacttagtttcctccaagcagtcattattgcataatacttgaattcaaaactgagttaagaggagatagaacaggtctcatgcagattgtttgggagtgagagagatgggcatgaacacagcggacactgtgcattcttgtagttagcgattctgaaaggagtttctagtctgtagagagtaagtaaatgatgcgatcctaaggtcagaagttgggacactggctccccaatttctcaccttccaggatgcggcagggggagacattcccttaatggtcagttctatatggtgttatttcaggattcattcctggaaaccaagtcaagaaccttctcctccagttcttccagtgattttgtaaacatttaactcctcatatcaaatcatctcctgctgaaaataaccaaagggtttactgctgttggcaatttaattctggctaatatgtggaatagagagagagaagttgacagagtaaagcttgataataaaaaaacaccagctcatgcttttatcaagaaaataaggcataaccagatatctatttttaaataaaattgcttacttttaattttatataatgcttttactgttattaataactttttttagcatggccatgttatcaattatcaataataataaaacataattatttgcagaacattgatgttgtatcaagcactacataagtattttatacacttagctcatttaagctttacaagtctatgagatacgtatttgtatccattctataggtgagaaaattagagttaagagaggttaattagtaattttccaaggtcaaacagctgataggtggtagagataaaatccgaaacctgtcagcctccaaaactcacctcttaaactctttattatactatctctgtaagcttatgaaattcacggcatgaagaatgaaaaaggagtctgccttgataatatccgactcttctttaagtatcctcttgtgtgatatccttggcccctcttacaaattcttcagattgttttgtgtagactctatttaacaatcttcaggaaatactttggaaacactaatggaattgaactgttaaaatataaaatctcattgcccctagcaagaattctctctaaaattagagccaggttttgcttataatttaacagtcttttccccatcatttgcatagtgatagagcttttatagttttaattctgaatttatattccagaaatgtcaatctggaggctgtaatcctactaacttttctgcatgcctatttttctgaatatgtataaatgtttattttctttaagcagcacatttcagaggtaaaatgtatttggaagactttaatctatgcacaagccatcattaaacttccctggcatatctttctcttacagttaaccaaattacatttgggtatttgaagcaaatgaggatataacaaagtgatttgggtggacaaaatgtatgaactgcatcctgtttatgcaacatttttacaattgtataagctgacagctatgcttagagaaacagtggaagaaacaaaatcgttcactcagtggtttataagaaaaagaaaaaaatgtcaattttcaagataaaagtgtggagtcaagaatgagttttattttttttaaaaattctcattacaaagtccttgaaagaatgtcaagaacaacacagtttatgactattgggaaagtggatctcctcttagaattggaagcctctatcctttctttctgcgtctctctatataaagatgtttctgtcagcttgggtgcattttcatcaaatttggagtatgcatttgggaagctaggactaaacatagagcagtgacatatgttgaatcaacttgggcagggagagctggggggactccgagtggctgatgctgaaacactgcagggaggcctctaaccagagaaaacatacagaggtcttcattgagggctccagaatcaatcattccaatggcagatactctaaactgctcttctgattttggactgagttgcttctcacctggaccacacaacataactcagatgcactgattttcaaccccagctgcatgttagaatcacttggagaacttttaaagactgtgggtgcccaggtcccagccagactagatcaactggaacctgggggtgggaggtgggaggaggacaggacaagtggccccaagacacctgcatttttaaaagctccccaggtgagtctaaggtatagccagagttgaaaaccactggttcagggtgaatagcagctggaatttatataatcatggttaatgattctcttatgagtaacatggaggaggccagctagtattatacaaagttaaaatgacattttgcttaggaataattggaaatattttttgtcaagtgtttatgtctgtgtctgacaacacacttacaagaaagcttagacactgaaaagttagaagcctatgggagctcagaagtgagatttgggttgtgcaccgtggctcatgcctataatcccatgttggagaggcagacatgggaggattgcctgagcccaggagtttgagaccaccctgggcaacaaagtgagacctgatttctaaattaaataataataataaatttttaacataataaaagaagtgggatttgctctcagcagagccaagctcagctatatccaagtcctctgcttatacaaagatatcctctagacataggtgttataatttctacttcctaagatgaactttttttctattcagcttttttctattcaagatctcattcctgtgtagctctggtttgaaaccaatagaaacttgagttttaaaatcctgatgtgaggtttctatcattttggctagcactgttcatttagagtaacttaacttcagtagaggaggataaattaggatctcccaaaaaactttaaagggacctgctctttttttaagagtttttcctaagcatcctgtatggatttccttcattctctttaagactgaatggaattttactgtatatatgatctagtgtcttccctcatacctcacacaggacagacaatcaatatttgttgacttaacaaattaaatatttaactattctcccaaatgatgggtaggggcatctggttgacaataacagacatattcaaggaaataatttgtagcaaagctgagtagaagattcctctgagctgacaagcatttcccatgtctcccatgcaatcagctttgaattccaacttcagggacagaaggcacttgcttgttgccttataggcatcatgactggcacaaataaatctcttccttgcagcattttagacaagtgtgatcaaccaatcaatgaaagctacaggcacctcgaaagagccttttctttccaatgtcatttcctccagcagctgctccttccttttgggaacccccgagtttatatataagcagggttcagaaggaagacaacgttttactcgatgcctctctcattcaagtaaatgggcactggcccatgctctgttctgctgctggaaccaactggagagtccaaagcatcacatttttcccagagggaaaactgatggaaaaaaaagatggaacttcaatgttcaatcaatcccaaccaatcaagaagctttcaatgctgcttcatttacataaaagtagagctaacagccaaaaagcagtctttaattcaggtatcaatgtataattctcaaatatatggctcaatctcaaatatatggctcaacctgccagagttatagaaatgacctggtagaaaatgtattcctatccttgaaggagctaaaagtagacatttctgtgtgtgtgtgtgtgtgtgtgtgtgtgtgtgtgtgtgtgtgtgtgtgtgtgcatgcgcatgagtgtgtgtgagagagagatgagagagacagattcatcactatcaagataagagctgaagaatttctttaaacagagcccccactgttaagtggactccaaaggataaaggtttctctcactgacttgaacctcattattaattatatttattattagttcctttccttgaatatgtctgttatcatcagccagatgcccctacccatcagtggggagaatagttaaatatttaatttgttaagtcaacaaatattgattgtctgtcatatgtgaggcactagggaagacagtggttcacacatacaataaagttccattcagtctttaaagagaatgaaggaaattgatacaggatgcttaggaaaaactcttaaaaaaaagaaaagatgtccaatgtgtatagtatcttgcatttgtgttttaaaaagtatttacatttatatttatatgttcacataattacatcgaaatcttttggtgctatacacaagaaaccactgacaaactctgaagactagggtgtctctagggtggaagggagacaatttgcatcataatgtttgccattttttacatgtacatttgttattttaataaaaaataaaatgtctaagtcatgagcagtattttctagagtagaaagattatttacactgagaatgaagagtgatttcaaagaatcatgaattttcctaattttccccaattttaaatcttaaaactatgaattttccaataaaattagtattcataaaataattaggggtttggcaaatatgcaagttgtgtctgtcagcatagtccactcaccccgatttccatgtatgcatatgtgcacactccatgtcccgtttttaatccctttctcttcctgcccaccccaacccagccccacacaatctcaaacagtctatgctgtaggacacaggtatacctgtgatcatacattacagtttgtaaacagaatattatgctttatattcacaatggatggataggatatattctatttaccctacacacgtctgtacatacacacacacacacacaattatacacacacgcatattgcctggtattcatgtatttttcaactgtgtgtcctgaaacgatttttctttttcagtgagtcattcattggcctgtgaaataaaatgttttcctactcagagatttgtaatgccaatgttcaaacctacatagtgtactgtcatgagaattaaataaactgaagcatgtgacagttcctcacccagatcctagcacaaagcagtcactcaataaatgtttgtggaatataagtgcattaaatatgtgttgaatgtgaacgcaaacctatgaatattttagcaaataacctctaacagatagaaccatgttagaaaactaccagttggatggccaaataggaacagctccggtctgcagctcccagcaagaccaaggcagaaggtgggtgattcctgcatttccagctgaggtacctggcttatctcaccgggactggttagacagcgggtgcagcccatagtgggccagcagaagcagggtggggcatcgcctcacctgggaaagtgcaaggagtcagggaactccctcctctagccaagggaagctgctagggactgtgctgtgagggactgtgctctccagcccagatgctatgcttttcccatggcttttgcaacggcagaccaggagattcctggtctcatgtgcctacaccaccaggaccctggatttcaagcacaaaactatgtggtcatttgggcagacaccaagctagctgcaggagtttttttgttttgttttgttttgttttgtaccccagtggcgcctagaacaccagcaagacagaaccgttcactcccctggaaagggggttgaagctagggagccaagtgttctcactcagtgggttccacttccatgaagcccagcaagctaagaaccagtggcttgaaattctcactgccagcacagcaatctgaagttgacctgggacgattgagcttggtgtggggaggtgcatctgccattactgagacctgagtaggtggttaaacccctcacagtgttaactctgactgtgtggaactcaccgcagtgtggcaaaggtcctggggctggactgcctctctaaatcctactcacttggcaggacatctctgaaagaaaggcggcagcctcagtcaggggcttatagataaaactcccatctccctgggacagagcacttgggggtaggggcagttgtgggtgcggcttttagtggacttaatgttcctgcctgccggctctgaagagagcagtggatttaccagcacagccctagagctctgctaagggacagactgcctcctcaagtgggtccctgacacccatgcctcctgactgggagatacctcccagcaggggtcaacagacacctcatacaggaaagctccagctggtatcagacaggtgtccctctgggacaaagcttccagaggaagaagcaggcagcaatctttgcttttctgcagcctccgctggtgatacccaggcaaacagggtctggagtggacctccagcaaactccagcagacctgcagaagagagtcctgttagaactaacaaacagaaagcaataacatcaacatccacaaaaaggacacccacagaaaaaccccatccaaaggccatcagcatcaaagatcaaaggtatataaatccacgaagatgaggaaaaaccagtgcaaaaatgctgaaaattccaaaaaccagaatacctcatctcctccaaatgattgcaattcctctccaacaagggcacacaactggatggagaatgagtttgacgaattaacagaagtaggcttcagaaggtgggtaataacaagctccactgagctaaaggagcatgttctaacccaatgcaaggaagctaagaaccttgataaaaggttacaggaactgctaactagaataaccagtttagggaagaacataaatgacctgatggagctgaaaaacacagcacgagaacttcatgaagcatacacaatatcaatggctgaattgatcaagcggaagaaaggatatcagagattgaatatcaacttaatgaaatgaagagtgaagacaagattagagaaaaaagaatgaaaaggaacaaataaagcctccaagaaatatgggactatgtgaaaagaccaaagctatgattgtacctgaaagtgacagggagaatggaaccaagttggaaaacacactttaggatgttatccaggagaatttccccaacctagcaagacagccaaacattcaacttcaggaaatacagagaacaccactaagatactccttaagaagagtaaccccaagaaacataaccatcagattctccaaggttgaaacaaaggaaaaaatgttaagggcagccagacagaaaggtcaggttacttacaaagggatgcccatctaactaacagtggatctctcagaagaaaccctacaacccagaagagagtgggggccaatattcaacattcttaaagaaaagaattttcaacccagaattttatatccagccaaaaactaagcttcataagcaaaggagaaataaaatcctttacagacaagcaaatgctaagggattttatcaccaccagcctgcctcacaagagctcctgaaggaagcactaaatatggaaaggaaaaactggtaccagccactgcaaaaacataccaaattataaagaccaatgacactatgaagaaactgcatcaactaatgtgcaaaatgatcagctagcatcatgatgacaggatcaaattcacacacaacaatattaaccttaaatgtaaatgggctaaataccccaattaagagacacagactggcaaattggataaagagtcaagacccattggtgtgctgtattcaggagacccatctcatgtgcaaagacacatataggctcaaaataaagggatggaggaatatttaccaagcaaatggaaagcaaaaaaaaaaagcaggggttgcaatcctagtctctgataaaacagactttaaaccaacaaggatcaaaaaagacaaaaaagggcattacataatggtaaagggatcaatgcaacaagaagagctaactatcctaaatatatatgcacctaatacaggagctcccagattcataaagcaagttcttagagacctacaaagagacttagactcccacacaataatagtgggagactttaacaccccactgtcaatatcagacagatcgatgagacagaaaattaacaaggatattcaggacttgaactcagctctggaccaagcagacctaatagacatctacaaaactctccaccacaaatcaacagaatatacattcttcttagcaccacatagcaattatcctaaaatcgaccatatatttggaagtaaaacactcctcagcaaatgcaaaagaatggaaaacataacagtctctcagacaacagtgcaatcaaattagaactcaggattaagaaactcactcaaaaccacacaactacatggaaatggaacaaacctgctcctgaataactactgagtaaataacgaaattaaggcagaaataaataagttctttgaaaccaatgagaaccaagacacaacgtatcagaatctctggcacacggctaaagcaatgtttagaggaaaatttatagcactaaatgcccacaacagaaagtgggaaagatttaatatcacaattaaaagaactagagaagcaagagcaaacaaattcaaaagctagcagaagacaaaaataactaagatcagagcagaactgaaggagacacagacatgaaaaactcttccaaaaatcaaggaatccaggagctgtttttttgaaaagattaacaaaatagaccactagccagactaataaagaagagagaagaatcaaatagacacaataaaaaatgataaaggggatatcaccactgatcccacagaaatacaaactaccattagagaatactataaacacctctacacaaatcaactagaaaaatctagaagaaatggataaattcctggacacatacaccctcccaggactaaaacaggaggaagtccctgaatagaccaataacaagttctgaaattgaggcagtaattaatagactaccaaccaaaaagaagtccaggaccagatgaattcacagccaaattccaccagaggtacaaagaggagctggtattattccttctgaaactattccaaacaatagaaaaagagggactcctccctaactcattttataaggccagcatcatcctgataccaaaacctggcagagacacaacaaaaaatgaaaatttcaggccaatatttctgatgaacattgatgcaaaaatcctcaataaaatactggcaaactgaaaccagcagcatatcaaaaagcttatccaggccaggcgtggtggctcacgcctgtaatcccagcaccttggaaggccaaggcaggcggatcacgaggtcaggagatcgagaccatcctggctaacacagtgaaacctcatctctactaaaaatacaaaataataataataatagccaggcatggtggtacacacctgtagtcccagctacttgggaggctgaggcaggagaatcacttgaacctgggaggcggaggctgtagtgagccgagatcatgccactgcagtccagcctgggcaacagagcaagactctgtctcaaaaaaaaaaaaaaaaaaaaaaaaaaaagcttatccaccactatcaagttggcttcatccctgggatggaaggcttgttcaacatatgaaaatcaataaacgtaatccatcacataaacagaaccaatgacaataaaccacatgattatctcaatagacgcagaaaaggccttcagtaaaattcaacatcccttcatgctaaaagcactcaacaaactaggtattgatggaatgtatctcaaaataataagagttatttatgacaaagccatagccgatatcatactgactgggtaaaagctggaagcattccctttgaaaactggcacaagacaaggatgccctctctcaccactccttttcaacatagtattggaaggtctggtcagggcaatcaagcaagagaaagaaagaaagtgtattcaaataggaagacagaaggtcaaattgtctctgtttgcagatgacatgattgtatatttagaaaactgcattgtctcagcccaaaaactccttaagctgataagccacttcagcaaagtctcaggaaacaacatcaatgtgcaaaaatcataagcaatcctatacaccaatagcagacaaacagagagccaaatcatgagtgaactcccattcacaattgctacaaagaaaataaaatacctaggaatacaacttacaaacgaagtgaaggacctcttcaaggagaactacaaaccactgttcaaggaaataagagagcacacaaacaaatggaaaaacattccatgctcatggataggaagaatcaatatcgtgaaaatggccatactgcccaaagtaatttatagattcaatgctattcccattaagctaacattgactttctccacagaaccaggaaaaaatactttaaatttcatatggaaccaaaagagagcccatatagccaagacaatccaaaggaaaatgaacaaacctgaaggcatcacactacctgacttcaaactatactacaaggctacagtaaccaaaacagatacatagaccaatggaacagaacggaggtctcacaaataacaccacacacctacaaccatctgatctttgagaaacctgacaaaaacaagctatggggaaaggattccctatttaataaatggtgctgggcaaactggctagtcatatgcagaaaactgaaactggaccccttcattacaccttatacaaaaattaactcaagatggattaaagactaaaatgtaaaacctaaaacaataaaaaccctagaagaaaacctaggcaataccattcaggacataggcatgggcaaagacttcatgactaaaacaacgaaagcaatggcaacagaagccaaaattgacaaataggatctaattaaactaaagagcttctgcacagcaaaagaaactatcatcagagtgaacagacaacctacagaatgggagaaaatttttgcaatctatccatctgacaaagatctaatatccagaatctacaaggaacttaaacaaatttacaagaaaaaagaaaacgaccccatcaaaaagtgggtgaaggatatgagcagacgtttctcaaaagaagacatttatgtggccaaaaaacatgaaaaaagctcaccatcagtggtcattagagaaatgaaaattaaaaccacaatgagataccatctcataccagttagaatggtgatcattaaaaagtcagcaaacaacagatgcgggtgaggatgtggagaaataggaatgcttttatactgttggtgggaatgtaaattagttcaaccagtgtggaagacagtgtggcaattcctcaaggatctagaatcagaaataccatttgatccagcaatcccattactgggtatatgcccaaaggattataagtcattctaccataaagacacatgcgcacatatgtttactgcagtgctattcacaatagcaaagacttggaaccaacctaaatgcccatcagtgatagactagataaagaaaatgtggcacatatacaccatggaatactatgcagccataaagaagaatgagttcatgttctttgcaaggacgtggatgaaactggaaaccatctttctcagcaaactaacacaggaacagaaaaccaaacaccacatgttcccactcataagtgggagttgaataatgagaatgaacgggcacagggaagggaacatcacacactgggatctgtcaggggttaaggggcaagcagagggaaagcattaggacaaatacctaatgcatacagggcttaaaacctagatgatgggttgatgggtgcagcaagccaccatggtacatgtatacctatgtaacaaacctgcatgttctgcacatgtaacccagaacttaaagtttaatttaaaaaaaaagaaaactactagatgtttttctctttaattagagaaaacaataaatatatcaatatgtcaatatagtattttcaattcattgcaacatgaccagggtaaacacctaagtatttatttctggaagtgatgctacagtaaacattgaaattgaagaataatgtctaatacaattttccagaatagaggagccttttgtttttcaacaccaattattgtattggaagaaactttctatttaaataacaggtttttacaccaaccacagctaatagggcccattgcataaacaagtgcattgtgtaacagttttaggatgacacttgatatacagtctggatactcgtccctgcccagctctcatgttgaattgtaatcctcagtattggaggtggggactggtgggaggtgtttgggtcatgggggcagataccttatgaatgacttgggccaaccccattggtgatagtgagctctcactctaagctcatgagagatctgttggtttaaaagtgtgtggcacctccccactgccttgctcatgcttctgccatgggacatgcaagctcccacttcttctgccttgaatgaaagttttctgaggcttcaccagaagctatgtttcccacacaacctgcagaaccatgagccaattaaacctcttttctttataaattacccagtctcaggtttttctttatagcaatgtgagaatggcctaatacacttaagaaaataataccctaaaaatgaatttcactttttcaaggcatttgaacatgcgctattccacttcatgcttttccacaattatatgaattcaagatggtatgaaaagaaacagggaattgtcttgaatagttaagtgcttcatccaagtctctgccaagagacttcatatccttgtaccttctggtggccacgattgctaagacaccatcaaatgaatgtaggactcctctcacttaagaatagcttttcagagtaagaaaagagatgctatatttgatgtacatctctgctctgataagtacactgattcaaaaaatgattcagttttttaaaatgtgcccactagaattcaaactttatgacatagctaaggttcttagccttagtttattaatgacatttttgttcataagtgtaattcagacaataacacgatattaatgtaatccttgtcattcattccagtggcaactttctctgtgtaacatgctttgcactgaaactagtttatgctcctggcacagcatctttaaagtagaaaatttattacataaacatttccagcaaattcaattagcaccaccaatacaaaaaaaaaaaaaatcacactagcttacgtgagttgatactggtctgatttatacggcaaaactgtctgactcttgcctcataatctaaaatttcatagtaggaacactgtaaagttatctgatttgtggtacgtttgaggaagggtaatctcctcttatgccatcattctcctaaatgcccagaaattttactcaaggtcagttggagcactgaatgctctgtgagtcactgatgctcaggcttgcctgccgttcttttataggatctctgtgggccagaaaatcatgaaaatatagttctacaaaaaaataaattcctccaacactgaattctctttccaatattacaatttcatggggagaaaatggaagaaaatgagtgattatgttccaatttcattttaaaactacagtgatagtgctacattgttaaactaatctcatttctagaacatacatgtaaggacaaaaatatcaagttaacaaattgtttttatcttataaccttccattatgacaaaagcaacaaaaactcgaatgccttctctagtaagagaacatggatagtgctagcgttgatacaggggtctatccattctaaaatgtcaagacacagaaatagtgaagagaaggcagcctgagtagatgaaaacgataaaaactttctcatattgacacaacattcctttgttcaactgaaatcagtgcttttgaaaacccacttggctgacagccctgagcctggggcattctccatttcctttacaaattaagtcagttatttcaactctgccccttgccccaggcctgcacttcccttttacagaacctccctcctattgacttcagggcacaagttcatccttctctaactcttgcttttcacactaaagttcatacacctgaaaggaaaacctataaataagctctcaggacaaataaaaatccatcaatgcgaaggtcagggagagctttcaatgatacaagcgcacattcattcaattattcattcattcatttgccagcacccactctgcagcaggcccaatgctaggcctggagacacgcataataataaaataagactcagtcccttgtctcagaggtgtttacaatccggtcagcgtaactaacataaattaaagttaggatgcatgtgctaagagtagtataaataaaatgctatgggggaccgaagaatgacccttgcactaaagtctctttgcctctgggtcctcttatttatcagggtctaacgtcaccaagcagcagctgaaaggaaaggaagacaatgctagcagtagcagcagcctcagcagtgctcctgacactgagtgggaactggggaggggtggagctcacaagacttattacccagcttcttacattttgataaagggaggaaacttccctccacttcccacaggggaacataggagggaatgccgtctgtaagatattcacagcaacctctatcaaagtttcagccatttcccacttttactccaaaagtgaccatattctgcaatccaaaaattgggacatgggatctgacaaataagtttttttccaatcaaaaagtatatttttataaagatctaaagacggaatcacacatggctatatactcaacatttgttgagtcattattaagcagggaatggtccataaaacctatcatgtgggttgggatagacagtaacatgtatccatgtctttgcttctaccacacccaaactgcattgatgctgatgctacaaaaagccaatggaaaggattgttttttcccaattcctgagaaaacaaactcaacaatatgcccttacaacacacacctgtggtattctaagctcattccttccagggagaagaaaaaaaaaaaaaactctaaaaagttataacacctcatttatcccaaacttacaggcatcagacacacatctatgagcaagcatgcgagcaggacgtgccaatagcatcccccactaaggacatgtactaaaccttatgaacatgatgatatcaaacaggacatttagaacttcaaggatcctattaattcttattttgcatacaagtgtagtcactttgcttttctggtttaatgactcatcacagattagaaaccaggaattttaaaggggtagagagaagaagtattgaagttaggcatacaaagagttctggcacactataaatatttgttctataaaccaaaaaggatctgaggcatgtctcaatcagtttagaggtttattttgccaaggttaagagccagcccacgacagagcctcaggaggtcctgagaatatgtgcacaaggtgtggttgagttacagcttgcttttatacattttagggagacagaagttacaggtaaagacatacgtcaacacacgtaagctatcactggtttgcccatctccaaatgggcaggttgggaggggtgcttccaggtcataggtaaattcaaagatttattgactggcaattgtagaaacagttgaagtcagcctgagttaagataggggggattgtggaagccaaggttcttgttatgtagacaaagcctccctgtagaaggcttcagagagaatagatggtgactgtctcttatcagaccttaaaagacatcagactctggaaaaaaactagtaatggaaggagagtctctatagaacgcaaattcccccgacaagaaacagctttgcaggaccatttcaaaatatgtcaaagaaatatattgtggggtaaaatacttttatttctttcaggacctgctgtgttatgtggtactataccagagtcaggttggaatttggtatcttactgctacaaaaagtctgttttgtcagtcataagagttctgttttcatgttaatgctgatcaattgtgtctaaactccaaagagaggagagtataaacaggcatgtcctggtgctcccttcccatcatggctggaactagttcttcaggtttctttgggatccctttggccaagaggaagatccattcttttggctaggggtgcctagaattttattttgggtttacagttccacgaatgaaggaatgagaaaacaagtcacatcaaatagacttgcaataaaaagacaatgttttaaagtctgttcaaaagacatccaggactattcattgcctttaaaattttctatacagatcagttatgcttactactatttgccaattctaatgatactcaccattaagaaactcacattttattcagcatattatgctgaaggagccataaacatgaaaactacacattcaaggtttttcactacaaaatagtttccacaaaaagcttctgaagtggcgagcttcagtttttgtaaaatttgttaacatgggcactccattcccaaacaatgcaagataaatagagtgtttactttgccttgaaaagtacattatttatagaggtatgttatactcatttaaaataaacccacttaagatgaagagaaagcccttgtctttaatcatccagactgagatctatactgattgagctttctgtataattactcacatgtacatttcacactgtgtagatacaatctagggcctactgtaggaattgcaagcaatttggggattttgcaataatgtcattttggaagatggatgcatttctgattcaacaatggttattaatctagtagcctaggaaaaaattaacaggcatctaaaaatttctaaaattggtttgcaaaggtctagaatatgcagtttcccaaaccattcacatatttgggtaattccaaataatttatctgcagcttttatcttgtaaagtatctcaaaagagagcaggcaaaccagataagctggaaggggtggggggctgggagggaggagtcagaccaaattgtttaaagtcatattcaatattattggtagaaagttctttttacctgatatttactcttagaatactttccttttaatcatgtatgcaatactataagtatctacctctattcaaaaacgataaaaacattgatcaaagtttactgtgaaactttacaaaaatttatgttgaatcatctttattcataatagctcctagcacataaaactattcaataattcacaaatttttgttgaatgaataactgaatgacacacagctcctagcacataaaactattcaataattcacaaatttttgttgaatgaataactgaatgacacatagctcctagcacataaaactactcaataattcacaaatttttgttgaatgaataactgacacttgcatgtctcaatgacacaatggcaaattgtatctttttaaccttaattatagctacagtgcactaatgacacagcatcattgtcaagagctcagcaccctcaccacctccagcaccaaagcacttttagctcccagtggcatgttctaggtattgcacaggacaattcagaagcataatccaagtccttcaggaagtccaaatttaaaaagctcaagcgctggcaaaaattttaatttaaaattattactctagcagtgcgaggacaaaactaggtggttggtctaatttgtattttttcaagtcagttgctatggttttaaaaattcatgtagaagaatctctctgttaaacacacagagagagagacagaagaagaagaaggaggaggaggaggagaaggaggagaaagaggaggagcagcaaaatcatttacatggttattcagttcagtgtaactgacttgggtgagcaatgaatagaccacaccgctgagtcttcaaggttgtatccaaatgctctcatttgacaagagttaaaaggaacacacgagtttaagataaaccctgcctttgtttttaatatttagtgatatgattttggttgaagtctgggagggtcactatatcatcagaaaacacagaagggatattgacaagcatcttatgagacaaataagaagttaatctgagagttgagaaaaatataaatgaaaacaaaggatttttaaggagaagaaattgataagagatgaggaatataaataaatattttaaaagcagcttcagaacatccaagaacagttctcactttacttgactcatcaagacctgcttaggaaagaagatagtcactaactcttctttaccaaaaagaccaatgaattatgatagaaactgatcaagataatacaaagaaaggaagggataaaactcaagagagcatgtaacaaaggtcaatacacaatgaagtcatctagaaagataaagaatattggcaactcccaaaaagcagtacagtcagggccaactgagagtcttagaaaaaggaggcatgtttggctgcccacagcctggagaaagagtgagtatccaccatcacagagagatgtgcagtgcagaatctgggaaactaggaaatctccccaaactagagcaaaatgtcagattaatggcatccagctctggctgcacattagaatcaccgggggaagtttttagaaatcgcaaatgctcaagccccacctggagagactgattcattttatttaggttggatctgggtttagaaactattttaaagtagtaattagcagagacagaatttgaactcatatctatctgactccaaatcccaggcttttcctattgtgccacaatgtctccttctagccctacccaaccaagcggtattggaggggtggagttgcctgtgctgtagtttctcctctgacatactctcaggtgctcaggcttagctgtctgagatgaaagcagaggcagtagctgtaaaagcagatggtcaagacttgagtctgttttctccctgaatgattttccagtttttctctgcaaggtagagttcatgattcatcctcttttaggctagaagaaaactacagaagcctgaagtccaaagaatggagccccagaatacaaacaggccagtgttgctggcccagggaagggaggaagatgcacagggcaggagaagtaaaagggacaaaggagtctggggacctcccagaacccatagggatgggtgccctgaggcatttagaagagtgattatgaggcagagcttccctgaagggcaacaagccccctgtgtctgaacagaaacccatctatgtgcagattggttcatcattggtcctcatgcactgataattaattctggtaaggaataatgaatggcaagatgaatgaaacccagccacgctctgtgagcaggtggatccagtttcactctgagcatcctgactgggcctcctccctccacacacacagacccttcaagtcattgccatccttgccccatctccaggtccctttgctctgcccacctcagcccttacaagaacagaccaagtgtacaccttccaactcacacctccacacacaaataggaaatctatcccagttaagcctcatttctgcacatgacagattaaaataaacaaaacaccagtcttctaagtggaaacatggatatttcaaaacaccaagcagctagctacctaagctgttcacccaaagcacaaggtaaatatcccacagtaaagcaaaagtgatctgagctctggctaccctaaagctttggaaacaaggtcctaacaaacacactctttgagcaaaacaccaaagacaataatggtgagcaagcagagatggcagcaagagggaagcccctgactggagggacctgttcaccaacactgtcttcaccctagggtcaagtccatcagccctagaaccagctaatcttcctgcagaagatataagcacaaactccaatggtgcgagaccctcagaagttgtactagatgatgacagaaatctttttgccaaagccacagaagtttctgtggacagtctagaaagggaacctaccctctccttgtaaccttctcctgcaatcaccctatcacccctactacagttattgctgccagaattgaatcaaagagtgtgtctgctcctgtgttctttgacagatccaggaagggggtacagaataatgtttgtactctaaattaatatggcaataacaagtatttagttatcctcccaacatccacttcccgttattcctaattgagtcctttcagacattttaggaactgaacattggactaaaggagtcagggaatctggcttctaattttatctctactgttctttaatccagtggcctgggcacatcccttaccttcttaagacaaagagtttgtcacttgtgatattatgacaagaatgtgagcccctcagggttcctatgctggtcaaacaagataacgtatgaaagtcttttgaaaactgttaatcctaacaaagtggcattttgagtcactttatttgattcaattatacaataaatactgtagggatatttttaagcaaaagatgcacaaaacaaaggataatacttctaacaacaccataaatgagatatcattctgtgaaacaggtacctactcacatgaatatatggaggaagggaggaaatctttctttctgggttttcttttttcattcgcctctaaagacagtcactaaatgtcttcctaagagcagcatggggaaacctcaggaataagggctgtgtgctccataagttccggagtttgtggaggccttgtttcaaagctcagggcagaaatcaaaagctgtatgaagtaccctgttttgtgtccatctgaatcatgaattcttctaaagctctccaggaaaagtatcagtttcagggtcactagctcccatattatgcccctaaactgccttttatcatcactcagctacttcatgctgcccttagttaccccaaagaagggtggattttaaaacttaggaccctcagtaatctatgaacctggcaggatgttgttgaagctatttgaattcccagaagaaatataccctagagatgacatgaatttaaactaatccaaggagtattaaaatggttgtgtgctgccctttgtctcacaggttataactgatgcagtacaagcaagtgggaatgaaaaacatgagaaaaatctaagacagtaactgcagaccattcttcttggaagttattcatttcaagaagcaggtgataattactttctagagacagtaataagaaaatatagtcttgtctggattaaatctatcttgatggttgattgctatccttgggacacgttccaatgagaaaagcaaacaaaatctgtattgtcttcatataaatttcatccagttgagccgattcacatatatgaaaacaagatttcttcattcactgagggaaatatttttctgctgataagtcaaagaatcttgtttctatcactaagatcctttttaaaaatagtaccacatgggctactagagaagcaggtgtcaataacacttaaaaatatagatggctatgactagtggagtgtgaatggctatagctgctgaggtgagcccagcccaggaccccaggagaaaggaaccctggaaattttctatgctggatagcatgcaaattccccatactaggggtacctcctggttaggccatcccccaaaaagaccttgtcctttggcagtttggaaacctttgagcttcagggtacaggttgcatgtgtaagagctataaatgcagaacaagtgccacaggattagttcatgtaaggtgataattaagagccatatgcctatcacataggaccaacttcaaaaggatatgtgaggtatagcccagggaggctcagaacacatgagattggcccttgtcctgcagtcactgctcaccagacacctgggggccactagcctggcatggccactccagagaattggttctactggaagttttgttcaataaaaagatatcctgattgttgatccatattctatttttttatgcaataatcaagcagatttattttgtattgcccatggtagtatacctagaggttttagagtcctcattttcttccaacctaacattgttactcaaagattaaggtggaagcaagttcaccaacagtagtcctataaatatcaatgaccaggagtataaacccatgaacaatgactaattcttcaaaggtatctaattcattctccccaaatttctgtatactaagggatcttcttttcagaggcatgtgagtgaggatctcctgccaaggaatctaaaactctgcattttattggattcagatcagaatttcagatactgggatcaaaaccaattagaggaatttgttgaatccccaccaatgaaaaaacggccagttcagaactatggcagaatctttaaaatataatttcttaaacatattaatagctagatgttaaaaaataaagaatctcatcaggcaaaaccaagtaagacaaaattcatatttgttgacgcccctagtcttcacaagtgacttcaatcccagtctaactgtaggcaagcagagctctccagcagaagctgccaacaccattctcagtacaattatctgccctcctggcccaagaccaacagcctcccctcgactaaaatgaactccttttcaccttgtcattaaaacttcacttagcccaaaccccacttttcaaatccccagcacaagacacaccctcgaccacacatgagttctttcagggtcgtcctcatcctactatgctctgtctggttttcctcccggttacattcgcactagagcactcacctgggccaagcttaataaatatactgcatgtggttgaacacccgcaatcctgagcacagaacagacattgtccaccattctggactcttcctcaaagagcctggatgatacttcaaggtccttctcccccaggctgccattcaaggcagctctcctgagggtgggcaggtgagagggatgatcggttagtaattggcccaccagtggatcttgcacctcacctaaccaacaactgccattctccacccttctctggcacaaaatgcaattcaacataagcctgatgggtgttctgttcccacatgggttaaatacaggccgacagccttataactttttgctcttacaaactgaaagaattttaaaacaccatatatccccttaaatttatgaagttgaaatctatattcttactttgcataagtttgaatagttttaagaacatatatttccagcatcttgtaaacatcgacaactaaaaattacatttttagtttaaccagtgaagtctaaataccacaatgtatccatgatatctaaaaaccgtaatgattaaataatcaccatcatctacttaaaaaatacaggaacaagctccttaacgtttttgaagaaacttttaattttagaataattttagatttacagaaaaattgcaaagaaaatacagagttctttcccctgctcttttcctgttgtttttcttccttgtctggttttaactagggattttatataatctcattttactttatcattttgattatacatctttttaaaaattttcgtggtgtccctagaatgtagtccatctaaattgaaatctatttcaaataacattccactcacatcacatgtgctccaaggaccttataacagagtattcccaataagctgctctcatcccataggacattgctgtcattcatttcacttattcatatgctatgataacccaaaacattgatatcattattgctttaaaaagttcttttgaatcaattaaaaaataagaaaaaaagattttattttatactcatttatttcttctctgatgttctttcttctttaaatagatctgagtctccaacctgtatcattgttctcctggcttttaacatctcttgaagaaaaagtcttctagaggtggattccctcagtttttctttgtctgaagaagcctttatttctccttcatttatgaaggataatttcactaaataaaaattctagatgggtaatttctttttctttcaatacttcaagtatttcattctactcttctcactcacatggcttctgaggagaagtctgatgtaattcttatccatgttcctctaagaggaagattgaatatgataagcctaaatggtggtggattttttggcatttatcctacttggcactctctgagcttcccagatctatagtttcatatatgtcattagttttaaaacgttctcagctattattacttcaaatatttcttctactccattctctttcctctccttcagaattccaatattgcttatgttacatcttttgaaatagtctcacagttctagggtgttttgttccatttttttccattctttttctttttcctttgcatttcagtttgagaagattctattgacccattttaagtttactgattctttccttggatagttgatttcactttgaactccaaagacattcttcatttctcttactgtattctttatttctagcatctccttttgattctttctcatttccatctctctgcttacattgcccatctattattgcatgttgtctactttttccactagagctcttcatatatcaatcatagttatttttttactccctatctgaagatcccaacatctgtgtaatatttgagtttgggtctaatgattgttttgtttctttatgttggggaaaagctgagttttgggaaaaaagctgaggcagggcttgcatctctgacataatgtaaaagagtcttggaacatgtcgggggtccagggtctgaaacccctcatggtctttggaacaacaagctctgtgccaaagggtggaaggctgccctgccacaccataatctaagcccagggcataaaacccctcgtggcttggatggaatccagggctcagggcataaaacccctcatggcctctggaatgtgtctagacttactggctccttgcttctagcattcccaggcttataaaatgattgtatcttaaactagaagaacatgttccccattatctcaagtaccagaatatgttccatatgcttcaaaggaaatgctaaaccatcacagctatagcttatgcacttgatgcaccacttcctttcaaccctcatatcctcaccacctgcttctttgttggattaccaataaatagcatgggctcccagagctcggagccttcacaacctccacactagtgttggccccctggtcccactttatgcactcttaaacttgtcttttctcattcttttgactccaccggactttgtcgcccccatggcctggtgttgggtccagctgccccaacatctctaaagtgtgtgtgtgatttttttccttgctatttggcatgtcctatcattttctgttgaaggcagaacacactgtatcaggcaggaggaactgaagtaaacgagccttcattgtgtgtgaggatttatattaatctggctaggagttgagctatataattgttgcgtagttacagatgccagaggtctgaaaattcctctggtggtctttgtttttgtctcacttcttgactttgggcttccttaagtatctcctcttcagacatggcctgtgtctttcagcaatttcagccataatccactgttataataatggagccgtgttggtgtgataataaggtgtgcaggaggtggagtattctatattctcccaatcaaagaatggattgggtacaaagactgaatatgagacccatctgtagcttggagagtaatccactttactcaaagtctactgacttaaatgttaatctcatctaaaaataccttcatggcaacatctaaataatgtttgaccaaatgtctgggtactctagcctagacaagtttacaaataaaattaaacatcatagcatgtgttcatgttatatttgactgagtcatgatttatctctataaaattaatacttaaaagccagcaggcctttggggccaagttaggctgggtcctttttatttccaaaggctggctatgcccttccaaagtcagccaggccttccctataggagcagcccccatcattcactgctgctaagcaaagaaccccaagtattattttacagagtagcatcgtgaacttcatgtatgtacagtcaccaacagcaaatattttcatagttcctgtaccaaagaagcttttacaaagttaattcagcagtcactcaaaatattgattgaacatctattggactcaagtcattgtaggagacacaaggtcataaatacctcaaggagcttaaaactagttgcagaaacaagatacagtgcatcagttcaacatagatttttaaggagaggagttcaagttctgatactaggcagatttacctagaaaagtccactctagctatattactaaagaaaatgcagtaagatgtgcaggtgatggtggtaaaatctgacagatggcaagagatttacctctatttttaggattacaacaaatttcgaaagactaaacccaattctaaccaggtcagccatgaggtcctgttagatggtgctggttattccccttgtacagcacctacaacactgctagtcctcgatcacagcttctctctggaacttttaagcaactctgctcaccaagcaacaacttgacatcttttcaaacactcacattataaaaatgcattccaatttctctagagatggccattacagtgactcatgtgagagttcttgccttagcaatagagttatgtgtactttggacttgactaacagaaactctcttatgtggtaaacatagatatcttagctggttggcaaccaggaaaaggagctgtaaatgataaattgcacaggtatatagttcagcttccctttaacacaacagtttacacattggctgaagaaagtattatctgaagcttaaaaaacagttattttatagttgaaattcattttattgatctcatttggaaatgattcacatttttatactcacttagcttcatgaaggttacgaatcagtagagtaccaagagaaggtattcaaaatgaccactttttgatatcttctccgggcccttttcttcctcccaactttcttaattgtccctgtcattgatgtttccatcttacttatctttttgcggagatgggagttgttttctagggggaaagatttttggtgttggttttgggtgttttttgttccatcatcctaatacctagtactctttccccattatcaagatgacagatgttttgttaaagtgatagattatagtttaacagtaatcacaaatctggcaaccaagatccacaacaagccccaaactggggcacagcaaaaagaaagctttctaaaggcagtgaactaaaagttgtgcagtttgctggaaagtccctaatcttacagtaatcctaactttatataacagactgatttaccactcctgagcatattagaaatggcaaactttaggggtgggggtgaggctgacacactgtctccagtgagagattatattggccaggggaaaatctacaatgagcaaacaaattttctccacaaatgatgcctggggtcttttagactgatgaaaatatgcaacacttttttagtccaatatgttatctagttggggctaaaaaaacatgactaccagctgggcacagtgtctcatgcctgtaatcccaacactttgggaggccaaggtgggcagatcacctgaggtcaggagttcaagatcagcctggctaacatggtgaaacctcatttctactaaaaatgcaaaaaattagccagacatggtggcacacacctgtaatcccagctgctcgggaggctgaggcaggagaatcacttgaacctgggaggtgaaggttgcagtgagccaagatcctgccattgcactccagtttgggcaacaagagtgaaactccgtctcacaaaaaaataaataaataaaaaaataaatgactgccacttttcctctgttcttagatatatgttttcactttttatttctaaaattgaagtcaatcagaattgatgtgttcctttcatgtaatagtgtgtcttaaggaaatcagtaatggtagattttataatcaaatagaagaaatgaagtaattaatatgcagaaatagattgaattagattcactgtcctctggattgagagcttttgaatgttttacataaaatttcacccaaaataaagcatttttatttatgagtttgacttaatagggtaatctggaaaattagttatgtagagtgctacattccctgaagatgcctgataaatgaactagatacttaggcagatggagctcccgaaaaaagaagccaactgttatcataaacagttgctagtttactttcttcgtagattttctttttttctgattagctggttttcttattttcctgcttcttcaaagacctgctacagtgaagtttagagactttagatacttgcaagtataatttttcagctttcacagaagaagtacatatccttctattcttacttaataaagaaaagttataggcttgagcagacagtgtttttggccatttctcttgctttattttggtaacagttaattagcatagtcctcaagctatccctccacaagttaaaaaattaaaactcccatttgaatatttatcaaaactctttacgtggcaggcactgtgctcagtgggcactgtgtgtaaagataaagaagatgcaagctctactcccaatgggcttatgagggtgttgacatgaaaagcagaagtcttaggaaggactcaccaacaagcaatataatcctgtgaaacacactcttacagcccaccccaatatcaaccaaatgagcacacctccaaagaccatctcgatttcaataaactgaagcatacatactctcatggcaccccaatttccaagacatcctcaaaagtatgcagagtaggacagaactaaaatagttactgccacaacgctaaccacttatcagatacaggatctctgacagaggttttcagtatgtgtgagtgtgagtttaagtgtatgttctttcttgactccacttcctttctcttagtcattatatgtctgaaggagagttacagcaataaacttgaatccactcattaatttaagtaaaccgttcacaatctttatttttttagtagtaaaaaatgacttgtgacatctcacaagaccaatccacagtgaacattacccagagaatttagcataaattctacatataaaatcaaactaagattttagcttgaaattctattagagaaggttaaattttcaatgtcttcattcactaggtacagcatatcctgagtgtacgatatgtttgtctgctggggctgccatgataaaataccatagactgggtggcttaaacaacagaactcaattttctcatagttctggaggcggaaagtccaacatcaaggcatttctgggttgagtttctcctgatgcctctcttcttggcttgtagatggccaccttctcacggtgtcctcaaatggccttttctcttgcgtgtacatatccattcccagtgtctcttcctcttcttaaaaagacaccagtcccattcgatgaggatcctactctcatgacctcatttaaccttaattacttatttaaaggccttatcttcaaacatagtcacattgggtgttagggcttcaacatgtaaattttgtccatatttttcatttcagtctctaatacacggtaacctccaggagtttatctattattcctttaaaatgagaatcatctgacccagaaattatctacaaatagactcaaagaagagtaggttccaaacctatcacggcatgcctggtagttcagccactggctcctggcttcggccctcagtgaagctgtcttcccctcatcaaggggatttcaaactatctacagtttgctgtcagcagttcttggtagctaagtaggtctgagcaatcaggcaaaagagagatggtgaagctagttcttgatttgcaacagtacaattgccaggttaacttcctggctgtgggcatcccttagtggtctgggatttctccctcagagacaaccacacattgtcaggggcttcctttatccggcattctctaatgcatcttctccatggcgaagactttttgttttacttaacataacactgatcccaaagacagctacatctcccctcagtcttgaaagtcacccctgggtaaacccggtgtgtgggagaactgggtttccccacttcctgaacacagaacctcagcctctgtccctctgcctgctggaaaggttggtgtggatttcaactcttacacccccttccctcttccacaaggagataccagcttacagttccacttgccccaccactgttatgaattccataacaaatttagaatattaaaataaaagctacaaatttgtgagtgcttactatgtaccaggaactgtactaagtactttccttacattacttcataaatcctctcaatatatgcctgtaattacagaggggaaaattgagactcagtaatgttaacattactcccccagtatcatacatgtagtaagtggcagggttaatattctaatttccaatgctcaagttttatctaatagtctattcccacttgcctaagtataaattccctacccttcttaaggtagaagaatgtacctatattagagaactaccttttttttttccttttgacagagtcttgctctgttatttgggctggcatgtagtggcgtaatctcgactcactgcaacctctgtctcctgggttcaagcaattctccttcctcagcctcccaagaagctaggattacaggcataagctaccatgcccagctaatttttgtatttttagtagagacaggatttcaccatgttgcccaggctggtctcgaactcctggcctcaagcaattcaccagcctcggcctcccaaagtactggtattacaggcgtgagccactgcacccagtgagagttacccatttttagcaaaacgttactctatgaggaggaagagaggttttggatgctgcttagtcctgaattgtgcacactaggtattcccagtgggctacagccatgcctctctctgcttcaagttccacatctggaaaatggactaatgatacctgcttgtcacattgcaagggccacaaaaatagaaatgagatgccgcatgtgaatggagcttgaggaaaatcaatacaaatataaataaacttatttatatgagtcatacttcaaaaaagaataccatcatactgtccttcatggtatcacccttaacaagacaatgccaaccatctaagttccctcgccccatcagactcctttaatacactacatctagtattgtttaattttctacatgcatccatctagaaacatggatgagcctgtaagtaccttgatttgggagattatgttcattattcttaatatttcctgtagtgccctgcatgcttttccacagtaggtgttcaaaaaatatcatgttgttgggttgataataattatatatggccagagagctggcattaactggtagccatttaaaataagagattaaagttatttcataattaactgaatgtttactaattgtatctttaaccaaactacttgaacgtgtttgggcctacaaggacacaggtttgcgacggtgctgattcaattagtaaccccagcaggttctacccataacttggcttaatggactccaccatttatatcctactcatgctccactctgaaggcagaggggaaatcttgggagagaggagggaggctttggattcttcaatctcaaagtaaatacaaaatatttgcctccctatgtaatttgtcatggacaaatcctcagcaaaattactgaaattacagggagccacaagtagaaattgataactgtcagggtgcttgacagctctatacaggaacaccttcgctaggaagactctgcttgctggatttcctctataaaatcagattttgttttcacttcaaatcattctctccagagaaaatatctattcatcccaccaggcactttgacacaggagccccattctgagagaaatgcatgttgacagcagaattgcagtagaagctgtctcataggatcccatcaaagaggctcttggcaagcctctgttttgagatccacattaactcaaggcctgttccatggtctcttacgtgaaaaagtaaaccagaaaaagaaaggaaaaaagacaataagtcttgtcctgagttagtaaaatattaagaaaaaaaaaccagtatgagtagagctggagaaatagagtatcttggttccttgatccataatattttgataggaataatttaaaccgtgatgattggaaactttgccatttgaaattaagcaccactctgctcctttcaccacatatatcctccaattcaatcttctgctgtaagtaagcaaaactcatgaatatgaggtccataaggctaaaaagatcctatttgtgtagccaagtggctaatgatctaccaaaggttcatgctccctcttccatagtggggacttgttgctgggaattggctgcccaaatgggggctacattcccaacccctttgcattgaggtgagggcatgggactaattcttgagtggaagtgatgtgtgtcacttcgggaccaagaaccttatctctctcttccatcccattccccggcagaaggcaggggcttcggaggctgtagcagaaggcagtgccacaaaacagaaagagcctgagtacccaaatcaccagctggaaggccacccaccaggaacatgagagcaagaagtaaacatcaataatgctaagccactggtgtctggtgtttgctaaggtagcttgcattaccctagctaacccaatttgctttcatggtttcctttccattttacagcttttaattttgatgtgctttttaatggatctattcctctataactaacaattaattatctgatctattcctggattttatgtactgtgaagattgccaaggatctgtccctctggcttactggaatagttatctatctattcttttctccacttatctgtaacagcttggtttatcacacaaaaccaccataggttggtgcaaaagtgattgcggtttttgccattactcttcatgcagaatagcagtagaggctgtctcatatgatgccaccaaaaaggtttttgctattaaaagtaatgacaaaaaccgcaatcatttttcaccaacctaatactatttgatggaagtgattagaatagagttgtagtgtagtacacagatgtaagtttgaatgttgattctgggtaactggacaagttacttgctttcgtcaaggctcggttttctcatttgtaaaaggacaataacattttacctctgctttgatgtttcactctctagtctcaaaatgtgaataaataacttttcgctcagtcccaaacaattttatatatgtctctctctttgtactttgaatcaccgccccaacagacctggcaataattccagtactacagatattattttgcatagaagataagcagttcatccagaagcagccacagtgtgatcggatgtagggctgtttatcttgacaatcctccctgcccccgcttggattacattatgcacaattcaatgtggcttctggtttgtcacgtatgattaatcacactgatatctactatgcccatttcattaaatccttcccactgaagcaggatgcccatatatacccaaagtgtgttttcctctgccttattctggcagatagggaaataaggttaaggttttaccttcattggtaaagttaccctcaaatcaaaacaaaatgctgaaaccatcagttaaatatgagctaatcttataaagaacttaaaaagtttagtcttcaggaggcaatttccagagagtaggttcaataataggaatttccttgtgcccaaaatggggtggggcagtataaagtatactgattaattgtcttaaaatttaaaaattccaactcctagtaactagttgcagcactccaggttgaacatttaactcatggaagtacctagagaatattgccaggtccagatagcatcctacccaactatctcatttgaaacgtaaaaaaattgagggtccgggaaattaaatgatttgctcaggtcactgaaggaatatactgatttaccatgtggctcccacaagagtcccgcctgccagtgctacgtcactctggtatccaaagttcactgtctaagctgctcttctcttctgtctgcactgtcttccttcagaggcaacacagcttatgcttaagagtgttagggacatgaagctctgatttgagctgaatgacctggaggttttcggtgaccctctctgaagttccatgtcctcacaagtaaaatgggattaacaacagcacctgagtcaaagggcgatggtgaggaccagcagagcttctgtcctggcacttcatgtggcctcagcaagggtctactttttctccccgcttttttttttgagacagagtcgcccaggctggagtgcagtggtgcgatctcggctcactgcaacttccgcctcccaggttcaagtgattctcctgcctcagcctcccaagtagctgggactacaggcgtgcaccaccacgcccagctaattttcgtatttttagtagagatggggtttcaccatgttggccaggatggtcttgatctcttgacctcgtgatctgcctgccagggcctcccaaagtgctgggattacaggtgtgagccactgcacccagcccctttttctccctttatggcatccaggcagacagtctgtaacagtggggcaagctccttctgactcatctatttctttgatcattattgttcgttttgtttttttttttaatgctacaactcagatatatctggaagcattcctaagcaaacaggcagacgagccctgttcacagtaagaaaaaagccttctttagataggttacacagaagcaaatttcaggacagcctgaaattatccatgtctcctgcagccaccaagggcaacaacaaaaacaaaaaaaaaaccagaatgagtcaatcagcaaaaactcaaattaaaatctagctcacttgttttccaaaaataaaatactcaacacaaactaaaattcctaacttttaccacaactgtaagtctttcaaagtattcatagacatagaattgaacacaaattggttaaaatcatgggcagagaaacaggaggaccaatttatatttgtacaggtctcagctacctgtttataaattgggatgcttccgtatgcagaagagatttttcatcttgagtatataaatattcttcctaataaggctgcctcatttctctacaaaaagactataatctaaacatatgcaaacaccaggggtgaaattgactgacaatgagcaataaaaataggaaaattcattaattactctttttaaagaggtaaaaataattgctctgtattaaaaccactgtggtattcaaacagaaatttaaaaatacatatgatttcctccagtcttacatttcatactagatagccaagtcaattaaactgatataaatgtaaagaaggtttatgcaaccccacgttgacatttcaagcataagaataatgcatcagttttccactggttcctcctactgtgggcattagccagcttgtagctatcaggcacaaatataaaccctttcgctgtaaccctggcatcacccaattccctcattcaacagtttccatgtagtccttgaaaacagctgcagatgagaccccagtagagtctggattatctatcacctgtagaggatggaacaaacctcctcaccctcactgatgccttgggttcttacagtcaaaatacacagcaagggacaataggaagtgactcagcatttgaaaactgtgtcatcactggcaaacttagtttgcttctctgtaggatataacaagataattctttcttttttttatatatcaacagtgtcattttttaaaaatgggaaacactgggccatattagcacagtttttgtgcagcattgcatacactggtgttctcttcctgagtagcttagcagaaatgcattttctcagcaatttctttccagatgtggcgttggtattgctgggtggaatggggtcgggagggtgttaaaagacaagcaggtagaaaatatcatctgttgtgaagccactaagtagcaaccaggatctgatttgctttatattttttaacaagttaccatccaaaggctaaatgaccctgaaaatcaactgggttttattcaaaacacagtttccagccacaaatctccagtatgacacatatggaatgttgaatgtaccagtgagcagttggttttccactcgctaggagttctaaaccttaaatatactgaagtgattaaatgaaatgcttcttctggcttaaaaattattttacagctaacattacataaaaaatgttttttcatccaaacatctgcagagtaaattacctttcattcatgctagtgccaagttaagtgacacagacagaaaggtttgacctcagtttccgcttccaagcatgtgccgttttccagggctcgtcaattgaccctaatgagcctccaaccaacacccataatggtcttctttaaagattacaatcatatttagacatgtttctgcctttataaacacttgcttcaagcacagaggtgcatctgacattatgtggtcaaaatattcctaagcaactctctgtaaactgattatttttgtaaattgagcaattcaaattgcagttgagagtactctatttacagacactctatgactaattcttttgcaaagctgccttttgcaatctgaatatccagccttgatttatctgtcttgtaatttccaatcttcacatatcaagcatacctaaaaactgcctaccacagtgcctgtcgaacagtagtcattcaataaatgttctggtttaatgatcttgctgcagtttcaggaaatctgcaaaataatttattatatatcatagtgcacccagacacaattcaaaaaactaggtgctatatacacatttattactttggaatgatttaggcatattagatgactttccaaggaattttggaattctagagaagtctctggattggttaatcagcaaagaaatcttcccctggatccccctcatatcctggagctctgaaaggatactctgaagtgtatactatacagataattgtaaggaatacatttccagaccttgacttctatacgtagattttctcagaactttctacagctttctactttctagagctgaggcttcctgacacttcttcctatcacccctttccccagtacaaaaatctcaggagtgatgaatgaaaaccaacagaaaataagagtccccaaagcctaatcaaagagccataatcatcatctccctccattttattatgagatgtattgctagttttatgatttatatgtaataattgtttacaaaaaaatataattcattcacataattttggtcaatttgttttttgttttttgttttgttgtttgtttgtttgtttgtttgttttttgagacacagtctcactctgttgcccaggctggaatgcagtggctcaatctcggctcactgcagcctctgcctctcaggttcaagtgattctcctgcctcagcccccaccaagtagctaggattataagtgtgcacaactacgcccagctaatttttgtagtttttagtagagaaaaggcttcactatgatggccaggctggtcttaaactcctggcctcaagtgatccaccctcttcgggctcccaaagtgctggaattacaggcgtgagccactgcatcagtcctaattttggtcaattggatgctaacaataattataaagataatccaatccagaagaaaagaaattaatactaagactatggtgacaggaaattgatagagtttgattaatattcatattgtttgaggatatcatgatagggtgatcaataagagattttcaaacatagactagaatgaaaataaagtttccaattgtttaaagaactctgtccctattatgcttcttaaggaggagaataggtgccaaatcaaataaaatattccattgcatacactttaaggaatgatgtaaaagttccattttaaattatcaatatgtagaatgcactagaaacaatgtaattttcgacttgctaattttttttttttgagacagagtctcactctgtcacccaggctggagtgcaatggcatgatcttggctcactgcaacctctgcctcccgggttcaagcaatgctcctgcctcagcctcctatatagctgggattacaagcgcccaccatcacgcacagctattttttttttgtattgttagtagagacaaaccccatctttgccatgttggccagcctggtcttgaatccttgacctcaggtgatccacccaccttgacctcccaaagtgctgggatgacaggtgtgagccaccgcgcccggcctcaacttgctaaaattaaaattgtgactttacaatgaagaaaactgaagcgcactattttaacccagtgatcaaagtgaaaagcccaacaacgggacaactgacatcctgtgcctccctgtgtgttagacagagaaagacacaacatcatttctgtgatgttcctgccaaagatgcagagtctgaatttaatcatgaggcaatttctgacaaaccaaagttgagggatattctacaaaataactagtcttgacccttcaaattaccaaggtcatgaaagcaaagaaaggtgaaaaggagaagggaggatactgtgtataaagacaagtggtggaattttaatacaaactgtaaagtagataacagtattttatcattgtacagtgattatgttaagaaatgcatattgaaatatttaagagtaagagagtactgcttatctcaaatggttcaggaaaaaatagataatgatgaagcaaaactggtaaaatatgaacgattaataaatctgggtgaagagtgtataggagttcttttttctactcttgcaattcttcatgagtttgcaatgatttcaaaataaaaagtaagtaaaataaataaaatctaaatgtctaataagatatgggagtgactacataattttccaaaatctaacaggtgtatcagtcaaaatgatgcaaattctggattgtttctcttattctctccaggatctttgtcagtcatgcagtttctactctcctgagtgcctcctgttcatgcatttcccagcagcaagatctgtgtgttcaatttcatcatctcctctctcaatttggcctaacaaattgacacgttctgtctgccaccctctaaagaaatagtaaagaaagtgtcactttctgtttgataagcatgaactgctttgcctggagaagcaatgaattaattaagtttaaagatgaatgagctacaattaatctagcttagtttatattgtcagcatatggagaaaaaagaaaaatcttccagtagaaaacaaacaaaatgtatctactattaaatcactcgtacatgtatatgtatatgtatatatatatatatatacacacacacaggctattatacattatatacagtatgcacacatatatttacacacatatatacatatacaagattgagttcagagtatattgataaagttattctgaatatatctggtaaaatatataaagtataattgaaatttctctttaaaaggaatgaagtgagtctaaatgcatatttcatatttattttatatgtagtatcagagtgtgtgagatacactctctcatttattcctactctgttcctctgaggaaaagaggaaatgatcccatttgacagataagaacactggggcaacatgagacacaggtaaggagacgggttgattagactgagaaattagcctgcccagttgcctgtctatagttccatactggatcatgctgggatctgctagaattttccccttcccccacacacttagatgtctacaaacatacatacgtatgtataacattccatactatacattgtgttacatgaacatacatacataaatatataaacacatatcatttcacccaaactaaggcaaaaaccaacaccaataaaaatatctccagaaaccattttctttatgtccttatcaatgagaggagttaatggattgaacagaggaaagttgttattagcaaaaataaatcctgactcagattgctgagatgatccttaagccagagagttcaaatttccagcctcaagacaaaacttatagctagtgatctctgtaaaatctagagtaaatggcaaaagaaaactgatggtatactgttatctatctataatgtccagagtttcataactaaaaataaaactctggcttctaaatattcaagaaacttccagtatcttttctccaatagtacaaaaatgaagaaatactttgttcccactgatctcttgggcctctttctgaaagcaaaccagtaccaatgagagaaacccagagagcatttcaaagtattgctactgttaagacctctttaccttagaagcacctaagtgctaacatcttccaaaacaagttcactatgactgttcagtgccagccctggagtctgcacagaaaagtgagtcctttagtgctacttgcaacagttaaaaaccagtttggtatatgtcagaccatcaggacagaaaacagagtctgcaatgaacatgcttatggcccacactttccagtcaaagagaagtgagtcatttctgcttcaactgctatccctacaggcctagaaaaatggaaggactgggcaggaggggtcagagaaaggatagaagaagcatagaattggaactaaaactgtgtagccttaaagtgctctggcctgaaaatctagagaaggcttcagcaggagaaagcaggagaggacatggttattttcagtaagtcatagaagggaagatggctaacagaaatgaaatggacacagaacatcaccaaagtagcatgaaggtatcagatcccctgagataggtcttagccaaataattccactcctgcacattagagtttgacatctaaggcccctccatcttttttccagtcaagacctacacaaatgggtgagggcttgctacatgagaagtaagcaggaacaatacgagaaccaagacaagctacaagcaggacatgaacacatcaaaaggcttctgaaaagacacgtctacctagcctgtgaccaggtcaactccctcattaagtttagcccctttaaaaaatatatcttgtttatggtgcctttggtttctcccttttccttctaattaaaagcaatttttgttaacttcttaatacaaaagcaatgctttagaaaaattagaaaatacacatttttttaaaagccagatggtcaacataaacatcattaataaaaataaaagaactgcctatatttattgaccaattatcatatgccaggcactctactaagtattttacatatattatcttattcaatcctcacagtaagtcttatttaaaaaaaaggtgggaaattcattgtacgatgtttaacaccaaacgttatgctgaaacactagattattttgctcagcaaatatctgcttgtttgtttatatacttaaacatttatttagggatgaaatgattttcatcttaaaaaatgaagtcttcccactcagaagcatggactatttcccagtttattcagtctttatgtcccacagtaaaggactacaatgttcttcatataacttctgtccatatcttgctgagttactcttagaactatatttgtgatgcaattatgactggtattctttttctcccaatcatattattgcttgtatatttattctgaatttcctgtaatttttgagagtaatctgttacattttagaagaaaaccaaaaaagattttcttataaggattaaaagttgagggtagagggaggaacaactagaagtgaatttgaattggtttccttgcaagagacagaaataaacacagagtgcagtaaacatcaatcagcacctacttattaactcagtctggcattgaattaggctagagagggttatgaaagaattttataaccactgaccttgacctgaaagagttttacaaaatggttgggaggctgggagtcaatgtatgaaaatctgttagcacttatggagttagtaaatactaaatcatgaagcatgactttatctgtgttaggtgttaagaaaaaagtggggtggaggcaaggtggccaaataggaacagctgggagctatctacagctcccagtgtgagcgataaagaagacgggtgatttctgcatttccaactgaggtagcgggttcatctcactggggagtgccagaaagtggggcaagacagtgggtgcagcgcaccgtgcgtgagccaaagcacggcaaagcatcacctcacccgggaagtgcaagtggtcaaggaattccctttcctagtcaaagaaagggatgacagatggcacctggaaaatggggtcactcccaccctaatactgcgcttttccaatgggcttaacaaacggcacaccaggagattataccccacacctggcttggagggtcctatgcccacggagcctcgctcactgctagcacagcaatctgagatcaaactgcaaggcagcagtgaggctgggggaggggcgcctgccattgctgaggcttgagtaggtaaacaaagcagctgggaagctcaaactgggtggagaccaccacagctcaaggaggcctgcctgcctctgtaggctccacctttgagggcagggcacagacaaacaaaaggcagaagtaacctctgcagacttgaatgtccctgtctgtcagctttgaagagagtagtggttctcccagcacgcagctggagatctgagaacgggcagactgcctcctcaagtggttccctgacccccgagtagcctaactgggaggcaaccccccaataggggtggactgacacctcaaacggccaggtactcctctgagacaaaacttctagaggaacgatcaggcagcagcatttacagttcaccaatatatgctgttccgcagccaccgttgctgatacccaggcaaacagggtctggagtggacctccggcaaactccaacagacctacagctgagggtcctgactgttagaaggaaaactaacaaacagaaaggacatccacaccaaaaacccatctgtacatcaccatcatcaaagaccaaaggtagataaaaccacaaagatggggaaaaaaacagagcagaaaaactggaaactctaaaaatcagagtgcctctcctcctccaaaggaacgcagctcctcaccagcaacggaacaatgctggacggagaatgactttgacgagttgagagaagaaggcttcagaagatcaaactactccgagctaaaggaggaagttcgaaccaatggcaaagaagttaaaaaccttgaaaaaaaattagatgaatggctaactagaataaccaatgcagagaagtccttaaaggacctgatggagctgaaaactatggcacgagaactatgtgacgaacgcacaagcctcagtagccgatgcgatcaactggaagaaagggtatcagtgatggaagacgaaatgaatgaaatgtagtgagaagagaagtttagagaaaaaagaacaaaaagaaacaaacaaagcctccaagaaatatgggactatgtgaaaagaccaaatctacatctgattggtgtacctgaaagtgactgggagaatggaaccaagttaggaaacactctgcaggatattatccaggagaacttccccaatctagcaaggcaggccaacatccaaattcaggaaatacagagaaggccacaaagatactcctcgagaagagcaattccaagacacataattgtcagattcaccaaagatgaaatgaaagaaaaaatgttaagggcagccagagagaaaggtcgggttacccacaaagggaagcccatcagactaacagctgatctcttggcataaactctacaagccagaagagagtgggggcaaatatgcaacattcttaaagaaaataatttccaacccagaatttcatatccagccaaactaagcttcataagtgaaggagaaataaaatactttacagacaagcaaatgctgagagatttggtcaccaccaggcctgccctaaaagagctcctgaaggaagcactaaacatggaaaggaacgaccagtaccagccactgcaaaaacatgccaaattgtaaagatcatcaaggctaggaagaaactgcatcaactaacgagcaaaatgaccagctaacatcataatgacaggatcaaattcacacgtaagaatactaaccttaaatgtaaatgggctaaatattccaattaaaaggcacagactggcaaactggataaagagtcaagacccatcagtgtgctgtattcaggaaacccatctcacgtgcagagacacacataggctcaaaataaagggatggaggaagatctaccaagcaaatggaaaacaaaaaaaggcaagggttgcaatcctagtctcagataaaacagactttaaaccaacaaagatcaaaagagacaaagaaggccattacataatggtaaagggatcaattcaacaagaagaactaactatcctaaatatatatgcacccaacacaggagcacccagattcataaagcaagtccttagtgacctacaaagagacttagactcccacacaataataatgggagactttaacaccccactgtcaacattagacagatcaatgagacagaacattaacaaggatacccaggaattgaactcagctctgcaccaagcagacctaatagacatctacagaactctctaccctaaatcaacagagtatacattcttttcagcatcacaacacacctattccaaaattgaccacatagttggaagtaaagcactcctcagcaaatgtgaaagaacagaaattataacagactgtctctcagaccacagtgcaatcaaactagaactcaggattaagaaacacactcaaaaccactcaactacatggaaactgaacaacctgctcctgaatgactactgggtacataatgaaatgaaggcagaaataaagatgttctttgaaaccaatgagaacaaagacacaacataccagaatctctgggacacattcaaagcagtgtgtagagggaaatttatagcactaaatgcccacaagagaaagcaggaacgatccaaaattgacaccctaacatcaaaattaaaagaactagagaagcaagagcaaacatattcaaaagctagcagaaggcaagaattaactaagatcagagcagaactgaaggaaatagagacacaaaaaacccttcaaaaaatcaatgaatccaggagctgcttttttgaaacgatcaacaaaattgatagaccgctagcaagactaataaagaagaaaagagagaagaatcaaacagacgcaataaaaagtgataaaggggatatcaccaccaatcccacagaaatacaaactactatcagagaataccataaacacctctacacaaataaactagaaaatctagaagaaatggataaattccttgacacatacactctcccaagactaaaccaggaagaagttgaatctctgaatagatcaataacaggagctgaaattgaggcaataattaatagctcaccaaccaaagaaagtccacgaccagatggattcacagccaaattctaccagaggtacaaggaggaactggtaccattccttctaaaactattccaatcaataaataaagagggaatcctccctaactctttttatgaggccagcatcatcctgataccaaagcctggcagagacacaacaaacaagagaattttagaccaatatccttgatgaacattgatgaaaattcctcaataaaacactggcaaaccaaatccagcagcacatcaaaaagcttatccaccatgatcaagtgggcttcatccctgggatgcaaggctggttcaacatacgcaaatcaataaacgtaatccagcatataaatagaaccaaagacaaaaaccacattattatctcaatagatgcagaaaaggcctttgacaaaattcaacaatgcttcatgctaaaaactctccataaattaggtattgatggcacgtatctcaaaataataagagctgtctatgacaaacccacagccaatatcatactgaatggacaaagactggaagcattccctttgaaaactggcacaagacagggatgccctctctcaccactcctattcaacatagtgttggaagttctggccagggcaatcaggcaggagaaggaaataaagggcattcaattaggaaaagaggaagtcaaattgtccctgtttgcagatgacatgactgtatatctagaaaaccccatcgtctcagcccaaaatctccttaagctaataagcaacttcagctaagtctcaggatacaaaatcaatgtgcaaaaatcacaagcattcttacacaccaataacagacaaacagagagccaaatcatgagtgaactcccattcacaactgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcagtatcatgaaaatggccatactgcccaaggtaatttatagattcaatgccatccccatcaagctaccaatgactttcttcacagaattggaaaaaactactttaaagttcatatggaaccaaaaaagagcccgcatcgccaggtcaatcctaagccaaaagaacaaagctggaggcatcatgctacctgacttcaaactatactacaaggctacagtaaccaaaacagcatggtactggtactgaaacagcatggtatggtaccaaaacagagatatagacaaatggaacagaacagagccctcagaaataatgctgcttatctacaactatctgatctttgacaaacctgacaaaaacaagcaatggggaaaggattccctatttaataaatcattctgggaaaactggccagccatatgtagaaagctgaaactggatcccttccttacaccttatacaaaaattaattcaagatggattgaagacttaaatgatagacctaaaaccataaaaaccttagaagaaaacctaggcaataccattcaggatataggcatgggcaaggattccaggtctaaaacaccaaaagcaatggcaacaaaagccaaagttgacaaatgggatctgattatactaaagagctttgctgtgcttctgcacagcaaaataaactaccatcagagtgaacaggcaacctacagaatgggagaaaatgtttgcaacctactcatctgacaaagggctaatatccagaatctacaatgaactcaaacaaatttacaagaaaaaaacaaacaaccctatcaaaaaatgggtgaaggatatgaacagacacttctcaaaagaagacatttatgtggccaaaaaacacatgaaaaaatgctcatcatcactggccatcagagaaatgcaaatcaaaaccacaacgagataccatcacacaccagttagaatggtgatcattaaaaagtcaggaaacaacaggtgctggagaggatgtggagaaataggaacatttttacactgttgggaggactgtaaactagttcaaccattgtggaagtcagtgtggcgattcctcagggatctggaactagaaataccatttgacccagccatcccattactggttatatacccaaaggattataaatcatgctgctataaagacacatgcacacatatgtttattgcagtgctgttctcaatagcaaagacttggaaccaacccaaatgcccatcaatgatagactggattaagaaaatgtggcacatatacaccatggaatactatgcagccataagaaatgatgagttcatgtcctttgtagggacatcgatgaagctggaaaccatcattctcagcaaactatcgcaaggacaaaaaaccaaacaccgcatgttctcactcataggtgggaattgaacaatgagaactcatggacacaggaaggggaacatcagattctggggactgttgtggggttgggggagtggggagggatagcattaggagatatacctaatgctaaatgacaagttaatgggtgcagcacaccaacatggcacaggtatacatatgtaacaaacctgcacgttgtgcacatgtaccctaaaactcaaagtataataataataaaatttttttaaaaaagaaaaaagtgtctagagaatggaagtggtggaaaaatatcccaccaaaacaaacgagctgacatatcattgagtcagtggacagtttgcagataagaagccaatataaacacagatgctttaatatgaaaccagaaggatatctttatgtcgagccccaatatctactaaattctaatactttaacttctcaaatagtgaaaacaaccaacaatacagaaaagtctcgggcggagggaggaaaagtgacaacacacctgtgaaatggcttctcaaagtttcaatagcatgtgtttctaagatatgggaaagccaaaaaacgcatgggcagccttcttcctttagaagtattcaattgttctagatagaaatctcctttctttggttaagaatttattgtagtttcacctttccttagaaatgaaaactgtgattgttgagtaaacaacttgtaaaactattttcactgacacttattaagtatcttggctccctgcattgaatttctatttagtcacttccctcaacatgtagatcaaactgatgcctcaattataatccttgaagaacatgggggaaagactgtttaaagcattccctctctgctaaggaggaaaatatcccagtcacatgagctgtgtagcataatgtttgttttccatgttgatctgcaaaagagagagatgacagaaagagtgttgggtgtggtggctcatgcctgtaatcccagcactttgggaagctgaggtgggaggatcacctgaagtcaggagtttgagaccagcctgaccaacatgatgaaaccctgtctctactaaaaatacaaaattagccaggtgtggtagcacatgcctgtaatcccagctactccaggggctgaggtaggagaatcgcttgaacctgggaagcagaggttgcagtgagccaagatcgcgctactgcactccagccctgggcaacaagagcaaaactctgtttcaatacataaaaaataaaaatagagaaagatgacagaaagcagaatcagaggaaatgtatcactgttgaacatttcctacatgtattgcactgagctcaacactttgcagggtctcccttacagtgaccttctgtggtaggtatattacccttattttataacttgaaaactgaggcttaggggtatatacacagacctgggaactgaaagctacagttccaataccaccagctttgctgcttgctagccatgtgatcttgagtgagttatttagtcatgctgcagctcagtttcctcatcaatcaaatgatgggagtctctgacgatcacgctagggatgatgcatataaagcgcttagtgcttggcttgtagcaagaatccaacagatgacagccctcactattacggcctacactgattcttcagtctgcatctacacccactgtgggtcatcctgccacctgccctgccctgctgtatgacctgaggcttcctcctaaagaggcattgccagagcttcctcataggcaggcttctgggtgaacccagtcattgggaagcactaacaacaagagatcagagctcaggaggagaggagctgaggtatttcttccccactcccttcttcctccaaggtatgttttctgacagtgactgtccctccgtgtctccagcttccaacaggagatccctctctcatagctcctttacccactggtttcctgtagtgctaattcctctccttgcacctccaggactaaggatggtaataaccgcccactgtaactagtcttgggtgtccaacaccctttggtaattgtgttacctgctcccatatttgtaagcagtcctttcatcaaaatctcttggaccatctgaattggagtctgcttcttgcctaaccctggctgatatccaaactcaaaaatcatacactcgtaaatgaaggacccagcaacctctatggtctatggccaatgctttacaaatcacttatttgccaatgataatttaaactgtactggtagtatacaaccacgtattattaaataaccattcttaaaagggaatagaacattgttaaaatatagtttgcaattgctgagaaatacatttggtgatttattcagatgatatctaaaatgttcaatatctcattccaaaggccgcaccccaattacacaggttgcaaaccctatcctgcaagtagcaccaactacagtcccactttctctctgagaaatgtcaacctgactttatcctgagaaaacagaagatcaaaactcttcatagaatcttagagaaagtctctaagcaagagccaaaatgtaaaatttgaggtaattcttattgtcattgtcatgtgcagaagtgcagctacaattctgagggctcggttccagaatattttagaaaaagtaatgagcttctctagttttggacaagacggcatagactcttttccctgctaagtatgaccccaaaccctggatataacacaacaaacaatcataagaacattctgaaaggtgaaagaagaacacagactggctggggacctcaaaagtcaaggagcagcacagcaacctaaaatctcctaaccacccatccggaggcagaagatgtcccaggtaggtgcttcttcccctgtaggaggcaccaggaaagactaagcagaagcacagccagcaccaggcagcccgaggaagcactctctgccccccatgagcctggcatcttctgcctccaaatttggtgatgccaggccaacccatagaagcacttttcaccctcacaggtagcacaagcaggaactgagtgacaaccccatcagcactgggcagcccaagccagagaaaatagtttctgctcctgcaggcttggcatctctcatcctctacccagtggtactagatataaagaagaaccaaatggaaattatgagacttaaaacttcaataactgaaataaataaaaaaattcactagaagggctcaataggcaaatatatgtgacagaggaaaaaaaataagtgaacttgaagatagaacaatagaaagagacacctgtggggcagaaacaaaagactcaacagtcatatcattggaatcttagatggagaaaagaaagagtagagctgaaaacatattcataaaaataactaaaaacttcccatatttgctaaaaaacaaacctgcagatttaagaagctacgagaataccaagtaagataaacccaaagaaagccacactaaaacacatcataagtaaaattctgaaaactgaagacaaaaataagaatggaattcatatgggaaaaagtcaaagtttgatgttatttttcactgagaaaactttgcataacaacagctctgacaagctgatatacaaatggatagaattataacacaatataatgtttataatgtgttagatacaagccctttgacaaatattaatattaaattcttaaaaaattcctatgaagtagttattattattcttattttacagttggacagagacccagagaggctaaataacaaactgagacccagaaaggctaaataacttgcccaaggtcacacagctagtaagtgacagaacccagaattcaaactcagacactctggttacggggtctacattcttgactatgatgcctggaagtggtctagtatagtagtatggaatcatgtacatatagtttagtagtatagaatcaacaaccaaaattgacaaggtccttataaactagataaagagacaaggaataatccaggatttagttccagatgtttttgtttatttttgttttattaagattttctttaaaatgtattagagctggacagtatggctcctgtaggcttggatattagtaactctcattgttcagaattaagcttatactaaagttgtacttggtgtgggcaatgtttttttctgccagaatcatatagtaaaagacatctgtgattgtttttttaaagttgaagttaagcagttagtctccttggcttactacttttattaaatatcaatgctgatgtcattttctccacaaaccaacatcctaaatgatttttatcaggacagataaactctcaaatacagaaagcaggtcttttcattatcctattgattaaaagcaaaatacaaaaaaattagctacatgatacaggcacacaacaaaaatctttgtcaaattttaacatggcacaggtttcaaaataaaattatcccttttagaactggcaggtcaatattatctttttgttctaatatgggaccatttgcagaaatgtggtttcctgtgaactaagagaaagctgaagtgttttgacacactaaactgtactaacaacacccactgaaatgatggcactgtctttgaatgacgtttaccctgagactggagggagccactgggacatactggtacaaactgagtgttgaacacatataaccttaatggataaaaggcagggagggagggagggctagccaagcctctggcctatgtcccttaagtctcttcacctcactcctagggttcttgaataaaatgtaaaactaaggccttaaaaaacctgtagtgtgggaattgactgcaaatggaaatcagagaactctgggggatgatggaaattttcgaaaactgctgtggtgatggttgtacaactctgtaaattaattttaaaaatacagaggtatacagttctcacagattaattttataatgtgtacagtacagctcaataaaactatttggaaaaatatcctgcaggttctccccattgccttctgaacaaaggccgagttcatgaaaacatacaaaatcctttatgatacagcccttgcttaactcacttcttgtctttttttgccacctgtgttcccccagccctctgatccaccactccacctatattctatttactgagcaaccagcagttttcagaaaatctaaagtggctgcatactacagtcctatgcctctcaccctgttctctctgccttctgcctagaagtcttcctccccacagcttcctgaccaacaccaaatggggggttcaagacacagctcaacctgactactatattctaggatgcttttctgactttctgggtagaattggccatttctttttgtgttcctccagagtacttagtcattcaatgtctataaatactttttccttacaggtgacaaaagcatctgcaattctatcaaaatgtccgtgtagcaccaatcccttcctctcagacctataaagataataagcaagagtgtattgagactaacaagaaggtgacacaccaaggatgggagtaacactgagggagtctctcacatggacaattctagcagctttataaccagtctccttacagcagtcagagtgaaccctttaaaacatatctaattttatatatatatatatgaaaaagaatgtaagttttagtcagagaaaccgacagagaatttaaagcctgctccaccacttactatatatatgactatacaagtcgccccaacagtgagcacataatttcctcatctgtaaagtggaggtataactaccttacagacttttgcaaagaatcttcaagattagccacgtaaagttgtgccacttagatatgatttcactttcacttccttacttaggttgttggttcgataattgatattactgaataccagacaggctaagaaccacatcactgatttacactctcctccacatttaaccgaaaagtgaccaatcaaaaagtatcacaactcaggttgatgtgcattcagtctatcccatggtatctttgtctcttttcaaatcacaatactgatgttccaataaatgatgtttattatcaggccatgagccatcaagaaaatactaaactctgcttagaacactgtttaagaaggttggaaaatatatatcaactatagacagttttcttagaaggaaaatcaacatgttagcacataacaaattaacatacaatctgggtaactgaataatatataacggcatgcttccataatagatgaagaattatggaatctctgtttgcaatccaatgtgggtaagaagaaatgtattcattcaacaactattcaaacatttgttgaacaaatgatatatgaaaggataaaagaaccagtctagaagaggaaacttgtgatcttcaggtgaaatgcatgttacaaagcataagaggactgttattgtgttcttaatttcagaaagttaacaaaagactcagggtcagggataattaaattcataagtatgtgaaagaatgactagttccaaaacaatctaagatgaacatctcttaactgatatatggtttctattaaataggtgacatgagttaagtcatcattaactagtactttttcctcttgctatatcaaaactatcaacaaacattggaaagcctacctccaaaatgcatgctgaatctgtgcagcccactgccaccactctggtctacaccactagtctctcatatggacaattccagcagctttatacccagtctccccacagcaatcagagtgagccctttaaaacatatatcgaattatatcatgtgccaaatcaacatgtttcaaaggtttcccattgtacttagaataaaaagcaaacgccatggaccccatgatgcttacaccctggcccttgtctgcccctttatcctcattatctgccactgaccaattcatatgctcaagccagtggttctcaaagggtggtcccaggacaagaagcatcattacctaggacctttttagaaatgcagactttcaggacccatcccagacctactgaatcagagagtctgggtttaaggctcaacaagctgtgttttaacaagcctttcaatgattcagaaacactaaatttaagaattattactctagatatctgctatagtttaaatctgtctcacaaacttcatatgttggaacaatcctcaaattcatatgttgatggcatttggaggtggggcctttgggaggtaattaggattgggtaaagtcattagggtggagtccccatgaagggactaagaagaggaagagagacctgagctgacatgccctctcagcatttgatgccctccaacatatgatgatgcagcaagaaggtcctcgccagatgccagtgtcatggccttggacttcccagcctccagaatcgtgagctaaataaacttcttttctttatagattacccattctgtgtaattctgttatagcaatagaaaacagactaagacaatacattaggcttctttatatagctagaaaataccaagctcttttccatctcagcacctttgaatttactatagttctgcctagaatgtatccctcacctccaccccatgtcaccaccttgattgccccttctccatcaactgtaaaaattctacctgacccaaattactttgtatcatgctacactaatcactactatcataacacttagtacaacctgattttatttacttgtgtgttcatcttgtttgtacactaaaacatgtgctcctttagaacaaggatcttatctttatcaaccacccagtgagttacaaacagtagttgctcaacaactattaaataaattaatgaataagcccagtataaatccatttaacataaggttagaataacaaagttagaatagtgaaaaaagccaccactgacttataataaaagtatccaaattgcctgcttactatgggccagtccttgggctaaatcttttcttgtgtttttctctttaaattctccctagaactcaatgaggtagaactacaatcatcctcactttaagatgaagacgctaagatataaataagtgaaataaattacttgaggctaccaagctgatcattcgcagagccagggttcaaatccaggctgtccaactccaaagttcatacactgcacccccacccactactacctcttctgaaaaaggtatctgaccagatattttcaacatagatttcggcagactacagggataacctggtgaggaagtagtctctccaattcagatctcctacagataaaaccttggcaaaggggtactcaattctgtcaactgagtctcacaaaattataatgttaactgatgggtgtttagaggatgtacattttagaagactcttaaattgagtacagatgtttagaaaatcagtgtcaaattagaaagcattaagcagacattaaggcagaccaaattggtcttttcagaaagctgggtcaggatgggagaaatgtgtgcttgctaagtaggccaggttactcagaagtgggtcttctaactcagaaattagtgaaggcagcccagctttgccagagaatcagacagagtaagaagcctaaacatggagctgaaggattgacctacaggttttcaggtggagtggaaggaagcagattctcttgccaagaccttcacagcaacctgtagatgcagcactggaacccaggactctggcgtgttttttaaccattaacctgatgccagggatgttggaactgtcttggaactccacttttcaacagaaatttctggaagagattaaggagatcctatgccttaaaagaggaccaggacatgttcacatcatccatctgcgggtttctggaggtggggggagccaatggtctcagacttttggaaccactttattttcatttcatagtttcatcacattcggaaaggtttggtatatttcctcatcataaaaatctcattctcaaaattcctcttgaaatatatgtgttggtctccaaatgatgccacacttgtttataggactagatgacaaacactcaggtaaaggcattttactgtgtgcagcaaaatatacagaacattcactttcacaactcaagcatttatggctgatatcattaataaaacatagccttagaatccctcttaatccatcaatcagaatcaccactcaaacattatgtgcctcccatatcatgggtaattgtatggaaataaagaagtatatgaggcagtatagattgacaattaagagtttcaccctggagttacacagacacaagttcttatcttggtgttgttacttaccaaccatgagaattggaccagttatccatgccatggtttctatctctaaaatggaataaaaatcacccgtaactcattatatggaggttataagaattaaataattcaagtaaatacatagtcattattttactaaaatgtgctacgtactactctaggtgtttttcacatattaattcatctcaccctcaaacaatcttatgagatagaaaatatcattatgccccttttgaggaaacagccacagggaggggtaaaggaacttgcccaaggtcacacagccagtaaatggcagagccaggattcaaacccacgcagtctggctccagagcccacatatgtaagcactatactattaagaagacaacaattcctatacttactagcttcatgaaagtaaaaacatttgcaggttttgctttgaaagatccaagtgaatgctactagaaaaatacaaagaataatgtactttttttatcttaagcactagccaaggaaacaaagaaggagcagaattcactgtacccaagtactgtgtggttattttgatacaagtcaacaactacagcagatgctggtatccatcttcctgacaggtgacaggtagtaccaacactcttcagatcatgagacctcaaaatactcattttatcctgacagcaggggtgagaaataacatgtaaatcatcatggggagatggaggcctaagtaaatattccaggaaaagggctcctttagcataaagtagcctttttcacacttgtgcagactccagaaaggaggtgccccatggctgtcagctctggtgtgctctgcagatgactggtcttccagccaaactgttggctggcttttttctagcaattcaatctagcattctgctagtacataccccagcacaaagcgggccaggtccactttattacaaggttacaggcaagccatagataaaaagtgagtccttaaatatcagggattaataattcaggaagtaattatttttagaataatatttaatttcaggaaatatggaagttaaagctttatcctgtgcagaatgatttaaattccagcttaatttccatctactaacataattgtggtgactaattttgataaaagtactttggatttgcctaacacctctgagtgttgaattccaagggcttcagtaaatcctgggtcacaagattgctattttttccacatttcataagactttttggttaatactctaggaaatgatcacaagcaggttctcactctcctgatcaaagacatagttccacctgtgaccaacttgcttcctgactatgtcagtttcctgttgctgccttaacaaataccacaccttagtggcttaaaacaacacaaatttcttctcttagttctggaggtcagaagtctaaaatgggtctcacagggctacaatcaagatgtctacagggcagcattccttctggaggctctaggagagaatcagtttccttgccttttcaatcttctggagaccacccaccttcctgggcttgtggccccttcttccattctaaagccagtcagtagggcatcttcaaatctctcttggtctctggctctcctgcctctcacttataagcagccctgcgatgatggtgggcccacccagatgatccaggatgaccttcctatctcaagacccttaactcaatcacacatgcaaagtcccttctgccacatcaggcagcatttatagatttcagggattaggatgtggacaactgtggagagccatcatttcacttaccatattgactcttaaggctatgactcttaaagtcttttctcctaatctataaacccatcaagaatatttaagttattcttgtaactacacactaccttgttaactcaatcttattataataagctatgtcaggctatagtcaagaatattaccattataatattacctatataaatctggggatgtgaagcatagaaaagaatttttaaatctcaagttttgcatttgtgtacttatatacctaccaatttatagagtttgaaattttatagaatttgaggtttggtagataaggtcgtaaataaagtttgacgatttatatcacatcttcacttaacatatcacttcatatattttaattattaaaatgtgtgttaatgaaatttcaactgtaattaatctcctttctactgaaatggttcaatagatccatgagcctaaacaaatctccctggattttcatcattaatatttttactctttaagaataaagaatttatgaattatgatctacagtttatcccactatttcaaatgacaaaatcttgtcactgctttagctttaaaagtatgtcttcccacttttaaagcactttttctagacagccatacctactttcttcacttaagtagttgacacttatataacactacacacatatagttgtatgtgtcaacacacatgaaagaggaaataacagagaaagtgttaatctgcctatatctttgaatattatcaaagcaatttagaaagctttataactgaaagttaaatatgagaaagaaaaaagacagtttcatatcttacagacgaagttaaatagaacattctctgagcatggtttacatgtgagactttgttctaggtgctgtatgccaacactattcccaaatatatattttttcagtgccttcaaaagaggctgttatgctaccttagataaccccccttctaatctgcatgatgcaattcactgctatctgcatgatattccacttgaagtgcacagtagagcactgtgctttccatcagcaaatatctagagttatgtgggcatgaaatgtctcctccaaggagtcaacagcgacccaggaatcgttctcaactgcacccctgagctggcagccatccagtcgaggttccctagacaggcagtgttgtcactgatgttacaccaaggggcctgtgtttcagatgtttctctttctcaacaagcacatcggtgtgaactcgaaagaatgaaaaatagttccatgtgatattcatccagttgttttgttctgtaagtagcaatggttaagttacaaaccatgaatttaatgccaaactcctgtgctcaggtaggcatgacagtaaactctcaatagcctataaaaaggaagatgaaaggataaaggtaaatccaatttacacaagaatcaatactgtcatcaacaacactaatagggaaggttctatgatttttttaatttcctctttttttttagcataaaaacagaagttaatgggtccctctcagtttgggaaaatctgagtgacaagccaaaaccaataggttttgaaaggggcctgtgaataaaacgcaaaaagtgcctaattggagtcaagaaccaactcactataacaattgtagaatctagatggcaagtgtaggtgttcattatactaatcttttgaacttgcccacatgtttgaaaaaaaatcaaaatcaaaagttggaaataaaaaagtaaaatagaaaaagaaacaattcataagatattgttgaaccccatgggctttgagaaatttgcataaacttgaggcatattcaggctgaccagttagctcctctctccatatacagctccatgccaaaaaaattatataaaatctactatctgagaaaatgggaatccacattgcttcatagctcttctgaatgaacaaaatgcaactggtacagacttaaaatcgttagggaaatttccttttgcagatcatgtcatactgacatgtactagaatagcaattaaaatattctaaacccatccccctctccatgtaactatccttgtcatactctcttgaagtcagagtacaaattgctccagggctaagtgatgacagaaacatctcccaattactcctggttacacagactcaaagatgggaacaatgaagttctaatgcctacacactccttagtgaactcaaatttcctaagacaatgaatgatcaaagtagagtcttatgaaagcttctacataaaagacaggaaatgagacccaaatcaggagagttggggaagctcaggaggagggagatacatatccagccctcatttaagatcaattcatggatgactccctaaaacaccacagaaaatctgacacaatagcaaatgcactgaatgatgcatgccattcactatcacaactgagaactccaaacatttcgttgatattagaaagtgaaacaaatgttcctgcaaaagtcaaatgagaatcaaaagcaccatgtttgcactgcagcctgggtgacagagcaagaccctgcctctaaaaaaaataataattttttttaaaaaatcaccatggtttacagggaaggatactgccgtggctgcacagacctttagtgtctcaaagcattgtgcaaatacctgtgtatttctttcatgcaacatgagcattaacttgcaaattttaaaaccctctgatttatcattccaccacttcacttatttgtaaaaccaactaaaaaagtattaagaatttcaagacggcaacatgagagcatcagatcacatgcaggggctcttctgagctcgggctgttgaatccaggcctgaccatatgaactggcagagtgaaggagagatgtggggtggagtaggtcaaagatgctgcaggctgcccaaatgaaggaatgtgggaggagaaagggagcaaaagggctggaaaataaaggggtgtgaggcacgttcaaaagagcaggaggaggaagagtacctgaaggcggtatgatagaggtggagaggaaagggctagatcaggggtccgcaaacccaaggccacagactggtagcagtcaatggcctgttaggaaccagacagcaggaggtgagcagctggcaagcgagcaagacagcctgtgctctggctcctgtcagatcaactgaggcattagattctcatagtagcacgaaccctactgtgaattgtgcacatgagggatctagattgcacactccttatgagattctaatgcctgatgatctgaggtaggacagtttcatcctaaaaccatccccctgccatccgtggcaaaattgtcttccacaaaatgggtccctggtgccaaaaagttggagactgctgggctagatcatctggatgcagttcaccacccacagtgcctcaaagtcgctccttgttttctctttccctgggatcctctcaccacacgcccaacaaaggtatcactctttcatgcttgaagggccatggtcccctttttatgttttttgaacaaggagacccaaattttcactgcgtgcacactgggctctgcaaattacataagtggttttgcctagaagatttagaagatcaccagtctagatagagaattctagaaaataattcctgaggaaggtcccctttgatggagtaatcttttaaaaatttattctgtttgcagattgtctgttacctcagttaacaaaaacattgactgttaaattaaatgttgacacaaatgatcttgccatgtggaaccataacctccttttcctctgtaagaattccagcaaactaacaaattggaatctgaaagccccaggttggaaatctaggaagatgacagaaaacatcgtccttcagagtagcaattcctgaaacctcctaccctaggtccatgccttagctactctgaaggaaacacgacctttcctcaaagtaaaagagagcaaaatgtaaggaaataattataaaaattgacgcctaaagaacaaaccctgggaatctgctatccagacaccatcaagccatgagtgagtgcataccatgaaaggtttatcagcgcacggacaagggccaagagtagactagtaagcagtaccatagcagtcatgaaataagaccagatcatcatagggaaggcatggagttttcttacaattctttgctcagagctctataaaagcactaaaggggtctacatttttttaaatagtagggctatttatataatctgttaaattatatttatgattggcccccaaaaagtggctttccaggaaccttgagaaatctttttatctccaagaaaaaagagaattgaactttaatacgttttttattatttatttattttgttattatactttaagttctagggaacatgtgcacaacatgcaggtttgatacatagctatacatgtgccatgttggtttcctgcacccatcaactcgtcatttacattaggtatttctcctaatgctatccctcccccaacccccagcccccgacaggtcccagtgtgtgatgttccccgccctgtgtctaagtgttcttattgttcagttcccacctatgagtgagaacatgtggtggttggttttctgtccttgtgatagtttgccgagaatgatggtttccagcttcatctatgtccctgcaaaggacatgaattcatcttttttatggctgcatagtattccatggtgtatgtgtgtcacattttcttaatccagtctatcattgatggacatttgggttggttccaagtctttgctattgtgaatagtgccacaataatgttttttaaaagtgaaatcagtttcctgctctgccccttcccctagcaccttgctcctcatttgcataacaggtagaatgacattggccaactcccctcacagttagggtgaagtggattgactagtataccaccaaaattcacatctacctggaaaacttaagagtgattgaattattttctcaggactgccataacaaattaacacaaatttagtggtttacaacaacagaaatttattcttgcacagttctgggaactagacgtccaaaatcaaggtgtttatgggacaccttctctgaaggctgttgagaagaatccttccttgcctcctcctagcttctggtggtttctgacaattcttcatgttccatgccttgtagctgtctgactccaatttcttcctcctacttcacatggctttcttctccctatggcctcttccgatcttgtaaagacaccagtcattggatttgggacccactctaatccaggatgacctcatgttgactagttatatctgcaaagactgtattcccaaataaagtcacattctgaggttctgggttgatatgaattttggtggggacatttttttaacccagtacagtgaccttatttggaagctggatttttgcatatataattaattaaggatccagatgagctcatattggattaggatgccctaaatccaataactgatatcctaataagaagtggggagggcacagagagaaggccatgtgaagcaggaggaagagacctgagtgatgagaccagaagccaaggaatatcaagattgccaggagccaccagatgctgggaagaggcaaggaaggttcttccccagggtcgatggaaggagcatggtcccactaacccccttgattttggacttctggcctccagaactgtgagggaaaaaatttgttttaagccacctggtttgtgataatttgctgcaacaacattaggaaactaaccaggagaggggaaggtttttagctgaaaatagtctataacacttatagagttttcattgaacacgaacacacacacacacacacacacacacatacacacacaaaactaggaagaaacgcttctgttttaagacaaactccaaacatatggtcaatgctgattaaattaaatgagcatgagtcagaactacttgaattctattgaatctatgcctttagtcagctgtgtggaagaaaacatgtttgcatggactaggattaacctactagatatttcctttatttattcattgctgtatttgtttatttagtggagcggtgtttttaaaaaagaaggctctttacattgtttattcaggaaatctttgctaaagaaacaaccagctctcgacaaacaaacgattcttgaggaaattaagaaatgtaaacagagagatgcaaatgtgatgtgcaatttaaaggatttactcccagcagtgcttaggaatcaggacaggatgagggcccacccagctgagctcatcatcctgcctcagcctccattttccagaaagtctggtcacctcaggagcagtggagacccagaacttctaaaatggcttataaaggaaaccacccacaagcctaaagagaaaagaatgaacttagaaagtaagaaaaagtctccagctgcagtctcctcacagagctttgttctctgagtcctagctctgaaaagcacccaggtgaaatgaaaggccagggtcttggataataaaatatccccttccctaataaaaccaacttatttagcatcactatgtgttttttgtttttcttagagaacagtgttatatcgttagaagcacacaaagtaggacttaaaagaagttatttctggtactgtcagtaataaaatccctctgaatgatatccaatacagagctgtcttttgctgaattctctggtgcggaaaactgtaatgaactttcagtataaggctggaattggtagaaagtgctatgtgtctgtgttggttattctcagctaccctggatctgttctccacccttctctgtgcctgggggtgactgtggatgggccatcgctggctctctggccctctggcttcctgttgagtttctgttggaggcatcagcagatcagaaagtagaaagggaaggaagttagggtagatgaggcacttgtggaccataggaagctcacactggggctgacagtgacaggtgggatggcttgtctcataagcaatatcttgcctccagccctgcccgtcccactgtggcttcaccctctgccctgctgggtcaggccccccagtggtggcaacaaccccctgctgttgccagtctctgggggccttacaaggctttggattctgtccactctgcccagacgcctacagtaaagagcaccttcatcaatagccctaagttaaacccttgggcctgccttggtttccagccagagccatgaccaaaggtaataatgccaacatgtataagtcacttttaaaggtttctatgttatttacaaatcctaaccactcaaaagatgactttaccttacctgcctcctctattccacctttacctgttgaaattctgccttatccttcaagaatcatctttaacatatttttaactgcatatagtttctcaaacatttgggcctctataattttttttaatttgattattttggaccttactgcctggtgtagtggcatgtgcctgtagtccagctacttgggagactgaagcaagagaatcaggcttgagcccaggagttccagttcagcctggggacaacagagtgagaccctgtctcttataaaaacaaataaatacaggcttggcacagtggcttacgcctgtaatcccagcacttggggagggtgagacgggcggatcatgaggtcaggagattgagaccatcctggcgcacatggtgaaaccctgtctctactaaaaatacaaaaattagctgggcgtagtggcacatgcctgtaatcccagctactcgggaggctgaggcaggagaatcacttgaacccaggaagcagaggttgtggtgagctaagattaaaccattgcactccagcctgggcaacaagagtgaaacttcttctcaaaaaaaaaaaaaaaaaaaaaaagagagagagagaaagagagaaaggaaagaaagagaaaaaatagagaagaaagaaagagagagagaaagaaacaaagaaagaaagaaagagaaagagaaagaaagaggaaaagaaaagaaagaagacaaacacaaataaataatacaaaataataatgatattttggactttacttatatttccctcactttgctttattttcatttgtgttaaggtcatatcctccttctctggctaaagtctccttaagatcaatgacagaatggctctaatttctgtatctcctcccagcccagtaagtagttcagtcccagtatacatactcagtaaatgtctgctgttactgccagctacttgttttcaatgatttttccaccatcaaacccagaacatttccataaatatgcatatcaggttttatacattacatacatacatgatatattatatatctacatacacaccctaacctgaaacttttatctaatttttcttcttccatttggcgtatatatatgcacaacaatgaggtttttgccttcagtcaagtggtttctcaaacactttctacattcttacacttgggtgtctctgctaacccagaaagaattcagtgtcttccttgttctcttttcccttttatgagaccccataacgtcactcattagagctatagttagcctccgattggttaactgtcttttgctctccctggctacgataactgcggtgactagctgtgtctatgtctcagctttctcctgggcaggcactttatcttgcctgtgttgtcatttactacttacacaatcataagcaagttacctatcttatccaaaactcacatttcatccctcaactagaaaaacaagggaataacttagccattcaccaattcaattattcattaactacttattgaggactaggcactgtgccgggcacagggaagggagtgaatccaaagcagtccttccctcctgaaaggaacttgcagtccagtgggggatgtggatgaacagaaaagcagctacagtcacatgtgctatgggagacatgggcattagtgcagggcccctggggagcaaacaggaaggcccctaaactggtgggttgatgggtgatatggttggctctgtatccccatccaaatctcactttgaattgtaataattctgatgtgtcatgggagggacctggtgggaggtaattgaatcatggggacgggtctttcccatgctgttcttgtggtagtgaataagtcttatgagatctgatggttttataaatgggagttcccccacataagctttctttcctgctgccatgtaagacatgacttcgctcttcattcgccttccgccatgattgttaggcctccccagccatgtggaactgtgagtccattaaacctctttttctttataaattacccagttttgggtatgtctttatgagcagcatgagactagactaatacaataggaatgggctaggttagacttcccagaagaaggatggctaacccacactctcaattctaagctggggttcgatttaaaaaaacaaaaaaacataaaaacctcaatatttgtttgattttgagaatcattaaaataatgtcagtcacagttgcaacagcagagagatacttttcacaaccaaaattaatacaaatttgcttgaattctgctctatgtaaagagaaattatctgctttggtaagggttactatgaaacttaattcagcttcaagattaaattatcctctgctggagattcacatagagcagcaagatacaggaaaaaaatgaatttaaattataattgtacttaaaaattcaatagatcattgtgatcttacaatatttatttcatgcttaaactaccacattttttcctcacacagaggaacttttaccagcaactccaagctggatagcaaatgtggatagcaaataaggtttctagctcctcagtcctcttacttgactaataaagacaggaacactaatggaaacatttttatttttaataaatttaactattttaatgctataaatatccaacttacaaattttcaaaggttattacatatatgtcatatgcatttgaatgtgttacatactcaatttgtaagccacttaattggaatgtgacatatatcttcctatagaaatgagagttaatagtgcctacattctcaggctagccctcaaaagcctattaaacatctctttgaggaaacactgggcaatggtcaaattcagagctctggttctgatgatgtaaaacgaggttaggccctctgaggcaaagattggaaatgaggtggtagggacagagtcaagcaatgtctctgaggctctcgtgctatacaaaggaaagagctagggctttgaactcaaacagactagggtcatgtcagatttaccagttactagctctgcagtcatcaagaaattatgttctctttgccttcacatagttacctgcagaaggggaatggcttgggagcactgtgaggatgaagtaaaacagcatatgcaatgcacctccgtaaagcctgggaccgagcaggtgctcagtaaataatggctcccttccattcctccattggctttctgcacctgttacctatcttggcctatggaaaaaatgacctctgttgtagggttgaagaattaaataaagtatgtgtatgtctgtgtatatgcgtatgtgtgtggtatgtataaagccagtaagtagtaaatacatggcctagtgaataggaagaactcaataaacagtggtttgttttatttttctactagtagcatacttaacaacctgcttccttttccctggacacagcctgcaaaaattctggcacaccaattctgcagtgtgaatcattgtgtttatcctaacagacgcaaagctattgtttttagctggtaatatgttagcgggttcctattggttccagacctatctgggttaatctggaaaagggagagggaggcttctgtttccgtgagctgatcagcatggcctgaaaaaggacttggttgcagggatgagcataaagagaatgacttgttccccagtgggatcccatgcaccaggcccaagcccagtagggagaagagcagtactgaggctgtggtttcacaaggatatcctgggtatgagcaagcataggagtgaaacacttcctgtgtgtgcacaaaacacacatggctccagctcagtgacacccaagggaccacaccaggagtccatatctagccaaggaagcaatgttcctaaagaggataccagccatggtggcaacaatgaaggaggcaccagtacctggtgtttccaagtgccttggacatcagggaaaggtgggttcaaagaggaaaactatgatttgtgatcacatatgagacactcctgggacttcccaaacaaatgaggaaaggctttgttggagggcagggatgtgatgctgagacctcagtgggatgtaagccagggaaatgtgaattcccttgatgtggttcatgttgcatccataggctggtgaggtctgaaggagggtacatatgggagggtacctccaacaaataagtacagcaaccctaagtcaagcaaatgcagtcattgggcagagctcagtttcaatggcttgatagcagaacagaataaatggttacattatagctgcataataatatagtttccaaatattatgctatcaatattaataagcatgactcttttttaaacaaacacatgctgaacccttattgttcattgccacacagagaacataatgatagcttactagcacttgtcaggatcttgggtggaagacactgcataaatatcaatatagttagttgaagtgttattgttttccattctgcactggcattttatatggaacataatgaagtttttatctctaatcctcatatcaaacgatcggcacctacttggggtattgtctagaataattatattctgattagtttacagtagttgctctaaaaacatttcttatggatgcttttcatagtcaataattacttttgtgatgtctttcttccaatacatcccaacatgtactgttaagatttaagtggtttcacactaagataatataaaccaatgttgtgaatatatctcagctttctctcagagaatagctgtgactttcctccctatttgatcataacgctaccattcctgatcattcagtatgaatgtttagctcaatagataattgctgttttctggctaacatttgagtaggttggcttaaagatgtttggaacaaagcattctgggataagcaaaggatcaaagtccaagcttgactggaataaggagggcagacagggagcctagaagggtatggctgcagttacagggaattgtaagttagaagggaacaagaaagagaggcacagagatggagggcatatcacaagtctcctaagtgatcaattagaaagcaagcggatggatgaatagcctctataagtctaatttttcttattgcaaaatataaaagttatagatataaaaggcttgggtgtggaaaattaaggaaagaaattttgaactggggagtctcataaaatcttgcagaagcacagaaaacattagtaaaaaacaaatagcttgaattccaacataaacaaaagattaaatacagtaaaaaatgaatgaaacaaaatcagaaggcctaagctctgctaaaacttatcctcactttgtgatattgacacgtcttttaatctttctcagtttcttcctcatcagtaaaaagaaaatgatgaactaaagtgatcccttaacaacaacaaaagtttttataactggcgatatgcaatagccctgggttttccctttttcggcagtatgtgctttaaaaagcaaacaacccatatgtcttcccaatttccctgtgtagaagatagaataaataacctccaatgaagggcaactagaaagtggaaattccatgttgctactgaatcagtgttggagtctaatatataagtcccattttcctgtatttcctgagagtcaccaaagcagtagcaagtgcaccaagcccaaggagagctgcatacagaggcaaagcaacaatcacaatgtgtggtagaaagggtcaccaattccctgatatgctatatctaattttattttatggtcttgagtaagcccccaaatttccttatgtcttagttttctcacctggatgtgtaattcatattctcaaaactacctttttgtaaaaagataccaaaacttttttaaatactaaaaattgaggcatttcaaaataaaaagtaccaattttaagaggtcatgtgcttcatgggaatagcattgaacttggaataagaaataaaactgggtttaaaagtaggtttgctatctatgagccggatgaccctatgacctctcagttttcttatttgataagtgcaagattttaaatatgccctgcccaccccaagattgccaaatttaagtgagattatagaaggcatggctttccttgaactatatatagcaggctatgcaaagtgagttcttcgtagcctcaccataatcataattgcaaggaacctaattactttccactctccctcagtcattaagtttcacaggcccaaaaactgtgaatcaggaaccttcacaagttccccggaaggtgaaaaaaatatctgcaaaagaagtgaatccagcccaagtttcataaccttaggcaaatccaggaagagtgacggcacaattacaaagagtaactgcatagaatatctgttcagttaccactcttacctggcttgtaaaacaacagcagaaggtgttaacaaatgcttgtttaccaataagtccatactgcagcaaaattcctggccctactgaaaatgtagtaaaagcctttctacaacaacttgggtccttaaccatggaacaaaaaaaacccatgtggtcaggactgaccatgataatactaattagaaatgttttcagtcttgtataccaaacaggtctgtcctggagacaagcatctttgctagtttcataaaaatgtttgtttccagatgctattttggacatttcttctcttccatatttttattcagaaaggcagttttttgtttcccctgagtacttcctgtattccctttaactataggtgtagctactgcccaaagggttcctaaaattacagtgagaagagaagaggaagggagagagccactgcagcccctcttggtcagaggtctattttgtgaactgcttgatggacaagagagtccattacgcaatttttgttttgaagacccaaaacacaaacttgcacgcctacctgcaatgattcatcctccaccaaacctgctatgcccagaagccctgttttacagcagagaatatttcttcaacatttttccaactctacatctaaatccatttaacactaaaccatttttaaaattatgtttaaaattacaacataattatcatattatgttcctatttttgcatcaagttttttattgttgtgctttgtttgttttagtctcattgcctctagattttggctttggcaaaatttattgaattgctagttcctcgtgggcaagaatagattttctactcaactttgaaattccccaaagaacctagaagagttttacagctacacagagtgaatgctgctgagagctgacgggccaactggtctcctagcaaagggcaccaaatcttaggtccaaaacaaacaaaaagcatcaattctgaacttttatcaccattcaggccaaaaaaatgcctttgtatttgttgatggtttctggctggcccacattccctccatctacttgaagttcaggctgcctatttagagagtagaacgacccttggcaatgggtgcaggagccaaaaagcataggtttcttgggcagcctgcattactccgagagggacatctgtttagcaggaagcttccactctgtgccagccttcagaaccatctgtctctttacgcttccggacacacacacacacacacacacacacacacacacacacacttccatgcattcactgggtgtaaaaaccaagttgagagagagagaagctggcaacataggtctcccttgcaacagagcttggaggggcacacgaggaagaaacatcgtgattactctatggactttgcatccctggatggagcaaagttttcccaccccgcccatacccctccagcccagccccaagctagaacagtaacttacaggcctgaaagacttaataaagatcacccacaatgatcttcaaaactaaatttcaaggcagcagctctgatataaagtctttacacactcagaaaaatgcctctcttaaaactgctttcataagaggaaactagagaggcaaaagggaaagtgtcttttggatgggtgacctattaattacaaggattggttggtctgatgaggcgattatagaataaagtcagtgagactaaggtcacacaagacagacacatggaagccatgggctgggagcctcaaggggcttgtcctactaatgtctgtgtgtgtgcacatgtaagtgtctgtacacacctgtgaatggaaggacaggacatagaaactattgcttaaatggatccaacatctctctgctgctgcacattgtaaaactgacatccaacatgaaaaatctgtttaactgtttgaaaaatgttatagtgattttataatttataccttattttaagaaatatttgaaaactcaagaagtagtttaaaaaagagaaaagacagcaataagaaattctaaaaagaaagagggaggtgatagtaccagatatcagagatgagaattactgcaattgagcactcaatctggctctgcagtcaagcaaaaagagaataatgagaagtgacatagtcctcaccatcaaagaaaaaggaacattatcagtgcacagaaagataggtctctctggactgaattttaggaaaaatttattgcatagaaatatacagatagactaataggtgggcaaatattgacaaaacattaaataacaacaaacagtgcttcatgaagcaagttagtacagaagttttggatatgggctttttagtagacaggactgggttcagattaggaactacaacattggacaaattacttaagcacctcaagcttttaatttcttacctctaaaatggaggtgatggtacacacctctcaaggttatcatgaggattaaatgagatggcacaggtaaaggatcttacacagtatctggctagtagatgcttaagaaatgttggttccactcccatccctcacccccactcacaatggttggattcaggtctttttgtggacagaacaaaaatcagagccctaatgcccttgaagcatttccacagaaagcgtagatactacaatggtctgaataaattgccagttagaggcaacaatagagcttggagaacctggggggatggtagctggcctgtctcttatactgacaatggtgtcaacacaatgagggagttgctgaaggggtgtcaagactcagctatctggtaagtacctaaaaggtagatgctgtctgttgctcatcaaagataacttgatatttgagacacccattgtcaagcagtgggattaccattatttgagtgtttcacccagatagtggaccatcccacctacacagagagggttggctgaaggcatgattgtagataaagccatttctttgtctcaaagaaaacgtacatgtgaccctctcaaatgcttagacaacgatgaattgggattccaaaactctgcatcatagagcacgggagcataatttgaacttggaatatatgagaataaatgtcccttactttaaaaactaccaaaaagtaaaatgcctctatgtggctgttagaaacatcttatttttattttattttattttatttttatttatttatttatttatttttttgagacggagtctcactctgttgcccaggctggaatgcagtggcgcaatcttggctcactgcaatctctgcctcctgtgttcacaccattctcctgtctcagcctcccgagtagctgggactacaggtgcctgccactatgcccagctaattttttgtatttttagtagagacagggtttcaccatgttagccaggatggtctcgatctcctgacctcgtgattctcccgccttggcctcccaaagtgctgggattacaagtgtgagccaccacacccagccagaaacgtcttatttttaatagcattgtcaccagatggaaaaatgaatgcatgcattattggatgcattagtaaatacataccaatcttttaccatatgtatgactctatggtaggcctctgtgcatttattatgtcaattaattcctgcaaaggaaaccaaaggtaatataccgaatgatcattgtcaactatacttgtacacatctaggtacaactataagtttatattagtgatccataaaagaactgttaaactaaataatccttcataatcaggtatatggtctataacacagttaaagggacagaagcagaaaatgaccattagaagaaaaattatggtaatttagtcatcatatacatcatgatttgaacataactaacaatttcattaacacaaaaattctaatactaaaagttctttagctaaataattaaccaaaatttatttccacagccaaatcccagcccctggcaagttttataatatctgcacattttctcaaatgatgaaagcaaatcaacagcattaagccaaatcaacagtttaattacagctactctctatgcaaaatccactgcaaccaagcaggtcacagctgaggttgctgtgtcacctcctaaagactgggctgccagaaaaacctcagatcatttgcaagtactgaaacatgaaggaaatttggggctcagtaacagaagaactgatatacttggaacattttcagaaactctttcctatgccgacccttactcatcttcctgaagacacaaccactcattcattcagtacttctggcttgctcactgtgtaccgggcactgtgctaggcatgtggggaggggacagttgggggcagagtcatatcagacacaggcacagcccctctagaactcacagacattctcagacctaagcataaattcagggcacagtcctatggaagtaaagggcttagaatcaaaatgcagatacattaatatgcaaatgtgcttttcataagaacatatcacaggttgcacacgctcaaattacacttgggaaaatgatccaacataactgacacacactattacaactccgttcaaacacctatcccagggtcccacagccagggtaagggcaggggaactgtgcaaaaccatgctcagtagagcccaacagagcctggaaaaagcaccaggaatctgcaagacccagctctctgaccctgaagccacttcacactcagcttcaagataagcctcatatgacattgataaattattaaatctgttgattgcatggcagatcaggagccatagagtaaaaggcactctacatggatataaaaacacctttaggcaagagacagatgaactcaaggtgagatatcaacattaacacaccacatgtttttacactttaccatatacaatttcaaaacatttacaatgagacatgccttaaagttttggtaattaaggaaccctcacacacagagcagtcatgagagagattaatcattcagcaattatttactgagttcaacagctgagcatggctgttgctgggggagaaaaggagaccccaggagtggtgggaagaacaggcacaagtgctcctaatacagatttccatgcagaggcagggagttagggggagagttgagagaatcagattacaaaaacagttctgccactacctatggcacaaatttggcaagctgctcagcccctctgagctcccatgttctcatctgtgaaaagggagatacccacacctacctcacggtcactgtgaggattaaatgacagcagttatggtgacgtccggcagtataactagactgtactaatgtaaactgggcttcaccgctcaggaaaggggggagcctttctgtgcctcagatttcctcatctgtaaaatggtgataacagtctcttaaaaggtggggtaaggattaaatgagtaaattcatgcaacgagctcagaatggttggtggcatctggcgcatagtgagaactcaagacaagtaggctcctatcactgctatattcctgatgctataagagggaaacaagatggttgggggaaggtttggaaagaagaacaggatttcaccaggaaaggctggtggggtagaaggcataggcgtggagcaaagggagaaatcacagaagaggcaggagagtggtatgggagacctgagcccatgatggcagccacacccctcattatctgtttctgcttcactcagttcctgagctactcacaaacatcgcagaaccctctcaccagctcaaacacagccagaggagtggaaatcggagctttcatcatggggcaggtgcccaagatgagccctggacacgctcatgtcccatgggactcttcatatccccagccttgcccattaccacctccagcctccattctctgccggggatgtctggtaccctggaaccagagcccttttctgatgccatttagttcaagctccaatacagcccccacaccatttcatatggaatatatttacttttttgaatatatttttgcttttacagaatattttcacaggacataattttttaaactcatccctgaaaaggactactatttgctatcaaaaataaaaaggtcgagattgatctctccacgtttgtatacatgtgcctgtgtgtgtatacgtgtgtgtgtgtgtgtgtgtgtgtatgtatggggagggtggagacagcaaaaacaccaagtgaaaaaacaaggcatagaattgtacataatacaatcacactctgtaaaagaatggataggcatatatgccagcatgtgaataagcattcttaaagaatacagaagaaaatgtttatggtgatttttctttggagaataggactgagaaatctacagtggaaaaaataccaacttttcacttactgcacttttgtatgccttaagtttttactatgcatgtatactattttaaaagctgttttttaagtgagttttaaaaataaacaaaagatcccatatcaggagttgattctgatgcctaaataaaagtacgtatttctgatacatagcaagctactgataagtggcagctgcctatggctcctgttattatttgtattattatcatgtattacggttatttatgtgcatgagatcttccctgtgaggctgtgagctccatgagcacaactcccatcagggctggccctggagtaacagcgtacacaccagctcccataaaggagttcatcactgcagacttactaaaccaacacccacaggaatgaatgacctgaccagcgaccccatcattgagggagtaaatgcatccttatctccattttgcagatgacgaaaaaggtgtcatgtaaaaaagtaaaaaaaaaattaggggaggagctcaatcaaaatcaaaatcccaaggctccaaggcagaacttcccatcagcaagcattaaaacacaataggtctggctgggcacacctgtaatcccagcactttgggaggccaaggcaggtggattgcttgaggtcaggagtttgagaccagtctggccaacacagcaaaaccccacctctactaaaatacaaaaattagctgagcgttgtggcaggttcctgtaatcccagctactcaggaagctgaggcaggagaatcacttgaacccaggaggtggaggttgcagtgagctgagatcgtgccactacactccagcctgggtgacagagcaagactctgtctcaaaacaacaaaaaaccgcaatagatctgacttagtgctgaagactaagagagaccccagtaaaaactgcagtgggaactactaagatgtgagctttctaaaacaggtcaacaacactatttcattgtacacatatgtatgtaagtttctcccctgacactaatgaagtcaccctagaggcacacacacatgttcatggattacaaacatgaagcgagtaaaaaaaagaaacacattcataaatatctacagggagcacacgcaggagagtcctgctacccagccaaagcaggaggcaccatggagctggcgggctgatggctgacaagatatcacctagttgaaggtagtctcctccacatgaccttgggcaagttattgatcctctttgagcctcagtttcctcatctgtgaaaatggggtgatccaggtacctgtgatccacagagtccacttcggggattaaatgagagtataggtgaaaaagtaattagaacagcgcctgacataaaaagcacttaacaaatgttagttgtgtggtttttgtttccagtattattaaacaaaaaccatagccagagaataaacacaacacacacacaccacccccatcccaataagaattatgtgccacctcttatgaaattttgcacagatttctatcatactatttataatatatattaaaatcactggtgtacagatctgtccctcttcctttgaactgggtatttcctgaaaccaaaacaggttcttagtacctggaaagtgctcatatgtgtttgtttaaaatgtcaacatggaatgaaaaagtttaaatcatttggactaacagagtgataactacaagcaatattctgaaaattgaaattcagtttctttttcttgatatccttttagatagttcaccacaaaagtagtatctataaataaagctaacttatgctctgaggtctactaatatactaaaccatcagcactatagcttctcttgatggtcattcaatttcatttctgcaaagtttaagcctgcacatttgagtaaatgaattcaattcatcaaggagcccagcctacgacagagctactcagagatccaatcaacagcttctctctggaataaggaaatgtagactccctttaatgagttcacttgctggaatcagttctttttctcacagattagggcaatggagcacccataaaggaattgacaagggaaactctagctcatttccaggaactatgatagaattctgtgagtgaagtaactactacttcaatatctctgcgaatagatggtgagattgtgagctccaagagtgcattaatcacaaaccttattctgtttctgtatagtgcaatcacatttgtcctcagatgcaactgtgtggttcaagataaaacactgtatagtacaatgcttattgtctttaaatataagttccatccatcatggaagccagactcattcctcacctaaagccagtaatatgtcttttggataaagtacaaacttagggagttaattacttcattacattgcatggcccatccattataacaacatagctatgactggattcagctatggtagtcattcaatccaacctcatttacaaaacacagtttgtacctactgcctctacagagactgtagaaaaatggttttagaagccattcattcatgttctaggaactgtgtaatgagtgcctaccatatgtcacacactgtttcagatgctgtggctactgaaggaaagaagatagaaaaacatttttactcttatggggtttaatactcatatggagttagtgagagtagacaaaaaacaaataaacaactaatttcagataacaatgttttattaagaagagtgaggaagacctttctaacaaggtgaaatgtgaatgatgagaaaggggcatctgtgaagacttcccactgtatggaatgtaacgtggctgctctgtacgtgttcatgtggagctctgtggaagccatattgatcagtttgccacaaagccacagccaagacaggtaatgaggactcgaactcagttcctggcacccaaatccctgcatcccaagatcactagaaagatcttgtcagacttttgggtgcagtttagatacctggggaaaacctctgttgttttactgcctatgaacacaaaatggcccccaaaaaacctgaaaaaaaaaccaatataacaaattagactatttggacctctcgtgatcttattaaaaataatatcacttctctaaattttacctgaggaggagtgagctacaaaggcctggaaaaggtaaccaaggggtccatagatggagtggactcttactgcatacaggccacctggcgtccactcctcctttcctctggcagtagaatactcttcaggaactgttaagggataagcatctgtcccaagctccgctagtccaagtgagtcctgggggttgtgcaagagttactagagactttttttcctgctggatttgaacctggggtcttgtgaggcctagctgcaacagataagcctggcagagagcagagcctctttagagcagggatgtaggaagatggagtaagacacctggtctctatgccttcatctgagctcccagatcaacccaaacctaaatccaatatgctctcagattctccaattcctttgttaataaattgtgcttttatttcttataataatttaagatggattttctatcacataccacagaaatagttcaagtacacatattaggtacattttccttaatactaaattattgagaacagaatacactttttaacatatttgaagagccacttgtgaagaaatctagattgttagagaaaactgaggtctcttctgatttccatgaggtaatttatttgatacatattatgtgttcatattggtgctagctcctatggaggatgaaatggataaaacattgcctccttggactcaaagtgcatatcctacaacctagcaccgtcaccaatgttttactgatccatagcactttattggttatagagcacctttaaaacattgaacttcaggtccgtagaattagactgaattgatcaaaacccctggccatgaactctcatcattactccatgaatggcccctttttatcaagtgcccactcacatcatctcatttcacattcacaactggataaaaatattgagattctggccgggtgcggtggttcatgccagtaatcccagcattttgggaggccgaggcaggcagatcatgatgtcaggagatcgagaccatcctggctaacacggtgaaatcctgtctctactaaaaatacaaaaaattagctgggtgttgtggtgggtgcctgtagtcccagctactcaggaggctgaggcaggagaatggtgtgaacccaggaggcggagcttgcagtgagccgagatcgcaccactgcactccagcctgggcgacagagcgagactccatttcaaaaaaaaaaaaaaaaaaaaaaaaaagaattgtgatctgagaaatcacacaaacctcaccagatccagaattttaactgtgtaaaagaaggggtgtatgagtgtatattagtataaaagaaggggttcctccaatcacactagaaggaaccacacccaaatggctggtgtgtttgaagagtagaactagaatagacacttcaacactaagcatacatccacagtcctgggggttgtttctggtctactgctaatttggcatttttggatgtgcgcattttaaacaggttttgtacagattcagaatctgcatttgctaccttttttttctgcacgtactgttacttacagacacacttacatgttcaagccagacttaaatcaaatttttccagtactataaaagatatcttaaagtattcatgaaaaatatttttttcaagagtcacttctttaaaatgtcattattgcctttctttaggggccttttctttttgcagatcaataataagtctattgttcctttcttggttccattagttctgactgaaaagtcaaacaggtaagaaaagacacaggagttttatttgtttaatctggaaataaaatcacctaaaataaataccgttgaaattttttcaggtaattgatttctacttctttgcctgaaacagctctcctcttgtttttttggcatgttaatttggtggagtagtttcactttataggaacaatgctctccaaaagaattaatgttctctggcattggctgatcaatttgaaaaaaaattgtcttatttatcttaaaatagaaaatcctcccccacactatacaatacaggggtagaggatataagatgtctttttacaggaacgaaatgtttctacagtggtgaatgttcacaggggaaataagccatggtttgggtgtcagatccttcagacaccaccagtagaactgggtcagaggccctgtgtccaaggagggctccattgccaggcccatcacttacagctggtactagcagtacaagatgcagtgatgccatttcccttagaaggataagagctcaatgttggaatgtttttcttctactcataggcacagcaggaaacaaaaccgtgatgaaattccataaacaggcaagctgggtatggaagaaacgtggttgatgctggcaaagagctgcacttatggccaacaaaggtgaaaaacagagagaaattgtggcccatgaagccaccaaagacagtaaaaaagaagagtgccatgatgcaaagtgctccatctatggagtcacccaaggcaggtctaaatcttggctctgccaccctccagctacagtgctcttaagcaagacaaaagtaccaaaagcccagcatctggcatatcaatacttcagtggtagaggactccctacctcccccgttacattcactttctgtgatgctctttggtgtaatcatagtcctatgtcttccaagatttatcttaatttttatgacatttaagtacatgcaccatgactaaataagtgagtatgaaatttggaattccatcagcaacctattttttatcaaattagtttaactaactctattaggacccaaatagatcttaaagacaaatttatctggctgtgtcagagtccattgcttgccattttctgttcagtaccactgtctgtacataggccatgtgtcctaaaaaataagctggaccctcaaaaatgtcgcactaactcttttcccccaaagagccacctcagcacgtctaccacactggcctcctagctctactttttttctagcaaagcttcagcccactgacttttaagatattgtaaatcagatcagttttacaatcctgctcttgtggctgggatcaggaatatgagcaaaggaggccacgagaaggaatcacatgtgtaaaaggtggcttgaattattattttttaaaatatcatggaggcttattatgagacaaatcatcaagatagctgacaatagatataatgttcagccacttcaggtctttgccttttctgtccacactatatttatttgcacacaaataccaccaatgccactaccactgtcactagtcccaattagccttattgttctccatagcattgagcacaactagtcattccacgtattttacctttttattttctttatcttatgcctcattctaccagcatggaaactcaaataaatcattgatttgtttatttttcatttgtgcaccctcaatacctaaaacagtacgtggcacagggcagggattcaaaaagtgtttgttgactgaatggtcagatctattattttttgagacattctctctagaaagactatcatggggagtagaagctaatataataggaattttagaacaaagcatttcagagaacttttaagataagtggtaaaaatgtttatctacaaacaaaatatccagatatcaattcaagcatggtttttggtattgttttccaccattccttcaatgaatacttacagcaaaaactcctatacagctgtcttctataaccctgtggctattcagacccaatctacccatgagctacatgccagatataaaagcagctatggatgatctagtggcatttgcatcaagccccatgccactacctcactggcttagcttccaaaccactggtattttattccatgtccacctagtttctgcctcttgactgcctcccattttcatcacagcttgcatcctctgaatttgttgacttgatgctacttctaggcttgaccttcactgttcatcaaggtttctaggttaggcacgttccattaaggatcctttccacacatgtcttccttgggtagacaaaggaactcgaggtccagtctctgatgaactacactcgagtacaagtgcacctgccaggtccaccttggtccctactactgggttcagggatttaaaccacaacactatttcataggtcaccaacttgaagacacatgaaaatctggttcaaattaaccatgaactgaaggacacctccagtcaatatgtcacacataaaaatcctataggctagtgatttccagcctgggctgcaagaacatctggggaacctcagcgattattgcaaaggagtttgtgaattcatacgcacatctgcactgttagtgaactgaaaaaaaaagacatgactatataacaacatatgctttgccatgtttcagcatcaaatagatgctaccatgttttatcaaatacaagcatattgaaatgtattgattaagttacaaaagtttgtttaccttacgtgtaaatcaatagatattaaaggtccaaatgaagggttcaaaaatattttgatatcataagacaaaaaaaaggctatagattcctccaagttagataatgatgactagactcttaaccaagatacagaataatgcaagattatgggggaaaatatggcagattctgcccaaaatgaagaatcagtgactagatttatcctcccataagaaacaatctaaaaacatacaaatacataaaacaatggctttcaaaacactggacatcaggccacaaggaacaggcaatgaaggtttgcattggagatatgcgaaacaaagacagggagccctgtggttgccatagcttactgccttgggaaggtttccagggctcagtccaacacaagtaacccaggtggagcccagtgaactctctgagtcaggagatggagttggggttccaggaagaccaaggaagttagaattcacaggacagcataccagagaaaaaaagagctacataaagagagctaaatagagagatctgcaaagaatcccacttgagtatccagctaagtaaggatgaacgcatgcatatgagaaagacatggctgcttttgtactacaacatctgagtgagtagttataatggagaccctgtggtcctcaagccaaaaatttactaccttgtacttttcagagaaaaggtgccaacctgatcaacatcatacttaaaggtaaaagactgaatgctttccttataagatcagcaatgagacaaggatgtctcctcttactgctaatattcaacattattatgaaggttgcatccagtgcattaaggcaatgaaaagaaagaaaacgtatgcagactggaaaagaagaagtaaaactgtctttatttacaaacaacatgacattttatgtagaaaacctcatggaatctgccaaaaagctattagaactgatcaatcagtttaataagcctttaggatatgagatcattatataaaactcaactatatttctggatactataaatgaacaatcagaagttgaaatttaaaaataccatctatagtcatataaaaaatctgaaatgctaataaatctaacaagagattgtcaagacctgtataatgaaaactacaaaacatcgctgaaactaaacaacatctaaaataatgttgagatacacctatgtttataggtcagaagacgtgatattgttaagatattatctcctcaaatctatctatgattcagtacaatccagctataacaactgacaaactgattctaaaattcatatggaaatgccaaaggcctaaaatagccaaatcaatttttaaaaagaacaaaggggaactaaaacaatctgatatgaagtcttattataaagctaaagtaaagaaggcagattggtattagcatcaagatagacaaataggtcaatggagcagaatagagggtcttgaaacatacacacatgaatagaaaactaatttttaacagaggtaaaatagcaattcaatggagaaagataatcttttcaacaaatgaggctgaaactaccggatttccatgtgtaaatttccatattgagtttcaaaccatacttgccaccacataaaaaaatcaactcaaaatgaatcatagacctaaatggaaatcctaaaactataaaagttccaaaagaaaatgtaggagaaaatctctgtgacactacattagtgtgcaatgtctgccatagaaaagtatcacaaaccaggtcactataaaatcagaaatttattgtcttacaattatggaggctagaagtccaaaatcaaggtgtcagcaaggttagttccttctgagggcagtgaaggaaggacgtgttccaggcctctctccttggcttggagatggctctcttttccctgggtcttcacatcagtcttccctctgcacttgtgtctaaattcctcctttttataaggacaccagtcatattggattagagcccatcataatgacttcattttaatttggttacctctgtaaagactccatcttcaaataaggttacattctgcagaacaaggggttaggatgccaacatcttttttaggtggacacaattaacccataacagacatcaaaagcacaatccatacaaaaaaagaaactaataagctggactttattaaaattaagaatgttatactcttcaaaagacagggttaagaaaataagaaacaagccacagaccacaagaaaatattttcaaatcacaaatctgataaaggacttgtatctgaaatatacaaagacttaaaattcagttttaaataaattaacaattttttttttttttgagaagaagtctcgctctgttgcccaggctggagtgcagtggtgcaatctcagttcactgcaagttccacctcccgggttcacgccattctcctgcctcagcctcccaagtagctgggactacaggtgcccaccactatgcctggctaattttttgtatttttagtagagacagggttttgccgtgttagccaggatggtctcgatctcctgacctcgtgatccacccacctcagcctcccaaagtgctgggattacaggcatgagccaccacacccagccaaattaacaaattttaaatgagcaaaggatttaaacagatatttgaccaaagaagataaaaaggtaataagtaagcacatggaaataccctcaacatcattagatgttgcagaaatacaattattaagtcacaatgagaaacttttctctattagaatggctaaaattaaaaaggctgattgtgccaagtgttgacaaggatatggagcgactagaactctcatatcctgctgatgggaatgtaaaatggtacaactttggaaaaaagtttgacagtttcttaaaccattaaacatgcagctactatatgatgtagccattccacttttaggtatctcttctagagaagagaaagcctatatccatacaaaatcttgcatatgaatgttcttagcaactatattcataacagccccaaactgaaaacaacccaaatgccagccaacagtgaataaattagaatattgtgatatataagccatataatgaactagtattccacaatataaggaatgaaccattgatatatgcaacaacatggatgactgtcaaagtagtcaaactaagtgaaagaagtaagctgcaaaagagcacactatatgaatgttaatttcacataactataaagaaatacctgaggctaggtaattcctaaagaaaagaggtttagctggctcatggttctgcaggctgtacaggaagcatgacaccaacactggcttggcctctagtgagggcctctagtgaggaagtttacaatcatggcagaaggtgaaggaagaagtcattgtatcacgtggtggcaagagtgggagccagagtcaggggtggagataccagactgttttaaacaacccaatcatatgtgaactcactgagtgagaactcactcatcaccaagtggatgtaggaactaggccattcatgagggatccaccctcatgacccaaccacctcccaccaggccccacctccaacactagggattacatttcaacatgagatttggaagggacaaacatccaaacccatatcagaatctgtgtatgtaaaattctagaaaatgcaaaataattgacagtgctggaaagcagataattcgttgcctggggataggcatatgggggagagggaggcattaaaaagggtcatgaggaaaattttggaagtgatggatatgatctttatcctgaatatagtgattgctttggtgtatgcatatgtcaaaacttattatacactttaaatatgtgctatttattgtatatgtaatcaataaagctgattttaaaatatgcattccacagtcaaatgacctactatttcaagtcctggctctacctctaactttgttatcttaagcaagttatctttgagcctctcattttccagctgtaaaatgatcattcataacatacatttcacaggattattgtggatatcaactgataactaattcaatccctgaaaataaaagataatcaactgtagctattaatcataacaacaataaagtcccttgttcttagtttctaatgtcctgtaaaagcaaatttgaaagccaagatgtacaactcatatttttagaacctgaaaagctgagtcttccccactttctcattcagtgtttcagatagtgttaatatacacgagctctgataaggtaaagagtgcactggaagaaactcaaaagtaagttttttaattatctaaaatcaaattttcaaatatgagtcatgatctcccctactagaaacacaaacagtttagacaataatgaagtaccagcaaaataacactccttatgcacgtgtgtttgaaatgcttgttccctggtgccataaagaaatagtacttgaacataaattttctcagcaaggccatttttactttctgcagaaaggtacacttgccagcagttttgccacaagaatacactgaagaaaggagacagggttatttataacttgacacatccaccctactgctgtgtctggtttccattggctggaatgggacctcacattctgtatttgtcctgattggctagcaacttagaactttttaaaagaggcaaaggcagaggagaataaaggaaggacgaagtaacttgtggaatgctgagaaaggtaaaaacatctccaaataaggaaaggaacaggctatgacctaatgcttgcttggactggtataagcacgccagggcaaatattttggctaaattgtgggagctaaggacacaaagtacattgatttatttattgtggctagcagatacctaagaatgttagcacaggtctttgaatacattttgcttctaagagaagttattatttattcttaattagatgggaggaaagtctctttgaagaggaacctctactttactttttacatgtgggccttcctcagctgcagttggtaaaactgcatttccagttttaaaaaatacacacacctctcaaaagaatttcaacttaaagctcttttacatatgtgctgcttagcttagaccctcaagaaagaagacaaagaaagccctaatgagttatccctgtcccatagaccacgtgggtggccctgtggggttatgcaaagagactggtcgggatagcaccttcacaatatgtagctgaaagaccagacccagaaaaaagtgcaatgcactgcaataattggtaaacaggcaagacacacaagtattttcctgagactctggaaaacgaaataaggaaaactcacatgccaaaggtattaaatgtcaagtcagtaagaagatagtctgaaaacatttaaaagctataacgtcaaaaaaaaaaattctggtacaatgtgattcaaaagatcaccctatcacagcagtagtttctgaaaaagtaacattgttttaacgcccacaaatctagtttgtgtagaagcatacactctcaagaacttttatttactgtgtcttgaagaaatatatgtctttttttttatttattttaagttctgggatacatgtgcagaacatgcaggtttgttacacaggtatacatgtgccatggtggtttgccgcacctatcaacctgtcatctaggttttcagccccgcatgcattaggggctctccctccccttgccctccaccttccgacaggccccagtatgtgttgttcccctccctgtgtccatgtgttctcattgttcaactcccacttatgagtgagaacatgcagtgtttggttttctgttcctgtgtcagttggctgagaatgatggcttccagtttcatccatgtctttttaacgctaattggataatgtgtgatttttctaaccaatggtgctacaaaagtccctatgatctcatacacattaagtcatttgtatgtgatatggttaggctttgtgcccccacccaaatctcatcttgatttataatcccattatccccataatcttcacgtgtcaagggagagaccaggtggaggtaattgaatcatgggggcagtttcccccatgctgttctcatgttctcagttctcacaagatctgatggtttcacaaagggctcttcccactttgtttggcacttctccttcctgctgccctgccttcctgccttgccctccttcctgccttacttccctgtcaccttccaccatgattgtaagtttcctgaagcctctccagtcatgctgaactgtcagtcaattaaacctcttccctttataaattacccagtctcaggaagttctttacagcagtatgaaaatggactaatatatcatgtattcatgctaggagcaaattcaaatgagtttaaaaaaaaaaaaccacagggaggaaaatattgctgaaaaccatacaactgggaggagacactaattctccaccccaggtggcctcactactgacattgttaacgccaaatggttaagctgatgctttatttccctgtcagttaagggactacaagtaatcaatgtttaagataaaacatgcagcggaaataaaaaggacaatttatatgattcctcatatttctgcctgccccccaccccacccaccaccaacgtctagctcatggaagacaagagctagaaacaattttttgacctttgattttcaaacacaaagatgccataaagaaaaagatgtatattttttgctgataaattttgccacttggaaatttaaatcttctatacatcaaaaaattcccaaaaattttaaagaaaaatgacaaactagaggaaaacaccaaaaaaaagatacatggttaatattttagtatacaaggagctttttcatggaaatatgggtaaaaatatgaataggtaattcacacaagaaagattataataatcattgatacatgttcaatctcactgagaatcaatgagattcacactaaagtgataagaggcaggactagactccagaggcagggctcagacactggaccaaattgaggactagctaaaatagggacaaggcggaaacggctttccataagacacccatcagtatgccatgtcagtttactattgttatggcaacacccagaagttaccaccctttctctaggaatttctgcagactgctccttaatttgtatatagttaaaggtgggaataaatatgactacagaactgtcctgagctgctacttctcagcatactccctatggggtagccctgctctgcaggagaagtcacggagccataacactgctggacctataacactgccagacctataacactgccgctttaataaagctgttttctttattagagaaggaaagaattcaaaggctcacccttgaattttttccttggcaaagccaagaaccttcccagctaagccccagtgggagcttgcctaccctgaatcagtatcagagtaacctatcaattataaaacattaattgtaaataagtagaaacttcctagagaacaatttttcaaaatgcattaaaaactttaaatgtttttccatactctttacatttcttctagaggaattttttcttatcttaaagaaaacaatggaaagaatataaatagaagtatgtgcaaagatacatacatcagaacattgtttataaatgaaaaactcagaagcaacctgactgcccaataacagtggaatggttaaatcagtaatggtgcagacatgaggtagaatattatgtagccattaagaataatgctttagatatagaaggaaggaaagttagtaatgatacatcaataaagtgaataaaatcaagaatgtatatgtagtctaatcccattattataacattttttgtacagaacaaagtttggaaagctatacatgaaaattttgacaatacttctctggataacagaatttgggctgttttaaaattttcctcctcctataaacaagacacagtcaggcacagcatgatgtctaaaaacagagattctatagtcaggttgcctgagttcgaagcctgcgtccaacatttactacctgtatgacctttgccaagttaatctttccatgcctcttcatccttaagagaaaaatgaggataatagcagtacttatttcatagttactgggaatgctaaatggagatcttctagaatggtgcctaacacctaactgagactcaataaagctaatcattatttgttaacctgtgttactcatatggcaaacaataattatgagaataattatgacaaaaatgccttgacattgacaagagtgccaagataattcaatgagaaaataatggtcttttcaagaaatggtactggctgggacaagcgaacatctgtacacaaaagaatgaagctggatcacaactttacatcatatgcaaaaataaactcaaaatggatcatagatctaaatgtaagagttaaaactataaaactcttagaagaaagcataagaataaatctacatgaccttagattaggcattagtttcttagatatgacaccaaaagcacaagccacaaaagaaaaacttgataaacgggtctatatcaaaattaaaacattttgtgctttaaatgataccatcaagaaagtaaaaagaaaaagcacacagaatgggagataacatttgcaatccctatatttaatgagggactagtatctagaatacataaagaactcctaaaaattattaaaacgacaaacaacccaaataaaaaatgaataaaggatctgaatagacattccttcaaggaaaatacacaaatggttaataagcatgtgaaaagatgctcaacatcattacccctgaaggaaatacaaatcaaaaccacaatgagaccaggcatggtagctcacacctgtaatcccagcactttgggaggctgaggatggtggattgcttgagtccaagagtttgaaaccagcctgggcaacatggtgaaaccctgtctctacaaaaaataagaaaaattagctgggtatggtggtgcatgcctgtggtccctgctacttgggaggctgaggtaggaggattgcttgagcccgggaagtggaggttgcagtaaaccaagattccaccactgcattccagattccaccctgggtgacaaagtgagaccctgtctaaaaaaaaaagaaaaacacaatgagatacaacttcacatcatctaggatggcaataatccaaaaacagataataacaagcgttggtgattatgctgagaaattggaaccctcatacactattgatgggaatgtaatatgtatggtgcagctgctttgaaaaatgacttggcagcacctcaaaatgttaaacagagttaccacatgacccagtaatttcacacttaaggatatactcaagagaaatgaaaactaaaaacatacgtctacccaaaaacttacataagaatgttcacagcaacattattcataataaccaaaatatggaaacaaccacaatgtccatcaattgataaatgggtaaagtctggcaaactcacagaatggaatattatttggtggtaaaaaggagtaaagaactgatatgtactacaacatggatgaatcttgaaatctttctaagtgaaagaagccaaacgcaaaagatcagaaattgtattgtcccatttatatgaaatgtccagaataggtgaatctacacagacagacagtagattagtggttgtgtagagttatgggagagtaggaggggaaaatagggaatgagtactaataagtacaggatttctcttttgagtgataaaaatattttaaacttaaactttgagaatggttgcacaattctgaatatatgaaacactgaactgtatgctttaaatgggtgacttttatagtattgaattgtatctcattaagatgcttaaaaaatgtttttctaatcccttgacaactctgagctttatttcctaagaatgccctttgaagagccagcagtttatagtggtagtagaacaacagcttgaaaagatctcctactgtaccatggaggatacagtcatgttgctatattcacacccccaccccatgccctgactgatacattaactccttattcagtacctatgataaaccaggcatagtgctaggtaaggggcccaaaggtaatcaaaccctagtcaagtttatccttgagtagaggggcaccacaagacacattatgttgttttaaaaaaaaaaaaaaaaaaaaagcaaacatgacaaagtccaaggtccctggaagcacaaggctgcgtggtaagagaaacatcctggaagcagcaatgtgtaagtaaagaactaaaacatgattagagttagtgagaaaatgtgctgaaagaaggaatcaattgtgttctgggcagaaggaatgtgcaagggactggaggtgcacatattgtttgagaagttaaaacacatacaatatggttggtgcacacagtgttcactgtggtgaggaaaggcaagtgagtttccttataaaggccaggcataccatgctagcgagctcagactttagtttgaaaacaatgcagaaccattaaactgaaaaattacctgataacattcatgttttagaaagattattctggcttcagtacagctacatatgacttgaaggaaatacaaatggaagcaaatacctaaattaagaggccactgggaaagaaatgatagtttgaaccatgctattaatggtgtgggtgtagggaggcagctagattcaagaactattttacatgttgaacggacacaactttgtgattgactgtatataggatagggaaacaaggggagggaagggtgactcccgggtttgtggcattagcaactggatgatggtgcccttcactgaagtagggaacatacaagagcagcaaacctggaataaaaagttttaaatacattccatttggatttactaaattgaagtgtctatgaaacttctaagggtggatatataggtctgaagttcagggaaaagagcaagctggaggatgtagctttgagaattaagagtctgcagagatgagatgaagctctgagggtagctgaggtgtcagagaagggaataaagaggaacagggcagaccctatggaacatgggaaactcaggccatggagagcccatgccgggatccctcaggctctcaagtggtctctcttctaccttcagtggtcagcttggtgggccccaggataaacactgaagaaagtggtttttcattcttggcctcaggacatcctaacccttttgtgcaccttcaataagcatttgttccaagaatattgaggaaaggctatatgtcaaggactttcctgggcactgggatatgaagaagtcaacaaatcccctgccctaaaaaactctggttggtcaagggaccaaaaatagacatatagaaattcttcatattttttctcctttttggtgagaaaaaaaaatttttttaagggaaattaattttataaattctaaatttatttttttctgaaataataagcacacaaagcgacacaaggacctgaaaaataccaaagtttcataatgttctttcaaagttggccacttaaaccaaatttcatacataagaaacacagctacttgacaatcaaaacagaaagaaaacacagatacttatttttagggagtaaaaacatttagtgtaaaattgcagttacatttttctgaaaagcacactagagcctcaaatcctggtaagttgcacaatgagataaactgtattcaaacaaggcccaaaagagttcagtcagtgtcaaaaaaattttacacaaatctaaattttactctggggagcaaatcaaaatcttcccaacaacatgaggatcatatagtatttgttttcattgtgattgccaggaacatgaaattcaaagccatgttttgcattgcagaaatttctagaccctcagtctggtaacactcttttgacctgtgacatagttggggcagccatatttctctgctgccagatgctttgctacagaaacaaacaagacacaggagagaaatgccacagtgctagcatatgaggtagctacataagtgacttttagaaagagctccccaggtcactcgtctgtctcctttctaatttgagtgtgatccagccgtactggggccatccatagaactggtttgcccctcctgatagtggttctatccccagtgaagctggccactaaagactgccgagctcctgtgatctctgagccctttctgcctggattttcccacatccatagttgcagatgccttgatgtttcccaaagattttgttgtgtggaaatgaactcttgcagactctacatttattccctaaaatccagggcattgaacttctgacagctttgtaaacttttatctacaaaccccacttcactgacccctctctaaacaaattacacttagtggatgttcctagctttgagtatgttctttccacaataactttctgagaagagagaaaggtagagaagagttagaggatggcattcttgtttatcatttatcaaactcctcagtcatagaacaatttacaaaattagatacccacacaggaagtaaaaacaaacgaaatacttattctgtagttccacttgccttttaaaatagtttttttataattcagagctgtattccttggctgaagaattttgtgtaccaataaaaattatttcaatacattatttgaattccagtcacatctccctctagcattttcagtttatatcatcagctgacatctagttgatgtctatccacaggtagacaataattttccttggaacacaataattttccttaggttcacagaatcctggatctgaaactgaagtgagtcctattgccatttaggaactctacatttacatgctcctctctcaagaaaaaaaatagttgcctttcacttaaaatttctctaaaatttttgtaaaattcctctaaaagaggaatatccaataccttctgtcttaggatgttcttagtatctcaatctaacaatcaggaattttttttaattcctcatgtttaacttaagtacataattaggttgccttaggaacctacaatggctcttaattctttctactcaaagcccctattacagtgtttggtatatagtaggtgttcagcatatatttaatgagagaaaaaaatgaacagagggaggaaaggaagaaagtgagaggaaggaaaaaagaaaagaagggagggaaggagagaacaaataaacactaaaaggaatcaaacatgaatccactactaaggaaattaacaacagagtagcaagaatgttaaatggacataaataactacaatataaagtagaaagtattaaagggccacagacacaatgttggaggaaatccgaagagaggtatgaaatttctagctaggagaaatcagaagcaagtcaacagaggaggtaagacttgaggtgggatttgaagaacaggtagatttcagacaagtgatcagaggggataagtgtcccaaggagaagtcatgaatgtggaaaatcatggggtgatggggaatgaagtggtttaaggggagcacagaaggtggtatcgggcccctttagtatctaggcttataagcagaaatattaataattattcagaatatcatttgaatgaatgaataaatgaacaaacaaatgaataaacaaacaaattaacttaggcctggaactttaaagataaagcagaatatgaatgttgtttctataattattcctattgcaaattacacctctatctctgaaaaggacctcctgggaaagccttctgccatcaaattagatctacttgaaaaaaaaaattaacgacagaattttaattatttcacagtgtttgcatgtcactttattttaatcccagggatatgggaaatcaatataaaatagtttgttactttcctattaccaacacaataatccatccagtgtaattttgctttctttaccttctatttcttttttttttttttaacatttaaaagcaaaccggaagaggctttgctcccactcttcctctttcctatttgctcccaacgatttaatgcacatacacaagactggccaaccaatttgtcagtgaagtactctcctgctggcttttatggctgagttattgcctttaaagaactaagaaataggacatactgctacacaactggtcctggcagaaacgttaactctagaataagacggatagaacaaaatcagtataaaagccagtgggattagtgaaggctttaacatacagcttgcaatggttgaaatctcttatgacccatgatgttggttaaagatcatacttgctgaaaaacaaccttagccactgttactaagttctaattgggttttctctctatagctgtcaaactccctctacaatctgatgactttttttcatacttaagcgcaaatgaattttaagacatacatcacgagaacttaatctctttttaacacaggaacttgtacacaaatgttcatagcagccttattaacagcctcaaattggaaactccccaaacatccttcagggcatgaatcgtaagacaaaattttggcacatccgtaccgtggatgactatttagcattaaaaaggatcagaatactggtatctacagtttatgctgcgtgagaaaaaaaaaagccagtctttaaagaatacatgccatatgattccatttaaaaaacatctgtgaaattacaaaattatagagataaagaacagagtaacagttgtcaaggcttagggatggaggagaggggatgggtgtggccataaaatagaagtgttaccatgatggcacagtagagaggctgttgattgtggaggtaattacacagggctacacatgtgacaaaattgtcacaaatgcaaatgatgtgtgcacaactggggaaatctgaaaaagctctatggataatatcaatgttaattccttggttttgagattgtaccataatcaagtaagatgtgaaccctgagggagctggaaggtgaatacatggcatttccccatacatttctttgtgagcctctatgcatctatcattatttcaaaataaaaactttaaaatatatgtagtcaatttatatcaggatgtgtcatgaggtttctctctcctgagttgaacaatatctaacataaagctgagtgatagtaaggtccaaaataaacactgtccaaagaaaagaagggaggaaacagggaggaaggtgtataaccatccctggtcaatctaaaattgatgaaaacctgatttggggggaaatttataaaatgtctgaagttttcaatatacctttttacaataaggacattaaaatcaacattataaggcaattgtgaaaattaaaggtatatacagatatgtagatttctcaatatacatatgtgtgtgtgtgtgtgtgtgtatgtataagagagctcattttagtaagagcctgggactcaagaagtattcattctcttccaataagcaaaaaaaaaagaaaaaagaaaaataaaatcatcattatattcttaattcctcactctcttactctttcttattgcataacctcacatcttggtgaaattattttctcctccttcaacaactaagagagagcaaagattaaacacaaaatcagagctcttttcatctaggcccatctgcctaggtaggcctaagttgaatcactgaaccactgacacacagttctgtgagctctcggaagctcagaatcccacatacagtttggccacagggctgaaatgttgtagcattttatcaacaaccatgttttgaacaatttaacacccaagctctctcattcctgtctccttcccaaggcaactgcagattcctcttccctcagggaatataaccccactacctttcctcattttagggaactgtaatgacctggacagatggtaaaagaacactggaaaagtgatgtcttcaagtaccagcccaatgagggtatctactcggggggcttaaaatggaacactcaagcacgccaatgaccagcaaagcaggaaatggtcccagaatcactgacagaagaggcaaatttcccagaatacaatcccttcatgccgacccccagggtcaaagcacacagagcagaatctgggccacaagcttggaatcatcctcatgtagagttatcctcttttcagaagatgcttccccatctcaaactgggcttttatggctgagtaaaatttaccttgtgtatataatttacattaatttgtttggcaggctccaaaaaggcagtacaagcgagaggtccaacagagaggtcagacacaagtaacagcttgaaacccaaggccagggtccagatgggtgtagagacgagctggagtgggagttgagggtagggggattagcagaaaccagtggggcatgcagactataattaggagcatgtatgtatttggggcttgaagacattgctaaacagctgaaggacactgctcaggaacatgagaagctgatcccagcaaggctggttgacgtttccaagactggacagaaaacctgaggaggctgggaggagtgggcagtgccagaaaaagtgagagcagcagctctgagcaagcaagtcctaccagcatcataaatgagacgaagagctaggtttgccatggtcaggattttgccacagcagggagaggatgttaagatcagttactggctggctcaaactgacatgcccataattacttactgagcgtccatgtcatgaatggagtgctctatctgtacatacagccagaggtcatacagtgaagatagtgtccctgctccacttctctgttcacaggggagcatcttctctctttgatcataaggaagaggagcagagcacctacctagctgtgccttttcaggccaaccacgtgctggcagcgtctgttccttgtaagaccttcccaggaatctgctctgctaatgaggcccctctacctgacagctggttacacaagctgctatcagaaaacaaaagctgcctgttgaggtaaccaatatttccacacctcacacacaagcgtgtgcatgcacacacatacacacatacacacacacgcgtgcactctccccagtaaaattcagaaaccatgctcggaatgaatcaaccaccaaatggaacaaaggctgcctccaagataattagagtttggactgaactgaattttttctggcttagactcagcattcccacttctttggttgccagccccacagcctacacaataggcacatggggcaaagctggctgcagcttatagttttagatgaaatgctggtaatccatcctctggtctgccatcttctcttatccctcagtagcaaccacagaagacattcactgtcgatctcagaacatcaagaacatacctcggtccattctgctgagacaagagaattccaactgaaccactgatttggccatattaagacagtcttcaccattgcacacctattacaacggccaaaatacaaaaccctggcaacaccaaatgctgtagaggatgtggagcaataggaactctccctcattgctggtaggaatgcaaaatggtacagccactttaaaagacagtttggcagattccttcaaaactaaacacactcttaacatcagatctgggaatcatatattccttggaatttactcagataaaatgaaaactcaggtccacaaaaaatggcagctttattcataattgccaaaacttggaagcaaccaagatgtccttttataggtgaatggttaaacaaactgtggtacatctagacagtggaaaataatccagcactaaaaattaaaaaaaagagaacatcaagctatgaaaagacatagagaaaacatgaatacatattgctgagtggaagaaccaaatctgaaaaggctatatgctgtatgattccaactatatgacattctggaaagtataacactatggagacagtaaaaggattagtaattgccaggggtttggaggaggaaaagttgaataggcagagcacagagagttttcagggcagtgaaattgctttgtataacacaacgataatagatacatttcattataaatttttccaaacctgtagaatgtacatgacccaaagtgaatcataatacatactctgaacttcgggcgagaatgatctgtcaatgtaggttcattgattgtaacaaatgctccaccctggtgggcgatgctgacagtgggggaagctgcacatgtggggatgggggttattatggaaaaatatctgtaccttcctctcacttttgctgtaaacctaaaactgctctacaaaataaagcctattgattaaaacaaaaatcttcagagactgacaaaagtcaaatcaaaaatatgttgacatgcaaacttaatggtgtattgtgtgggtttctgtttgtttgtgcttatatgtgtgtttaaatagataccaagttatagcattctagaagaatgctaaatttaccaacatggaaaaacataagattccaaattcaccacaaatggaatgccactgcttcaattttctttgcaaaggcagaaaaaaaaaaaactatcaaaaatggtaaaaaaaaaaaaaaaaaaaaaaaaaaaaaaaaaaaaaagactaatgggaagaaatttttatcaatcaaaaatcaccactctgatcctctaccaagatgagcctgactgttatgagctgcgttacaaatgactgcaaaaaaaaaaacttttaaaaaaatctgctgtctattaggctaatctagtgattgccattttcctcaaattcttcatttgatgtttccaaagcaacaacaacaaaaaaatctgatgtagcaagccttacactgaaatcatattaaatcttcaaaaaccaatcagaaaaaaagcataggcaagtcttcttgggattcagacttaatcacctttaggtactaaaggtgggattagaacttaagtatgtctctaataaacaggatgatgcaaaatcaatcctggctcactgccagtcttcctcctgattgacagctagagcagggctgtccaacagcaagacaccctgaattgcagacataatttaaaattttctaagtagtcatgttttataaaataaacaactgaaattaagagcatattgtatttaactaatagactcaattatttatcattttaacatgtgaccatggtagccacattccaagggctcaagagccacatgtggctagtggttaccatattgaacagcagatctagacttccagtgtaaatctaacaggtcccaagcttctccctttcaaatatgtatttattcattcaaacacacaaagtctcttcatatgcttcattattcctactactggaggttcaccagagtcagcagtaacagtgcttgagtcacaccttcaatctatgcaaaccataagaaagattaagctctatgccaatgtgaaaaccagctcaacttcagtttcttattgttattattattattactaatttatttccagtatatatccttcccatttctttatcttaatttttattacatattgactatttgtaattatatatatttatggggtacaaagtgatgttataatttatgaaaacaatgtggaataattaaatcaagctagttaacatatccatcaccttaaatacttaattttttttgtggtaagaacgttagaaatttaccctcttagcaattttgaaatgtacaatattattaactatattcactacactgtgcaatcgatttcaaaaaaattcctcctgtgtaactgagattttgtaacctctaaccatcaattccccattccttcccttccccccagcctctgtagccaccattctattatctgcttctatgagcttcgttgttttagattccacatctaagtggaaacaattaacaaggtacggagacaatctacagacttggagaaaacatttgcaagccatacatcagataaggtattaatatccaaaatatataaggagctcaaacaattcaatagcaaaaaaacaaaaagcctaatttaaaaatgggcaagggacctaaatagatatttctccaatgaagacatacaagtgaccaacaaatacatgcaaaaacaaattcacattgttaattattagggaaatgcaaaataaaaccacaatgagatatcatctcagatggagaaaaaaggaaatccttatacattgttggcaggaatgtaaattagtacagtacagccattatggaaaactatacagaggttcctcaaaaaactaaaaatacaactaccatatgatccagcaatcctacttcctagtatttatccaaaggatttgaaatcatcttgtcaaagaaatacctgcactcccatgttcaatgcagctctattcacaatagccaagttacggaatcaaccttttcacactgtttggaaaaacaaagaatttctcaactaaagtttatctttgtgatagaataaatcaagaaataataggtgcaaagccatctagggtctgcaacaagagtggaggtaagtgtagtgaggggtgggaggagaggaaagaaggcagagaggaaagaaagaagggaggggaaaatatcacagcaggtcatagaaattacctcaaggcatcgagtttaagagcaggattcccacattcaatgactttcacccaaacaggtaatgcaacctaggtttaaaaaattgtgtaaatgttgtaaaagggattttcaaggcaatgaacattgattacatgcaccaatacatctgaaagagatagaaagcagagtttagccaatacatttgtgcattttaaagactgtcccttaataaacacaataatgagccttcttatattgctgcaacattatttatcacagtaaagaactcgaaacaacttaagtgcctatcattaagagaacatcccaattaaccgtgatttagccatactgtaaactttttaaaaagaggtacatttctatgagctgacatagaaaaatatccaagctacgggtgagtgaaaaagcaagttgctgaaaaatgcatattataacacacacacacacacacacacacacacacacacacacacacacacaaagtgacaatagctataatctctcaggaggaacctgggataagttggttgtggggatagaggaggaatcaaagaagactggacactttggtcttctcagtagtatttttttaataaagaaaatgtattcagattttacttagagaaaaagaatgattttaaaacaatagtacacaccctcaaatgtgtttatcccaaatcaaaatttaatatattgaaacccaccaaactcatgcttatgcttacctaagaatggagtttctctcaccatgtctatgaatatatttgaacacgtggatatatccttgaatacagagaaagtgttttcttgaattggttattttttaaaaaattagatcgctgaaaatcttctcatgaaaaactgaagacatcagtaggcttctacgtacatgttgatggggtttcagacacattaccgccaaaataagttacctgggcatattgaatattttaagctgaaggaattgagaaacagcatgtacaggaaggactttctgatcttcccctgaagcagggcataaaacttaggaaggactttctggtcaacttcataataaacctatttagaaacttataataaacctgattaaaaatttataaactaaatgcaaactgtggtagatgctattactatctgtgaataaagacctccttctctcctcaaggaaggactatgctcctccactccattttggacttcaccaggagatttgccttgatatatacaaccaccaagaaaaatatttaaaggtgaccaagtggtctaagtttctcttgtcactgtcctctgcaacaagaggcatatcccatagagcctttgatctattttacaactacatgaattgtggataactgataacaacatgaaacaattcctgtccactgacatgcaaatattactttctgtctcgtgaagattcagtgagcttcccttctccactatggaatgtgttttgtccttcatttgcacattccaatctatgaatgtggctattctttggattgtcatttgaacatcattggtagtcataacatcctaccagttccctcattaataatgagttaaataaaatctctaacacatgttcattttatatccaaaagagagtataattttacctttctttgaaaattatcctgggtgcttaaaatgttagataattttactatacactgattccccctaacaaccctatcttttactaatgagaaaaaggagccccagaaagattaagtaacttgcttaaagccacacactgattagtagcagagctggaatctaaactccaggtctagatgacacctctacactgcttcaagggcaacccttcagagaaaggagagaatagggtggaatcagggtattgtgaaatcacagaagtgttaacagccagttccttttttgatcatatgagggaatgaaggcacaaaagtataaagatcttggccacgttgcatagcttattataggcagggatcagaacccaaggttccttacaaccagcctgatgatcttgcgttcaaggaggaagtcaaattagactagggccttgatggataaatagaatcaacagactggcaagatgcaggaaacagaggctggacacatgtgaatgtgaggtatggaaagtaggagaggcccctctaccacaagggttctaggaaatttacacagtggggagcctggaagtgggaagagatggggcaaggagactgtgtccagacgttgtcagagggggccacaggtttgtaccgcaggagaagtactgcttgggggagaaattcctggaggctgtaaaatgagttatttgctttcccagtagtcagagactagatgcttggccacctgactttgtgcacaaccctttgccatctgagcttctgcttcacctgaggctgaaaaagatgacatccaagattccttctagggccaaaaactacaataaagtcaaaagagtagacatacttcctcataagttgatcatggtggcatactctgttataatcacatgtgttctagaaacccaggatgccacatggggcagaaaagccagaaaagcccacatggggtcctggagagaagaggctgcctcaaaggttattttggaggaggaggtggagacctcatgttctaaagaggaaaacaaacctacttgcccttgcctgactgtcaggctgtgtcccagaccagcagggacttcacagcaaggccaggcttcctattctgtgagttcctcacacccgtagagtgtccccatctctctgccactggggcataccctgctcctcacaactccgaggcaagaatcaagttcacagggcatctgttcactgctacgagtgtgtggagacagccactgacaggaacactgattcccaaaaggcacatgtaaatacaagatgaatgcaaagagaaaagtgactggactagagagaaaatatcagctctaccaagaaggaatcgtgattcctgcttctattattatagataaaaacctaccatcttatggtcacatgccgggtcttatgaaaatgagggctgtgcacacagacagtgccctctccacacctatgcaccaacctgtggagcctccctccccaaagaatggccaagaaccagggcatcagtaaccgttagacatgcagaatctcaggccccatcccagctctgcgggatcagaatccacgttttaaaaacatccccagatgatcacattaaactttttgagaagtgctgtttgtaaggttcctgtgagtaatgcagcagcaaagctcgggtacacaaggaaagactaacaagtgagcagagagctggagatggggaaagaccagaccatgaactggagatcacaagctctcttaccaacacaataattcagaaggtgacttctcaaaactaatcttcagctgagatcagctgacggagtaagaccttcccaggatgaaaggagggctgaatccccaggcagggcaaggcagaagggaaggggcagactctctcttgatggcatcctagcagaatcaattgttagttcccaaagctgtcctagaggcgtgatgctctgtggtgcatttgctatctctttgtgactcatccacagatgaatgggctcaaagaaaagggagaagcgagccatgaaatatagtaaattacagcttaatcttcctcaccctggaattcattcagtagttttaatgaacttacagtctggaaagcatgttgaagaatgtatatggaatatatttcatgccactctgagcatcaaaggagcgcaattccctttgttattaaggggataaatgtccttccttcagtcagtaccttggcaaaaaaacaaaaaacaaaaaaacctgttttccattattgctgttatctactgcaaaactctaaagaatacagattttcaagaagtggttcccgagcacagtcagcttcctgaccttgtatcttcaccctgaaccactgagacaaataggggaccctgaactgtcaccttgaaactccaccaggttctctctctgttggctacctcctttgacttgacccacagacccaagagagaaattgtcatggcttgcttctaattcaggttggaggaaaacccaaagacccctggaaggatattgagttatctccagaaaacaaaaacagtaccctgatttattaacgtacttatatgcattaatatatgtccagattagacctggacatttaaattcatccccaaaaggatatagcttatgctctgatactctactcccaccaaccattatcagtaattttcaaattatggactgctctctatcagtagataataaaatcagcttactgggttatagccaacaattttatgttaataaaatagaataggaaaattagacttaatcagtggtagtaagatgagagactgtgtgtgtgtgtgtgtgtgtgtgtgtgtgtttgcacgcataatgtaaagtgtatttttttactgtgtgtcacagtcaaaccagcatacagcacctggatatcaaccccttactggaaagagcagagagacaacatgagcaaagaactggaaaaacaggtttccttcatgaacttctaaaagcaaaatgaggaagaaattaagccctcttgtggcccaacagatgggctggagcttctggttaccctctcccctactcacatcccccactccccctacccattatggctcaatcagaagccacatcccataaatctcacaagaatgaagaaaagctgatttgtgctgcacagatttgtgcctcggacaaagatgccaatctggtggatggattccccttagcagtgaaaaaagaggctgagcgatttggagatcctattccttggcacagttttcactgaggtccccattctctacaaaaattattttccttttctccccaaggtgtgttcatggtagctcccagtcatgcttggcttcaaatgcacaaaaaatctaaacaggaattaaccaaacctccaaacagtactgatgtgaactttaatgtaaacactaagtcataatcccacctttgtcactatatcccaatacctccaaagttaaatacagaggcaaggtagcataagagttaagagattggggccaaaagtcaaattgacctcaattgaaccaagccccatcatttcctgaccttggaaagttacttatgattatctaagactcagttttctcacccataaaatggaggcaataatattatagcacctatcccagaggagttaataaaaattaaataagtgtgtaaagcatttatctcagtgccaaggacatgattatcatgcatcttcaagtaatattatggctatttttattattacaatcatactctattatttaaaggcaaagtttagtttctcctcagcctagtgacagagcaggagcattgccctcttggaaaagcaccaacattttaaagttccccttgatcaaaagccaccgaaatccaacccaaaggacatcagcctaatggctaatgtcagcatgaccataaactacaaatgacatctccaaccagaagcattccaaccctaagacaaacgcctccacaaccagagacatgcctgccccaagataaactcccctacaaccagagacattccaaccccacaataaacttctcctccacacagaaacattccgagcctgtgataaactctctcactctgaacccctaaatactcttagtctgtaagagagagtgctcctgaccaaattggccagaagcccctctcaggtttattctccaaaataaacctgtctttgactattgagctgcttttcacgtttctttcctctttctttaactcttacacctagcttgtttgtttggttgttgtttgttttgcaatcaataccaatggtataaatttaaaaggaagagaataaagaaattatattttctgatcaacgtttgttgtaaatgatttatacagtgatgggtcccaaactaaatttcccagggaattccctatttccttgcgggggtaaagagcatccgaattatttgctcattaaatgagttgccaaaagccagaaaatctatgcatctgagagttttcatctcaagagacccaggagctcgaaatcctagcagtatgaatcatctctgtccaagtgtatagagtctattagcagagggcagctcttgcttctgatggcaatggatgccagctgctgctgagaaaacaggaaaggtaatcccatgtttcagctttaacgtgcctggtcaattgtgaaaactgacttgaagggagagaaatttcatcttgacccccttggataatgaacaagaaggacagcctggcctgtgaaggaaacaccagagtggggcaagctcagagaaaattcagccaacatagcagtggaatcatgctctttaagtgtcaggccagcctcacaggtaccacactttttctaaacacaggtttctccattcacaaattgtttacttcagaaatgactttttctcctataaatggaattcctttgtctgagaaccacatacgcaagaaacaaggatgaaggaagagccatctaaactaccaggtcagctacattcattcattcattcacctgccccagcatatccatcctacgggtttactaggtaacaataggggtatggatgaggcaacagggatgtacagagaaagaaagtgcttagagtgagttgtatagcttaaatgctcatattagaaaagatggaaggtttaaaatcaatgccctacgtttcaccttaagaagttagaaaatgaagagcaaattaaacccaaagtaagtagaagaaaggaaataataaacaaaaagcagagcacaataaaacataacacaatcaacagaaaaagttaacaaggacagaagatttttaaaaacattaataaaagtaataaacaagtagcaagcttgatcaagaaataagagaaggcacaaattactaatgtcccgaatgaaaaagagatattgcagatcttacagatattaaaaagatggcaagcaacattatgtcaatgagtttcactacttagatgaaatgaacaaattccttgaaaaaccacaacttaaccaagaatgactcaacaagaaatagaaactctgaatatccctatacctattaaggcagaggttatccacatgtagctccagcagaaaggcagcatcagcaacacctgcaaactttttgaaatgtaaatccacagctctcactcggacctaccaaatcagaactttagagtgggtggggtgggggtcacagcaatttgtgttttaacagaccttgctggtaattctgataccatttgagaactgtttcaatactatcttcctacaaagacagacagatctagatggtttcactgatgcattctatcaattacgtaagaaagaaatcataccagccttacaaaagctgagaaaatttaaaaaggggggatcacatctcatcatttactgtcaatctctactcttttatggaagttgtaggagtctttattttccctgattcttattttaaagtgattcctggtttctttgaaatgggccattctgacagacaagtggtccacatagcccaaatggccacactgcatgttctcaagtagagaaaggtctttattaggtgttttctgtcttttgcttgcagcccttaggggagtgataatctagttcacgataaggtaattaaggcagggagttgcccctcacccacaaggatacccacagcatagcaatccttcccttctcttgcatacaaacctcactcaagccagagcagggactgggactcagataacaaaagcggtgataaaaatgaactatctgctcatagtattccttctaaataaaacacccataccacctttccacatctggctgtttttcttactcatccttaagcctcaggtgtcatctacagaaagacttttctgaacccccaaactaagcagatgtaactaaatctttacatctttatccaagaacttaatattgaaattctctatgactttgtacctttgtcaaataacttatattgaaattacctgtctgggtcctatatctctccaattatgtcattagctccttgagggcagaaaccacatttcattttttgttttggttttggtttaatgtctcacagtgcttgactactaattgcatagttccactcagtaaacctgtagtgaaatgaagagtctgagagtggagtcaggtcaaaatttacctccataaataaaatacactcaactcaaaacattcagtatgacttatttttaaaataagtactttcaatttgttcaatctctcagtagtattattaatgcaaaccacatggactgactttcattttgcaaatctcacctaccctttttaaatatatggtggaaacataaggtccctgcccacagatctatgcattgcagagcctactagaagataaatacagggatcaaaagaataacagtagtaggtgacacctagaatcttaggataaaagggttggatttcttcttttagcctctttatgcagacctgcaagttttgccttcacagccttgaggatcatcctgaagcatgagacacagattctcccacctccgcctattgcagaccccattccaacaaatcctccaataaatgagatcctgaagaattaatctcccgcacaagcagaataagtgcctgagggaggccaagttttgcagagagttaattatgatgaaggaagacattctgtggccattaatttttattgggagggcaggcattatattaacagctagtatatatatctagaattgggccatatagcatacacgcattgtctcatttacttatcacaaccctttgaattaggtaccattagtaagccccaccctgagaataagcttaactggccgaaaaatcacaaagtttaagtggtggaaaatggatttaaatttacatctctcagaccccaaaatccatgctctgaatgctagtgatatattgcctttttacagtcttctggtataattatgctcctacaatgttccacccaagccagtggcaaaagtaagtcactgatatcaaagaggggggatcatctaccctatgaatctgaagacaaaaagcaccctttaaacatgattcatcttcgacacaagagactaatttaagaaacatttctttctattcaaaataatgatgctaaatgggaagcgatttaagctttacaatggcttcatcagaatctcatctgtcagatctcaaaatcatgctcccagaacatgtttctcaatagaatgaatcagcaggaaagaaaagcagatgtaaagcaaacaggtgaaagtatgaagttagcaataactgtgctcatgggccaccaccaccatcagcaccaccatcatcatcctcatcaccagtattatattgttattattaagtaccttcattcccaaatagtagcattatgtcctctgaaggaatggggcttctgtttacccagcaaacaggcactgtttgcattaccttaagggttaacctactttcttgataatgggtcatgagtgagtaggggtgatcagtaaagatagtactattacaaacaacagagcacacttgtagttactaaaattatccaaaaaatcatggcaaaattatcaaagatgtaggattatgaatttggtatgacagcagaaggatgattgcacatctcacagtccatattgctcacatcgggttctcacatgctttaattgcagtgctaattctgagaattcttgattatgatctaatggtggaacacatctgaaagattaaagaactgattgtagaaaagtcaacacaaagtcctccatttatgtacataccagagtgcaggacaacggggacgaccctgtcccctggtggcagagctccgcgattcagaacctcgcagcaggaaggaacttgcctgtgactccacattcagccatgctttcagaagcactggacttttatcaatttctagggatatttgtgttgtcagggtatactaagtaggaatctattcccatttatattgtgatttgctttgtacctactaattttcactgaaatcactattataatttactgtctctacccccacaagtaagggatggaacttcatttcccagtaaatatattttgttttattgcctcctaggtaacaatgtgcaacaataccaaagtgtttcatttaagacctgtgattttgtgcttttcaggactagtaaaatacaatagcatgtggaacttatgatttctaatttgtttcagaacgtagtatactgtgtttatataagccacacaatattaacccttcaagacaactttaaaatctctttcaaagcatgattaaaagtacgtctaaaaattttccttgtgaaatgtaaatgtatctaatacacctataaaatcttgtcagctacatttatgaaacataagtcataaatttactacataaacaacaataagtcaaaatagtaacattgataacaattgctaaaatgttctttacacttactaaaagccaggatatacacttaacacttttaatctttatctcttttaacccttacaacaaacccacaaggtaagtatgttattctctttttaaagaagaaggtacagcttagaactatgtacctcaacattggcactctaacattttggataatcctttgttgtggtggaaatgttccatgtactataggctatttagcagtatccatggtctctattcacttgataccagtaatataccccatatccagaagtgacaaccaaaaactgtctgtagacattgccaaataccctcgtagggccaaatcagccaaatcacccccagtcgagaaccactggcttagagaaataaagtaacttactaaaggtcatatgcttagaatataattgaacagaagccaggcattctgacacaagaatgtatactctcaatcaatgaaatacagtgttgtttactctgtgatagtttaaagaacataaattttcctcaaaatagaaaactaaaaatgaagacaaactgtaaatgccttcccgtagaaagatattctatggccacaagagactgtgcccttccaaaattttcctttcctaattaaggtccatgtcccaatgcctattgcccttacgtagcttgatctcctgccccacctaccccaatcttctttaagtcctattccatgtgccccaaaagacagtcaccaatcccttgttaaggctgattccatgctttagtaaataagatccagactctgcctcacagagcccctgaagaacaagacctgtctgcttcctacctgttcccttagatgacccaagacttccacctgtatcatctcaaagtgtaagccttctgcatagtggtcactgaattccggtactgaagtcccaagacttcagtgactaaggactttccacacaccaaagtcttcctatgtgcctcacatagactatttcattccaggctcacaagaaccctaggaagcaaatactatttccatttaccaaaagaaacagattccagtaggcaggggaaacccacacaagcatttcaccaggttcacgacaggactcagattttaacccaagtatggacaactccaaacccctgctctgtattccaaccctatactcttccaatttcatggcagggcaaagactacagacacacccttccaaagcatgttctcatcttgccatactccctccagcttgcttagaagttcatcattccagccccctctcctcgacatcccaaatttatgagaataaacaaagcagagctgagtgtgacttcacttgtggaatagaaaagggaaaaattcaggcagtgacctcacgaactttgaaaaggcagtatcgtattaaatcagaggatagaaaaatacagaacatgttttctcttatccgattctatttttgttatttactttttttatgcataaagagttatgtattcatgtatgactgatcacatcgcttcaaagcactttagctgttaagtacgaaaatagacaattttgaaaaaagaacctggtggtggaggtgaggatttttccctttcaatcacattacttaaatatagcttgttgtttttttgttaagtcttcattaaactttcctgagagcttcaacttttaggttaaggccaaatacgaaaactttcaaacataaaatgtctgaagagaaaagaacaattggcagagtagagaaatgaactaccaaaggcagatctttttgacgttgatttattcagctttaagctgcttcatttggggaagaaaaaaaaaggaggggctccacagctgtaaaaatctataaagccaggctgagcacagtggctcatgcctatgatcccagcactttgaaaggccaaggcgggtggatcacttgaggtcaggagtttgagaccagcctggccaacatagtaaaaccccgtctctattaaaaatacaagaagtagctgggcatgatggcatgcacctgtaatctcagctactcaggaagctgagacaggagaatcgcttgaactggggaggcagaggttgcagtgagctgagatcttgcctctgcactccagcctgggcaatggagaaagactccattaaaaacaaaaacaaaaacagaaaacagacaaaaaaaactataaagccaaagggatagaaagaactcaagaaactttcagtgtctgaaaggcctgcctttaaaccctggcccgaccatttgtctgctcatttgagttacctcagatgagttacctcttttccatgacttccttttctgtaaaacaggatcattgtgaagatcaaatgagaaaatgcatgtaaagcacctggcacactgtagacacacaatagatttcaatcagtagggggccctctggacatacctatgtgcttgccaaagtttgtgctttagcaatacttttaatgtcccatgattacttctcattaattaagtgaatttagaagtattgtaaaccaaggataatctggctaggggctaaaggacaatatatatggggtacagactatgtcacctgcccagtgatctctgtgctaactggcagctttgttcttttctggtgattcagttaaacagcagagagtgcccaccatcactgcagatgttgttcagtgacctagacttcctcctggaaggacctcagtaactggaaccagagaatactgtttttgagccaaagaccacattcgttctcagattgaatctcatctctttacagacaaggacactgaaccagagaggagcaattcggcacagctaaatgtgacagaacacaaacacgattcttaatcttacctctttaccagtggttctcaactagaggtgattttgacatacacgggacatttttggttgccacagctaggggaagatgagatgttactggcatctagtgggcagaggccagggatactgccaaacatcctacaatgcacaggacagcccctacagcaaaagcatcaatagtgccatggttaagaaatgctcacctactccattggaccagtgtctccagggagtctgaaatctgcctttaaagctgctgctgctggaagttgaacttggccccagcatggcggccctcactaatgactgattcaaccctgtcaattgtgcctcttagcattgaaagccaccaggtttgggaaggatttagagatttgcctcctcaggtaacttaaagtctggacataacttttgaagcaccctgatatgcctgggcataagtgctattgacagtcctgaaaatgcacttcggtcttattaggcaatctaagaaacttactctcaaaaccattttggcaaaacaccgccaaacagccaaatgatgcacaaccacacagatacctgaatatcaaatattcagaatgatccaccctgagcaaatacatctgatactgtactaagcacctccaggattaatggcttgagtagaggaaacacagagattgaagcactgattaaagctaaaatactctcagtgtttccacccaaagcttgagttccatgttgcagggactaaaaaaagaaaagaaaggcagagtcaatgatttaagcaattatgtacttactgattcttgccatgcatgccatctgtcttgctgacctcacaggcctctacaccggccagtgtgagggtcaaatgagagtctacgtgtgggagtatgcagtgaactgcaaagccatttgaaagtatgagtcacaatccaaacttatttacccagagttccacctagtaactatgacgttagttctgacccatgatagaaatatatgaaggatcccaatctgatttattcataaaatcaatgcacatttaataaagatctgtcatgcccaatgcttttggggagcatattccccacttaaaaaaatcagtgatgccacaaggaatgacatgcaccccactaactcttatacagaattagagaagcaggaactcttttaggtggaaatacctaagaagtttccattgaaagggatggtctttgaattggatcttgaagaaaagatgggatttcaacagataaaaatgagaacatttagagtactggaaagaatatgaaagaagaaaggatcataaaaaaatcaggcaaatatgacagtcagtaaggagttcagcttgactggaacttagggtgaatggaacaaggtaacagacaaagcagcaaagtttaggtggaagcaagtgtaggcagccttaaaatccaagacaagaagataggcatttaatggccaacaggaagccaatggagatttgttgctatttttcaaacatagaaggcacaatcagaggagctgtggagaaagtaatcagacataggtatgcagcatggagaagatgaagaaaccagagtaatgaaagagattaaagaggccacccaatactctaagagacaggtgatgagactggaccaagatcatgggagggaaagtaatgtgaaggaaaagcccacaatccgttagggacccattgatcatgggcaaagaggaagaataaaaagttaaagttgaaggaacacccaacagaagatcatacaaaggggctcagaagttttgatcctggataaatggaagaatggtagtaattatcagacataaggaagatggaagagaaaagacgaatgaattgtgcctagatgatcctcttgactcagaaaatgacagctcaatgccaaggtcactcctgctactggtgtctagatacactacccagacgaagtgcctgagctattatacttactacatctcagcaccctctcatcccatgcctagttcccaggtgaaagcctctaaatagcctttctgggcctagatccctacacctgtgccctgcccccctcccaccccctcccttccccccaccgactcctgctgatacattagcaagggtaagtgagtgaatgactaagtagtgaatgagtgatggctgcctgtactctgaactctgatcaaaactatatagactctccatcactccccttcccccacccccagccatgttttacctgaaattgtagtgctttttggccctttctcacattaactgccccaggacttgcacttgcaggctaagtctcagcatccatctgtgactggggctctaaccagaccactgtggctgctataaaggcaccctgattcaggtggcaatcttggaatgtaaactggacacattctcatggctgatgcacttgttcttactactttgagactgtattattagtcatcacaaatgtaggaaaatatttgtaaagggatttatctcttggaagatcctcttgtccctgatgttaccacttaggctctgaaaatcaatactactaagtaagcagtagaatgcaggattggttgtgcattaagtttgcaaaaatgtatgatttgatttatccagtgtcacccctgttaattttcccaacaagttacttagctgccacttttaattgcaaaggtaggggacaacagtctaccaattctatttcaaaggtgctgaaagaacttcggaattaaccaatgggccttaatatatcctgggaaggaaacgggcagagttcagcagaagatgtaccacatcccatcctaggatacaactgcttagcaggcagcctcccacagggtgataaccactcgccttccctcccttcacatgtgacaatctattattaccagcaaaggtggctgttgatgatgacttattagctatgtcaattcatgaaggctgaacatgggcaggcctgactaagggaatcatttgctggatttaatcaattactgggttcatcaagtgtgattactgagccacgtcaaaatccaagtgaaataacacattagacattcatggaaaaacataactccttgctttgccttgccacagatagaggccacactattatctatatgtacaatatccaggttatcaattatctgcacatgtctgtatcctgggctgtcttcttcctaatgtctagaatatttttgagccatttgccttttttttaaaaaaaaaaaagaaagcctaaaaatcagcaaaacatacatttttaaaataactgaaaacatgaagaaaacaagaaggaaagattctgggctatcctattagacttcagtatgcccatactttcaagcaccacgaataataaacaatactggaggctcactttataatctagcgagagaagagtatatgataatgtaagtatcctcccaacagatctgattgttcccaatgaccttcaatacttatatctattatagcacttaccacattttattataatccctttgttcacctgtatctcacctacaagcctctgtacctattaacagaggcaattgtacatatcttgttatttccagtatttactgaactatatagcaatatactatagtaagtattaaataaacttttgttaaatggaagatttttgtaaagtactgtgcatgtgactatcagtataatatgattatcaaaaacatgagggacacctttgtctaaagttaattactcacagaaatatgtctagatttagaaaatgaataaatcagacacagtaagagctagaacttctacctaaactatctaaacagtgctatgattaataacaaataaacaaaaatgttcatgctaatgaggttgttcattacctggtatggcttttttaagccacaactccaactcctaaacattctgaccaaagtatttccataatccagacacatgaaaattgaacgtgtgtctgtagaactccctcaggtttgtggataggtctttaatttgtgcctctatttcttaatcccctatcatactgaaataggggtgtgtgtgtgtgtgtgtgtgcgagacagagtgtgtgtgtgtgtgtgtgtgtgtgtgtgttggaagcacctctatcatagattcagcttgcaacatcagctctgatagcaattcctttcttcaagggcagctcataagtatttggttatttctaagtatttctcaaaggtataaacttctgcaagccagacctgataacttgaaggtgaaactctattaaaagaaaccggatgagacatttatgagtaagcaggtttacagcgtaatcctctctagccgtcaaattaccatttcaccacttctgcaaatctcttggaatgattgaccctcatgaacaagattcattcacaagcaaaaggatagttccccttaaatatgtggatttaaaacccaatccaataaggttttctgtgcaaggagaggcttacctactacctattgattcccttgctaacccgataaagaggacttatgaaatcactctttctactgaaatttggtcttggaagagattagtatactctccttaatgctaggagtgagactcagtaaaatcactatcatcaaaacattcccttgggctaccaaaatatgcctcgtacttggtgaaatacttaaagaaagataactgcctcaattgtgttgtagtaggatgacaattactttgaaagctgtgggttttttttttctttaacaaggttttgataggtaaacaaatacataagtgaaataaaatgaaagttagcaagaaaagcgtaaacaaatgtagattatttttgtatcctgggctgtcttccctttgatgtccaaatcaaaccttttaatataacatttatatcacttagttttcctatattaagccacctactttatttgactaattattaactccagccaaataactgcagttagaattaaactcaccagttaagtccacattgctgtgtttattcctaccatgagaaaggaatcacagctattcccagtccaaataaaccatcaagtaggcaagcaaacattcaaacagaccattacttgactgggagtgtcaagatatatttaaaattgtctaccattcatcaaatgaggaatccacctactccaaatctacagatccccagagaaggtctcaagcaagattattctgaaaaaggctgaaggtttgctctatagattaaacaaggctggaaattttttaaaacacttcttttatcaagagatttagtctatggtccattctcttgaatgggtgggttcagtgatagcttgaccaataagacacagcagaagtgatgctgtgctcacttctggacccaggccataattaagagactagcagcttttaattcctgtctcttagaacatttgacctaagaaaccagacaagtgcaattgccctgagcccaccatgtagtaagaagcccaagccagatggaagcaccctggaggacaaaagccatgtgaggagagagggagagagagaaaaaaaatagagagggagagagcaagaaacaaaaagcaccaagactcctaacgtgagcaaagatactatcttggaagtggagtctccatccccagcagccccagttgacaccaggtggatcagattcaaaccagccagccaagtccttcctgaattcctgacctgcaaaattatgagcagaataaaagttattttaagccactaagttgaggatggcttgtaattcaatgatggatcagaagcacatggatctacttcatataaaaaatgtatttcattaaaaatagaagagctcaaactgatcctctattaattcacactttaaatgacttcaataaagcttgttcaacataattggtttatttttcattacagtgacaaaataaaaaaaggcaacagcattcacgtcagatatgcaaaaaacacactttcaaaacaaaattgacattgtaatttgaaccttgacaggtttgagcagctctcttgtaaaacttcctctcactgtctaagtatctctccttaaaataaaattgaggcaactttgaagcacctcatactccaggttaactacatgtgaaaatgataaattactttttactactcaagactactgtgccctctaatctgagtgattaatttacatcctgctcagtggttcacatgcaattactaccgtgagtccaacgaacctgaacaagacagaattgtttagccatctgtacaagctctcactatatttagaaaagtacagcaatctccaggaagctttcaagttttagttcattttcctctcaatgactcgtgcactctatgctgcatatcaaattataataccactcccttggacccaagtttgctcaacccactttattttgttgttgttgttgttttgttttgttttgttttaggcttttagcagcctgaagccatgatttttagtttctgtctatagtgataagaataaaagagggatgaggaaggggctttactggcccaaatagaaacagaaactaagaactcatgactgtattctctccactggacacccctggaggagaccatgcaacacaggaatctctactgtgagatgacgctcattagaaaaggcgagactaaagcagtgatctaaaaaatgccattgttgaaacctactggcaaattttaattgcattaatgatttttttaatctgcatgtaatctgtttaattccataacacccaagtcaagtacaatgaaagcagatacaggccgtctagattgaattgtgggcttcaaatgcttggtcagcaaaaggtctaagtaactttatttcctaactcttctcaataaaaagaataaatattacagaatataacaatggagtcaccttataataaatgtgtccttaggcaatattgacattgtgtgaaaatcattaagtgtacttacacaaacctagatggtatagcctactacatgcctaggctgttggtatagcctattgctcctaggctacaaacttgtacagcataatactgtacttggtaatgtgggcaactgtaacacaatggtaagtatgtgggtatctaaacatatctaaacatagaaaagctaatgcattgtactacaatgttactgcagctactatgtcactaagcaataggaattttttagcaccattataatcttatgggaccacctaactcaagaaaagcctcctaacatacatgaggtctacacctctagataagcctaagataatatgcttactaaaagtttatgaaagctcttcctaagaaagcatccatgatcagctggacctttagaatcccaactttgatggagagtcatagctaagtttaaagaataaagatggaggttggaagtagcaagaaatgacgctggagaaataaaagaggtcatgggagaccgtctgtgccattattgtccaatgaaatttgtgaaaacaaatcattgtaaaaaacagaaagcagtgtatacaagatgaaccaatgaatgaacaacgtgaggtgatgaatatgttaatttgcttgactgtaatgatttcactatgtgtatgtatatatatatatacacatatgaaaaaatatcatacactttagatatatatataatttttaaaagatgaacaaatgaataaattccacgaggaagtacatgacatttcctaagctcatttcattattctatcattagagaacccactcaccctctccatagtcacaacctgtatgcatgctcaaatacacatgctgctccaccaagtcagcaaactacatctgtcaacgggtcctgtaatggggaatgaaaatcgcatatgcactgaaaaatgggcttcccattggacttcggaggccatgcactcaaaaacctggtgagttatttttgaactataaatacagaagatttaagtccaacatttaatagccacataggttagggccagtgaccacctgatccctcatggctccttatgccaaagagtgcaaagcacagcccagaggcaggctgggcacatgagggatgatgacagatgtcattctagttaaaattaccctttccacagtcaaatcgaaagactgccactgcccttaaaggaatctgtgcctgtgctttgagctcaacagcattttgtcagcaaatcaggcaaaggatattctgagacaaaggagaattcagacactaaacatgttatataaagaccgctttgtgctccccatccataaaccttcagcccccgccagcctaatcactctctggtcaaggttttaggaaaatcactagacagcatggcagtaacaagcttttgagcccacaggatctactctcttgtgaaggcatccacctactgtgcctcactagatgcctgcaatcaatttttaattacagcagcagtcacgatcggagataaagcacgcaacatgctgagaaagaaccaaaagcctgtttattacagttccagtccaccatgagccagacttgtgaagagctgggccacaaatgaatcaaccagttgcagctcagaaagacgttcttacctctgggacgttttcttatatttcctcctgtaagaaaaggcataaacatatatcagaaaagggttgtggcaggcagtgggtaagaaagggattacttcagtggggatgggcatgggggtcaacacttcttaggggggtttctctgtgaagcttatgggtttcaaagcttagttaaaagtttgggaatgctgtgttatattgtagtcagaagtacagaacctaagcctttagtaaaaaatagcatcccaagagctcagtggctctgctcccatgttcttcccttttccttttgaaggttccatggcattttagttgaggtcaggctttaaagaccacaaaatctaggttcaaacctcagtccttcctttaccaggttcatgaggttcttacagagtaaatggacacaagcttacaaaacacttcttttatctggcacatattaaatgggttaaatggtgaataatgatcagttatttatgttgtcactatcgttactattatccccaacatctagcactgaggtccctttaaggatgtgcctttttaaatgtaaatgtgcaatcatgcagctaaactatgagatgagacataaggtcttcaaaaaaagaagaagtgaggaaggggacaatgagaaagtctagaagcaaatgttgagaaccagcattaggaaccatccccaggaagcagaagagacccagttccagcccacgtctgttatttacagtcatttagccttgggcaaatcttgtgcatcaggcttcttaatctatcacatgaagctagtaacatctgctctgaccatctcacctaggtcagagtggcagacaaggagaaaatggccataaaatgtatgttgtcccaatatcccaaagttcttcatatgtgtgtcaatttttgtagactctgaagacccttaaaagagtttcaataggctcagcactggaggggattagaggagaggaagtgttaaggaaagaaaatccatctccttgtagcatatccgggaagtacaatgtttcccagttgaccttagttccacaccagcatttccattacagtcactgtacccaggaagcaaaccactggtttgctaatggagagctgtgtaccatatttctttgtaaactaaagaggtttcaaattgagaatcactaggacctgttacatctctgttaaaatgaaatcacacagggcagtgtcaggtgtgtaaagcagcaagtaacacagaacctacagtgtggtcttgactagatatgtagtgatatctatttacctgaaaggagacacaccagaatgacaaccatgactccagggtagtaggatgacaaatcactcctttttagttttatgaattttccaaattttctttaaagagtgagcattataacagaaaaaaatattaaaatatggatacacctagttacatataaaggtatatacaaatataggactatatagagatatttccatgtttatattatatcacatataatagggaggaaagttgactaacagtagattaaggcttggcctttgaagcaaactatctatgttccagtcttggctctagcacttagctttacaatgctggactagttattaaatccccctgaacctcagtttctttgcatataaagtgggaagaatcagagcccctcttctgagaccttgttatgagaaataaatgagataattcacctgaacatcagctccccaagggcaagttctttgtgtggtttacctcatactctccccaaaagctatgatgcatgtgcactgatcaatcactctctcgcacctggaccctgtcaccaatgacagctcacactttccaggcagcagccaagggcagaggcttcaccttcagccatggagcatagtgagctgtgggtgtgacctgtgcccttggactcattagcacagcagtctaacaaactgatctaaggtacaactggcaagacgaaaaaataacccattgagcgtatacagggaccaaaggcaaggaggcagttggaaaagaagaatgcccctagcctctactcagaagcccaactaatcctatcagcagacagcatcttcagaggtcagaagaagacagcccttgctattggtttccacagaattctcccaatacttgccaaagaaatctataaaggcactgctgggagttctgaaagaatcaaagatgaacaaaaataagaaaagcttcattttcagcacctactagcaataagcacttaatatactttgctaatcctcataactctgtaggatcccctctctgaaagagcgcaaattctaaaaaggaagttaagacatgcacctaaagtgttattttaacaacaaatacaagggatgctttgtgaaagaggtagtcttgattgctgggtgaaatgtcagcaggaagaaatatggaagtatacagcaagcagaaacagagggcatgcctcatggtctcaaaccagtccagcaagcagggactataaagtgaggtagcaggaaataaggctggcaagtgctaaggacagagttaagtgggaagagtaataaaatttatattttagaaaagatgatacccagggggagtgtcacctcttgtgggaagccgcattacacaccctcttctgtgctcccacagcatgctgaaacctctctgacaccgttctccgtggcattgcattgtctcatgtctgattttgtggaaaggcaacagggctctggagtgtgatagacctggctcaaaacctaacttcacccacactagctatgagacctcaggcaagctctgtgctaaatcaagctttcatttctgcatctgtgaaatggatgagatgatctcaaatgagatagtgtattaaatttgtcatgtagtgtgcctgccatgtaagaggcattctaagatttttaggccccttggtccctagttctgagcttcttgaggtcagaggtctgtcatatgcatctctatatctatcccaagggcatgcacgttaactggcacatggttggctaaataaatgaactatttgcaactgtcacccatacacatcaaaagatgggttgtgcatctggtagacccaaagaaagacagaccagaagtctgattttcagtccaactcaccttcctgacacgcccctcgttcatagatatattcttagcttcagatattgtaaagtttcccccttcaatcttctcccatttagacacagccctaaaatcaacccaaatggtatcatcttacaatggagtttggaggtcagctcttaaagcacaagagaaaatgcaactcataaaaattactcaagatccaactctcagattattttgaatgggcaagattggtgaggcctgactgagccctactcatccttcagttctcaactgaaacatcacttccaaagaccttctagggccccccaaactgggtaacactccttctgtgtgtcccatagtggccagagcttacccaccacattgcacttatgactgctcatggtcatgatctgttattcttatggaaagaatgatggcttacctgacatctgctagtgtttcttccttgtcatggcaactgctcaatatgttgttattgaattcatgaatgcatttacccaaaaattgatcaaaaatgctttctttttattctttttccttctactaagcaatgatttataatgagcagtgaggacatccaccacagctgtggtttcctacacacagagggaaagcaatgagaaggctggggagctcacatttgttgagcacctcctctgttccattcctcttacacaagttaactcacttacaactcctgcaaaccctgagaggttctacctactttcgacttgacagaagtgagtctcagagaggttaagtaacttgcctaaggatacagaaccttaaagtggctgagacagaaggcaaattctgaagccttcaaagaaaattaaggaatgtatacaaagaaggcaaaagattccaccaagaaacttagacactagataaaaccaaaataaaattaataacaataaaacatactgcattctgtccaccaaaatgcaggaaatgagctggaaaaaaaaccccagtttattcttggccttctatttttaagaacttcaacagaatccctgactcgcaatctgaaagacaaagggaatttttttttgctttgttttgtttttgagagggaatctcactctgtcgcccaggctggagcgcagtggcgcaatctcggctcactgcaacctcctcctcctgggttcaagcgattctcctgcctcagcctctgagtagctgggattacaggtgcatgccaccatgcccagctaagttttgtatttttagtagagatggggtttcaccatgttggccaggctggtctggaactcctgacctcaagtgatctgtctgcctcagcctctcaaagtgttgcgattacaggcatgagccaccattcctggcttgtttttaaaatttgtttctaaaacttaatttaaatttgtaatattttgaaacttgaaacaacacactacaaatctcaagatttcatgtagctagaccaagctgatgtagaaagtagagaatgacaaagagctgttgtgttctgggacctggcaaatttggcagggtgggagatggagaggccagcttcatgctgggagagaaggcaagggcatcttcacaaggccaggctgaggacaccacttcaaagaaggtctagagtggcactttgcaaagtctgttccctggaatgggtccaccgttctctctctctctctctctctctctctctctctctctctctcactgaaacacacacacacacacacacacacacacacacacacagcttcatctgtttgtcgtttctgtttttctaaggggaggcattacagcatactgctcaagatcacttgcctgagctttaatcccttctccaacttattgtgtccgacaggctgcatgacctttagcaacttatatcacttctccaaccactggtttcctcatctgtaaaatttgggtaacagcagtgcctgctttacggggtgatgtgagagttaaatgtaatgatgactgcagggcatttagcatagtgctgggcatcctggaaatgctcaagcgtcagctactgtactaaaaacagtagtattgcataaataataatggcattataattcagtaggttttcaaaacttacttgatcaaaaatctttcattgattttaaaagtcacaaaaaaaaggttgaagattgcttttccagaatggaaaaattggatactcccaattttccttatcttggaacacttgaaccacaaagaaagcaggtgctaatctcagttctgctaagaggagaatgagctgaaacactgcccagcttttcccatgcataaggggccgtgtgcctgcctgtacaccctgccacccaccccagcaatgtcccacttaacctagcagagccacacactccccttaaatgtcaaagctgagccattgcccaaaaggcaggagaaaagaaagtaaaactggatagttatgaactggatatcacaataatccttggaaatatctaaaattatctttcaaagaaagtcctttttatcaataactccctaaaaactgagcccagtgacttgcttacacacatccttaagcagtctcaggaagttgtaactcaatgcggagatctcatgtgctatggctagaattattgattaacccatactcatttagctcttaagtaaattaaaagaccactagtcttaatgtctgtttatgtccggaatgtttcaatggaactgtggattacccaagaagtattaaatgatgcatgtgtgtgtgtgcgtgcacttgtgcacaacaggggacatgaaccccaaaacccccctcaacggcttcggtccatttacaggcagctggtcacatcctgacaggcagattctgaaataggagcatcatcaaagggcaaagagcactgacctccagtatttaaataggttccccaaagctctccacggcagtgtcataaagtggaagcttctagaccctgaacttcattttccttctcctgccctcagtcagggagataaagaatgaaactaagcaagcttaaggggtgattctgtccacagtcaggggcaaagtaaagataagcaggcaaacagcgagaaacaacagtgaggtgggagcaaggatgcttttaagggtctttatttgctttttgatggctaggagttcccagagtactgggcacacctgcagtcaaatgtaagcatcaagtactccagaatcaaacagatgatttggaaattgtttctaatagcctggataagtgagagtcgattaaacattgatgctaaattatgaagcgcctggcagtctttcacttttttaaagtgagtatctttgaacaacagccatatgggtgctgcaataatgaggtttataaataggcttaatattctaacaagctggctttgaaaaaccaaaacttgtgctctgtttctaagttgacagaaagatacctcccagttgggcacaagatttcctggtatgggaagttgaatatgcaacaactgcatacacacaatgcaaattccagttctgccttcagtgttctccagggtttctgggtaacaatgactcactcttctccaagtcctatcctgtctccattcttttctccagagaccactaccaccgccgacacacagaccgcttcggaaagcttggttctcagccctcagttctctcaagggataggacattgaaagacaggctcagataaaaacaaaatgcacagcaaggctcgtgtagttaactacaggttctcatgagtacagatcacatgtgtttcactcatgggaaagtggactgagataaaatgtcacaaataaccatgaaatgagtgaggatctgaacgatcatctgatcctctggttttgtttttcactggcatgcagggtacaggttggaaagaattggatatctctagaaacttctaatggatctcttacatcatttgtatgaattaatctacgcgctactgagaatggaaagtctttgtacatttcttctcattcctatcagtgatttcatttccatgatgcatgtattaaaaactaactttgcaaagctatccattgcttcctggcctttcccatattttgaacaagtaaatgctaatgagaaaaatatatacataaactggtggtctcttgacaccttccacaagaatatttaagggtgagaaaggagataatagagtaagagaatctcctgtcttactagctcgaatatttaactgatgagctacaaaatgaaattccatgtgcacaatgatttcattttcctgcctggccaaaagtccaaagcaagacaacaacaacaacaaaagattataaaatggaaaaaaaaaaaacctcatttttaccttgaacagcccaatcattaggaaagaaaaactaacaaaaacaaaaattctagggaatttattagctaggttttctagtagagaaaattgttctacagactcatactgtcattgaattatcttagaaaaggaagatcatattcagagatagccagctcccaaacatagaggactccagtatgtttagccaaaagtgatggatcaaattcacatgaaggaagcctttgacagtgtggtttgggggtggggatggtgaccctaaagaatgggagaatgcaaatctgaagcagagatgtaaataagacagtcaattttttactctttcttaggagcaagtgcatttctatctagtgctggccaggcagtggaaagtagagaaacctaggagaaggtaacaaactccaaactaaacaaccccacaggaagccccacctggggctacaccaactcacatggcagacccaggctgccccagtgctcctgtcctcccaaagcaagccccactcttcactgatctccctccgcatcccctcggctgcctgcagacagctggccagaaacagaaatcaaatctgctgctcatgcctgcttctctcatgagcctggattaaaaattccagcacttggactcctatttaagaagccctaaatgggacccctccccaaagaaagctgaactcttcctttggaaggcaagattttttttttagcaaaccaaacacaatttcctttccttctagctaaaagccttttgctcaaagctgggcaatgagctaatcagtggcaccaaggaaaaaacagggaaaggttttgagagaaagaaaatagaaagcaaatgtcatgcttgtggaagcccaagtagtacgttttttgcataactgatttagtcctctattcacgtatttacaaccacttgctgtgttataagtactgcaaaactgtgtgggtgggaatggaagcaatttttacgaccttcttcctgggagcccgtctcctgcttaaataaacatcagtaagaaaagctaaaagcaaaactatctcttaatatctgtgacggcactgccaaagtagatataaatccaaaggattaagacaaaatctcactcttcacagatctatccctgtaattaggggaggagtagggttttttctaattgaattattcacagagctgtttcaattctctactttgtttttccccttgtagatttagccagaacaaaaactgtaatcttctgctgaatttcacttcaatgtcagtctaatttttctaagtcttgcctacccactcctgcagtgttccttccctctccccactctgtgcccttcctcccaactcttatcaaaactgactcctggcagaaagcagctgctggtcatttacaattccaggtgaatttgaatcagtgccatggctccttgggagcatgagtccttcctatttcatccaaaatcctatcttgtagtagcatcatctatgtaagcctccctaaacacacgctctataaatctcaacaatttaaatatggcaaaatgagcccattgtccaaaatacagggaaaaaaagcgccaactagcagatgcatttcttgggaccattttgagctcttctgtcaactgaaatcagatgagcattggaagcaaattttcctgagctatagtagttaccttcactgaaactatgccaaatctcccagaaattggtgctttgaacgattctttcattttttttttaacaatgactaatttcagtcagtgattttatagtcagaatggcagttctgaaacaacatttatgaggcttgatttatgataattaatccttctatttcactaatgagctaggaaaggccttatttatgaaagtgtttaaattcctcacagttagcagacacggtttccagtgacacccacatggaatggtatactaaatgcaataaacttttgtgggtcatccttagacaaaagtcagagagacaaatgaaaacaagtggcaggatgtcagtcggaatttgaactactcctaaaacatctggaaggagctttcaaagattaatctttcacttccatatttactagatgtatctctagagtgtaggaaaagtcttggttatttaagcattttctttggttggaatctggataaacaacagtttaatggtctttggatatccaattgtgactttcagacaaaatgctccatgcactctcatactgattgtctaaattattgctcttctggtggccttaagggaaaggaaagctgtattttggcagaatattgaataccgggtccttgcaatgggtccttggatttgggtagaaatagaaggaaggccttaaagagcagagaaagggcatgaatgggcagaggtggtacagtgagtgagcgctgtggccagaactgtggactgctccaggagacaaggcccagccatatccatggaggcacctctggagcaggcacaggaggccaagccccctcaatggagcctaaactgcagaaaggcctcttgccagagccagagagcctccacgcagccaagcttcacttggcccttctgcagtgggctaggctccaggcttcaggtctcagccccatggcatgtgccctctacctcccagaaggtccgtgatgagggctcatcccatttggctccctgggtcatggcctctttctgcccttggaatactgggaatgaccatactggtttctgtctctgttccaaacctatgttttgatgggcatgataccaagtagtcaatataagtttcaagtaaagttatgattattagctggcctaagtaaatgccaatattttgaacaagtaaatgccaatgagaaaatatacataaatttttggtcttctgaaaccttccttcagactatttaggggtcacactaaactgtattctctacttacaaaatttatagatatattaatttggcatcattcagatatacacagaattttcctgcttactttgctgggctgtagattatatctccagacctgtttaatctccagactcacttatccaactgctcttgccttccccatatctcccctcatagtcagtatgtcccacactgaactcatcccatactgaactctctatcccccattcattctgttcccactcacgacaagacctgcaaacatgttcctcccttagtgatcctaatctaagaaaaaagaacctggggattcaagccaaaaccctgcgagttgaccttaattccactttcttcctcatcccccatatccaagtcctgttggatctacctcctaaaaagttctcacatccatgcctactgataatggcttccccttgctgaggccccctggtggatgaagtcggacctggctcctctccagctgtgtctggagccttcgcctccttccagtctgcgctgcagccacttggccttctttcattttctcagaggggccatgctccttcttgtctttagatctttacaggtataaacatcccaggccttaaatgcctagaatacgcttccctaactctacttaactacaatttacataatcttcatgtctcagcatgcgtctcttttcctcagagaagccttctctgaatcccggaccaggtttgggtcctctcttctatgttttcacagctccctgtgctggacttcttgcagcactcgtcacagcaggtagtaatttatggaagtattgtttaatatattcctctactgtaggctgaacatcccccgagggagggagcctttgtcttgtttcccactaattccctggtgcttagcacagcaccaggcacatagtaagtgccacagaaatatttggtaagtgaatgaatgactgaattttctgcatacagatgtgtattccttcaactatatgaacaaaactcattacctaaaatgatcaatttttatatcttctggatggaatgattctctttagttttttcataatctcacaagctaggaacatctagctttgtcttacggtcattaagactcatttattttgtttaataacagctgtcaagaggactctgtataaacagtacaataaaagcctgaagaataccaacactttacacgaattcagtatacttcctccagaaatagagtgttgcatttgttgtagaattcatttttattgctagtgggaaactccgatgatggtcattctcaaagctgtcccagtctattgtaatgtgccttatatttgttaagttggtgcaaaagtaatgcggtttttgccgctaaaactaacagcaaaaactgcaattacttttgcattaacctaataacaattatttcttttagttgtttctcaaaaatccaggagataggtcctataaacacttttcttccatgtggggaaatggaaaccaaggaaagtagtcttccatgagccaaagaaaattaaagattgaaaactagagatggtaatgcagaaacctctctgctgagggctgcttcccaactgacagaggaatgctgtaaagctcagtcaagatattaagcactttgctgctaaatattgagttgtaattaactaatacactagcataaccaaattacaataatcaagtgatgatgtactagtaagctgcatgagtattcaagtaaagaaaatttcactgtaaatgtgagaatctacttcttttgatattcacatttttcccctttaatatacattaagaatgtatttcagagagatttaacttgatctttattaagaaaagaaagactcgaaaacaatccttcaaacacaaatgtctcccttctctgaatcctagcatgtagcgtccacatcacttagtcagcaattaattattgccctcttttttgttgttgatttttaaccttttcacatgtataagacgtatcttgtttccctcaatatattctaagtttcctgatggtaaggattttcttctgatattttcgtatcccttctgaagctcctagcacctagtacataatggaaacccaataaaaatatgctgaacgatctggcaattccaattgaatgggagagtaaaaggaccagttaatacattaaatatgtaatctgggggaaacaaacaacaattttttaaagtattctcctggaattgcttttctggtaagattcaggtcaatgccctcttccctgggtcatctccttgcaaggatttaataataagaaccaagattctcagacccaccactccaggccaaaggtctctccatggctccatattgccatcaccaatagctacttgaacattccagaggctaccaatttaacatatctatacccaagtttatcattctgctttatcctagcctgctcttatctccatagtccctaacgaggcaaataacaccaaattcactgagacatctaagctgaaagaactcagaagacaacagctcctctttctctactctaaatctatgttctgtcaattctcatttcaaacatgccccctgttctttcatcttcagcagcgctaccccaaatcaggcatcttccccaactggtctccaggcctcgagtcgcatctccaatctgtcctccaccctttttccagaattacaatcctaaaattcaaatctaattttgttactctccagcttaacatcttttaacaatttcttataactgaaaggataaaacacaaacttctaaaaatattatgtatcataaaatatatatatatttctctagaagatatgaaagaacacctagaacacagcacttttttgttgtatagtaaaatgtgttcaattactcacctcctcaaactatgagcatacataattttgagtaaaacaaaaagtaaaatttttaaatgtcatgtatcactacccagcctctgccttcctttccagcatcacctctcatgactacacttctatctgtccctcagtactgcactagatgagctgcaagaggacaccacacattaagcttttaaggaaagtaaggctcttgggaattgattagtaggagaaggtaatcctgttacccagaccaattcaggggccaactacttctgacggaacggcggtgggggggggggggaggagccgggggccagtgagggggaggtggtgagatttatctccaatagctccatgttgcatgacagcaaacagacccaaccatactctctccttagggaattctcaatgagtggtgaacatagagaaggttcactagaacacaagccatatctcagttaagtgcaagcagctttgccagtagtccctaagaacatctcagaaatctcaactagtttattttgggctgcccggaagactccttgtttttctctcatctttgtaaaaggtttctttgcatttttgcaaaaggctgacatcaatgaaaagagtctaagcaagtttcttccttatgactctaatgagtctcctagaatgaatacacaattcactgtagtctgtaacaccttctctggccctcccaggtagacgtagcttccttcgcatccccctggaactatattcatcacctccaggtactcatatcagtctctgccactagccttcaaattgctgaaagttaagtaagtatcttacctacttttgcaaacccagggcttagcaaactgactggcacctaatagacactcagtaaatgttaattgagtaatcccatgttgcctgaacactaattatatcatttaaaagttcggttatatagaaagaaaacacagagagggcttaaataagaaatttaaaaccaaaggtccaggctttgttgcctatggcttttctcctcatctttgctgtgtaggttggaagagtcacttaacttctctgtacatcaatagggtattagttaagactgtttcagagaaaccaaattcaaaacatcctaagcaaaaacagagtctaactagctcatgtagctgggacagctgacagaactggagacacatctacaggaactgggacctccaggagctgacccagggattcccactccgtgttttctgcttccttttgagcactagcctcactgcctcctatcataaaaggtcttctctatgaggtgggaaatggatccaatggcagccccatgaaagtccagaagaaaagcaaagcctccctttcccacagccaatacagaaatgtcaatgagggactctaatgcttctgtttgggatccataccctacttgaaaccaacttttattacctggaaggtgaattctgtgattggccagtcctgtagtatgctggggtgaggagtagagtctgttagcatagtaaggtggatgggaagcttgctgcatagacaaaaacaatagttgttgcagtctattaacttaatagccattctcttgcctttatattaataatgttactttaggtaatgcaaaaaagcatcatcatcttcatggagtgttatataagcataaaatttattataccaactacctcatagttgggcaaaataaatatatgagattagataattataattgtgataataaatgccaaggaataagtaaaacctgctctcttgctctcagtttttaaaaaatgcagcatagaaacacgtttctgacatcatctagcaggctggcaatagaaaaactttttggtcgggacccaaggtacagtcataacccaattgctcaaacccaaggagccctatgaggcttcatcaggggtatatagaacacccacagccctgtttccctgactgaaagattctgtaacaaaaaagtaattcagagggacacaaaaaagtaattcagagggactcaaaaactctatccagtcctccagagaaaagagatatgacaacagctcattgggaggaactgaggtttatggaaaaggaaaaatgaggctcctctccaaagagtaagaggacagcatccctctgagagttccaattaagaaagctcaggtgtgcagtatttgttttcttctcacttagagaaatgggagcatgtgcgtaagcagcatcagggccacagagcaaggctgaggaccagcaccctccctggaaatcacagctagcctctgagcgttagtgtgcagaacctcgctcaaggggcatgggcgccatcatcataacagacacctgggcttgcaggtgtctataatcccagctaagatagagtgtttaaaactcacatctccaatatttgatgcactgttagtatgctgatgatgctacaatgctaagagttattcctaattctttcttagagaaatatgtaaaacagctctatgtttcaaatatgtattactgtataccgggtggaagcgtaggcactggggataaaaagcaaaccaaaagcaagtgaccaaagcaaaccaaaaaccctgtcttcatggggcttatattctagctggaggagacagacaataaacctaaaaataaataaactatacagcattcggatggtgggaagtgctagagaaaaataaagcatggcagggtatgggtacgggttggaatgtataggggacacctccctgcaatatacttggctgttgattatttgcaggtgataaccacagaaatcctcttgctctggtaaagactacctctcaccagtgtgaaagaggggctataaagaagggaaagagaaagcccacatgatcaccacagtgggattcagccctgggccacaactctgccacacatcttgcccatttcccacctcagtttagatttctgtgccccaacctgggcaatgatgttaataaaacctgcatcctagctagctcatggctcattgtgttgacaggtctcacggccataagctgtcctaaatatatatttatcttcattttgaatatttaaaagctcacatttgggtttttatgcttcaccacctattgattgagcatctactatgtgctaaatgctgttctaggtattgcagtgagtaagtatgtgtcctcatggaacttacattctaatggaggagatgaaaaattcaacaataaattaaatacgggcgataccaacaagaaggagatgcgataacattgaataatccaggcgtgagttgatgatcacatcctgaagtgagatgtctctcagacaagctgaactgaattcctgaccatctgtggtcacctacagagccctttctataaaggtgtcatggtaatatattggtatgaaaatccaattatggtttgaggctttctaaaatgttgaaagagcagcttcctttctcttactgacaatctgttgtgtggacaaatatgcacacacccttccttcccctaagggtttctattttgtggacggcaaagtgttattccaagttgtggactgcaaaaatgttattccaagttgtataaaagagtgtgtgctttggtttccagagtctttagctatttattctagcactgctgttatgtttaaaaagaagaagaagaagaagtggtaaggatcacatactggtaaaaatatgtataataataacaaataatagcatctccttttcaaattagaaagtgaagctataatcaccccacacttttcatgttcaaaagcactaggttctgagtagatacaagagactagaaaatgaaaatgtagttacattacactgcaacaccttggagagagaagcctagcagatatgaaactgagaaagctacacgacgcagtgttgtaagtgctaatgcttttccacacaagttcccgcctcagcattgctgatttgaccaaacacttgtctctagcccaaatgtctccatggagtcggtttaaattgaaaagcagtccaagagaagaagttcctgggtgtatggatatgaatccctctagtcagcatggcaaggaatccagctcgacaacgctttcacattatacactttgggcccagactttgtggacacaacaaactttctgtgtgcagcacaatacaatcggacgtaatgttcactaaatataacatgagattactgtaaacaccactccgagagctgctgcgttgcaggcatctaaactgtcaggaaagcctgccagccagagacaaggtttccaaataaatttacagtctccactagcggtggctagacaagtcaaaaatcaaattatttggcatggtttcccattgaaatcaatggcaatgaagctcacttggactatatatggaatggcttttataaattgcacctgtcaataaggaccccttaaagaaacacatactaccttaatgcttctccttagaaactttgaatatcaagctaacttagatcaacacattttttatttgtcttttgtttgtgtgtgtgctttcaaaaacaataacagcagcaaaacaaacaaactggcaggaagctggttttcccatcagtgcccttgttagaaacagaatgtctagagaatatgcttggagaaaagccatatttttaaaccacactagatatctgatgccaaatgactgatgaaagtagtatctagtagtaatggaaggtgtctttgggacctgcccagtgactgaggagcaagctgtgaatatacagctatccctcaagctcctgactggagtgaccagcagttcactgatgatgaaatatttttacagaaaataccatgtattttcaggtcacctctcctcagtacccaaaaacagacagaacccaatgaagtgaatgaaattcagagatctccatccatcagggcaactagaattctggccactctatttcattgttcaaatattgcaagaaaaccccaatatcgtttctgccccccctttctccacaagagcctttccttctagtaaacatttctccaccaaaaagaaccccaggaaatatcagaagttcgactgggctaaggagagggaaaaaagaaatgtagcagccagaatgcatgttgaattttaactgttggtaagttcttggaccacctgcccaagtgtatgcaagcagtttgcagagaaaaattcttccttcaattaaaagtccctgtctgggtctcaaacttttctccctgggcaaaaaggatcagaaacacctcattgagtattgggccaccataactgactcatcaaaggacatctctccttccccccaaaaaagcatgacttggaacagcaaggcattctaagacagaaagacaaccctctctgtgttggaagaaaagtagcagtgactgtaattaacagagcagcagttgtggaacttctagggttgtatttaaaggcccatgcaggaacagggtgagcagtcgtgactgcggctgtgtggtaaaataaggatgggagcgggaaatggggcaggagaagtaaataggtatacttacagcccgcggagccgaagccagattttctcgatctgttccggttgcaggtatttcagagagttgctctcaaattcttcaatctccttggttggcgactccatagctgcaggtaggtgaccactggcggtgaagctgagatagtttgggctgtcccctccccgtctcctcgcccagctcgcgatgcccagccaggcgcggcgcgcgtttgcccggcactttctcggcgcgctcccccttctgcgcccccagactccgacttagagcggactccgatcgcggcaaaccatggccccaggtgcgctccggaggcagctgcgggaaccagccatggtcccgggctaatgcccagggataagcacagggatagggatagagatagggattgggattggactccagctccaagagaaagcacctcgggtctattcgtattctccccctacccccaaacaaagccacagaagcgatcagcgcgcagctaaagggtttggaggtgaaaaggagggctgggtggggaggagagaaagtgagaagggagagaaaagcggcggctgagcaaagc

SEQ ID NO: 55 - DNA, 318349 bp, Homo sapiens
gggggcaactaacttttagagattgaaaaaagtggcaatgagaggaattttatttttttttaagtttgtgtcattttaattttggtccaatttagacttttagagacttataccataaaaacacccctcttgctagtttgttgctggcgtctgggctgatcccacatacagcaattgaaaagtctatacaagaacaacaaagaggaaaatcacatacaactttcatttcaccttggtggagtcaaccaggatagtacctgctccaacagcctccaagggtcttggaggtgtgtcctgctgtggccagtgggtgctgagaagcagataggtagaccctccttcactccctctcttcttcccctcggcctattttctgttccagttatgtgagatgttctgaatctttttcattttgatcctctgatccagcatcttgtaccttgcaggatgctcatcagttttctttgagactgaaggtgcataggagctagatgcgtaagcagggcgtttaaaatgacgcaaaggaggcttgatgactggcggccatggaaaggaagacagacaacggttagcctcacccacgacatgccacaacctaaatattgtgagcaacttcctctagacctgtttgtttcctccaagaccaggaaagaagcagtttggattctccctggaaaccttatggcagatagatgaataagcacgttaccaccttggtcattcagttaaaataaataaatggaagaaatttctagagatacagtgataactgcagtacataaaggtcctttgacaatgaatggatggggttaagggagtgagaggaagcattggggtcatttctgggaacagcaaagcaaacaaggtgaacacaggtatatcattaacagcatttagcattgtatgtaagcttttagtgtttggaaagtggcactcaatccccaagggatacttaaaagtgcatcattaagaaaatatttataaaacacatataaagatcttgtattcaaaatataaaaagaattcttaaagctcaagaaaaagaaacaacccaattttaaaatgggcaaaacatctgaacagacttcacaccaaggaagatgtatgtgtcaaataagcataggaaaaaatgctcaacaattagagaatttcaaattaaaacaactatatgctactacacacctccacaatgctaaaatctaaaaaacttgacaacaccaattgctggcaaggatgtaaagtaatgggaactcccattcttgctgattggaatgcaaaatggtacagccactttggaagacagtttgaccgtttcttatgaagctagacatagtcttaccatgcaatgcagcaattgtgcatcctaggtatttacccaattgatggaaaatgtatgtccacataaaaacccacacatgaatttttgtagaatctttattcataagtgccaaaagctggaagcaactaagatgtccttcaatagttgagtggataaacaaattgtgatacatttatacaatggaatattattcattgtgataaaaagcaaattaactatcaagctatggaaagacatgaatgaatcttaaatacatattgctaagtgaaagaagtcagtctgtaaaggctgtatagcatatgattccacttatacgacattcttcaaaggacataactatagagatgataaaaacatcagagattgtcaggcgtttggaaagaggagggatggttaaataggtgaagcacagggaatttctagggcagtgaaactctcgcatacaatactgtagtggtgtatatatgacactacacatttgtcaagacccatacaactttatagcacatagaataatccttaatgtatgcaaataaaaaaactatttaagaggtcggaggaatcctagaatgaaatgcaaattgtaacaagacaatgtaaatgcattgccaatgtaggaaacaacctcactgaagagtgggggacaagacggtcatcgaagtaaccttgtatatgaacagaatctgcaagactaaaggccgaagaagctgtacacaagcactctattctagctgataaaattgtttcccatggggctattggttatcaactctaagaccactctacatgtataccagaattcaacaattacgtaaacagagggtggatggtgagaaatgttggaggaggttagaatggtccatgtggtaatgaacttgattatatcaatatgaattaatatttagcttaatagagatacaggtgattatatataaaatacttatagatatgtgtatgtacatgagttggcattcacacatatattgtcttgctctatcagctgaaggggagggggtctaggaccaacgaagtcactacaaatctagaagtctcagcagcaataagcacatctactgccctgatcttggtttctaaaaccatttgctaatagcagaaaccagggctccttgcagaaatgactgattccagaactcggacacaaaatatacaagaagtacctgaagcatcttgtagagccagaaaatttgaagtgttcaaaaaaaacaaaacaaaacaaaacaaaaaacaaatacaacaatagacaaaggagccctgaatgaaagatctactgaatgatcaaaattgaatcaaattgagcaacaaaataaacaaggcagtattgcattttaacccgaagtataaaataaatatccatgagtccacactgatataaataaatgattgaataaataaataattgtgggagaataatttatatacatatgcctcccttaaggagaaggagcccttagtatggattggacaaagtgacatccttccaaaaagtacagactaaaatatgagacaggcttggcacggtggctcatgcctgtaatcccagcactttgggaggccgaggctggcagatcactggaggccaggagtttgagaccagcctgaccaacatggtgaaaccccatctctactaaaaacacaaaaattagctgggtgtggtggttggtgcaaacacctgtaatcccagctactcaggaggctcaggcaggagaatcgcttgaacctgggaggtggaggttgcagtgagccaagatggtacacttgcactccagtcttggtgacacagcaagactccttctcataaataaataaatatatgagacaaaagagtaactttatatagagaaatctagtaaacacttcttccaggggatcaaggttgacaccagtggcatgtgatgaaaattaatattttgtgatgaaaatagaactttacttctggagtcttcctcccaaaaatatataaccccattctaaaaatgaagaatatcaaataaattccaattgagagatattccacaaaatatctgacaggtattcctcaaagctgtcaaagtcaccaaaaattagggaagtctgaggaactgtcacatccaagaaaagtctaaggaaagttgatgactaaaagtaatgggttatcccggatgggaccctgggacagaaaaatgacactgggtaacaagtagggaaatttaaataaagtaggaacttcagataataataataattaataataataaggacagcatctaatctgcagatctagacatagaaggtaaaatactcattgacttttcctccccctgctcctctctgtgccagcccccacctcatcccttctaggttctgctggaaagtgtttggtcagtgagataatgtcaacatgaataaaggtgaaaacaagtcaaatgatcatcaaaaacagatgagatataataactaggtgaaagtgcaaggaaacagagccagttgaacccttgctcactggctttccctgcaggctcctccactgtcactgaaaaagccagtgcaggagcaggacacacggtggatctgctggaagggccaaggtcagggacccatctgtccaatgcctgaggcttccttgtgaaaaaccagctctgcacatctcttccaataacagggacatgcatggtgcttgtgaccaaacaaaagatgagaaacaacttaaatgaacaatcatagggaattggttaaattctggtccattcttagaatatgctactgtgatactatggaaagatgatacagatgactactaacaaaaatagaggttcatgtaatggtgttaaatgaaaaagcaggatatattatctaacctcattactagaaaatataaacatatgtgcataggaaaatctggaagaacatacatttaaatcatagcagtggttatctctgagtagcataaacatggctattttatctctttggttgtttatactttctaatttttctatgatgatcatgttctagtcatgtaacttttaaaaaagaaacatactagtaaacatttcttctatagaatcatctatcagagttattctacgaaatcacacctgagagaaaatcagtcaaaccaagttcaccttggaccttagtactagacatctcagacaagccatagctgagtacacttttcacagcatacagattaacttcatcactggccatcagagaaatgcaaatcaaaaccacaatgagataccatctcacaccagttagaatggcgatcattaaaaagtcaggaaacaacaggtgctggagaggatatggagaaatatgaacaattttacactgttggtgggactgtaaactagttcaaccattgtggaagacagtgtggcaattcctcaagaatctagaactagaaataccacttgacccagccatcccattactgggtatatacccaaaggattataaatcatgctgctataaagacacatgcacacgtatgtttattgcagcactattcacaatagcaaagacttggaaccaacccaaatgtccatcaatgatagactgaattaagaaaatgtggcacatatacaccatggaatactatgcagccataaaaaaggatgagttcatgtcctttgtagggacatggatgaagctggaaaccatcattctgagcaaactattgcaaggacaaaaaaccaaacactgcatgttcttagtcataggtgggaattgaacaatgagaacacttgggcacgagaaggggaacatcacacaccagggcctgtcatggggtggggggaggcagaaggatagcattaggagatacacctaatgtaaatgacgagttaatgggtgcagcacaccaacatggcccatgtatacgtatgtaacaaacctgcacgttgtgcacatgtaccctagaacttaaagtataatttaaaaaatggtaaaaaaaattaaaaaaaaattatgctacttctctttttaaaatacttatgaggtacccatactcccaagtatgcctcataaaagccttcaaaaaatatttattcacccacttcttagagtacctattgtgtgctattgatataacagtgaacagaacagacagaaatccctgcctttatagggcttccattctaataagatccttcgaaacttttaactcactcacagaaataaaaagtgttcaggtataaattatgctatggctacaagctccttaatacccatgccaacttcacccattgcaatatcctaacgtgaagtaaagagttgcagcaaatggctctgttgttacatagtaatatatattcttctatattattataggtttgtttattagatctcagagtgcttaattctgtttcttagggtaaacaagaaattatggcatcaaattgcctaggaacaaacataaaagcagtgccgttaccctggagaatggtgtagaaaggggagagggcttcagcttaaaagcagattgttgcaatgtctgagccagctgattcactgctcttcaagtcaccgtccctctccatattcattctatttcactactcagcaggaactcagccaaagtattactgaatttcccacttctcagcatgaagaaacatttaccatttgctgggattctgattgtcagaacaaaacctctccttgccactggagtcactgcaaatagagttgaacctgctgatataggtagactccccactgagtttgtggaaatacttatatggctgctgtcaccctcactcaaaatgtgggataaaggaaaatttcgtacattgctgttttgtatgcattcattgcctttcccctctgcaatggattgtgatttggtgacagagcaaaacaccagagccaggcatgagggcaccatcttgaatttaatgtggaccattcttctggggtcctggtatggccttctgagggtaccctcattaattgtctggctatacctaaactatcggaaggggtccgaccctcctcctttcaacgactgggcacttcccacagctgaatccaaccagtcgtacaatccccgaccactagtggagaagaaccaaacctggatccccacccctgccacaaataaatggttgattatcagcaagttggacacttcttccccttggggatactttaaaaaagtctggcctcatctcttagaacaatttgcttggagaaaatgatctaattagttaatgaagattgtgacaaaggcacatatctcagcacagtacctgaacttgggaaaattatctatattacttttaaacatgcttagaaaaacaaaagttcaagccaaaaattgatacatcaccgtcctttattttataattatgctccatgtttgattttcataaaagcaatgctcttttaggagttttaactctcaattgtttaattatttttcataaatataacaatttctcccaaaggtatctatgattttctcccctttcactgccacaaccagcctatcttttgttctctctctctctctctgtctctctctctccattctctctttctctctctctctctcatcatttttcttcgtggctacttttttgttttggtatggggaacagttgtacagaattatttttctccaggaaacaggttcacatttattcatatatcaaatacagctattaggattatttatattagtctactggaaaccaaagtgcccttcaacaaagctgtgtaataggtgtggttgtggggagagggtttcctcaatcaaatttaactgagttaaactagtatcttcacaccaggacttaccagcaccttaaataatgctaacatctattaagaatccctgagaacagccaatagcatgtagtttctctcaattttatttggctaaatagctcctttttatcaaggacatcttatagagtgaaaacgccttcagaaaaatggaattaatttcttatcatatggtatcacactatatcaagtcattaacccagtataccctgttgttttccactaaatgagagcaatcaagagagaacagccgctagtcctcatccacgcttgggtctggcctcattcccttgagttcaatatgatttcccatagcactggccttggtcctttcaatccactgtgacttcagtgtgacctttggaaccccacactgcagtgcagcagtatcttcaggtggaggttttctgaacctcttcaggtgagcatcacctcaaatggcaataatttggtctacttggagcttttgagtaaattctaatattggtagccttagttttaaacaaaaataagtgttggatatctgttttttctctttcaaacataatgctatgatatgacatttggaaaaagcactttctcctatagacactttctatctgcaatgtgtacacacacacacacacacacacacacacacacacaccaaaccacatatactaaactaacgaaattaaaataatcatttattgccacttaaatgttattttacatgaaggaaaaaactctactatacattctatttctaaaatcagtatctgtttgtggtagaaagcccttatcaaaatgcacaaaaaccatccaggagttttgaactgcaagggactggaatgttaacgtgagccccactgaggatgggacaatatgagatttgatcctgtgattttcatttcaggaaccgctgtggtaaaatcattgtaatagctgatactatgtactgggcatgtattttggctaaagtaactggccaaaatcacacagttagcacaaaggagtcttgattctggattcacacacatgcaatctgaattcacacccttcctcctatcctcccatatctaaaataatcttgtaccaaaatgcagagtaagttataataactaccaataataaaagagtcaagtcaaaattgtatctcatttatattattaacatttaggtatgtacctgagtcatatactggattattgaatacccttgaataatcaataattttgaagcaataatcttgcttccctgtaaacaaaagtaagtcatcccctaaccccactttaaaatagtttgtggcaatggctcaggaagtaactacattaaggtcctgacttaaagagttctcttaaataactgctttcatcttttccctcccttctgccagactggaatattaacaagtattccaaaactctaggccagtggagtctagccaggcaagctccaggactctttaacttggtggttctcaatcctggctgcatatgggaaccacatagcttttaaaactcttagtgctcaatttgtaccccagatcacttaaagcagaatctatgagggtaggactaagccttcaggaattgtttaagctcttcagataattttactgtactggagtttcaaaactactgtcttcatctctccaatcctctcattcttcatcttccatgagctatttgcaactcctcaccatccttggaagctggccagattcagttctggcactgtccccataggacttggacactttatttcagttttccatttaaaaaaatggaaataataacactcacttcacagggcaatggtaagaataaaaatatatcatacatgtgaaaacagccagcacagtgctgacacatagtaggtgctcattcagtatcaatttccatccctttcctcagatgaagacatttaggaactatctagaagatttgcaagtgccgggaaaatttagtagcagcatgctttcccaactagggaatttatttgcctctctaagacacaaaagccttatagtgaggccacattaataagagcctttccttttgtagaaatacaatttagcaactttaacccaaccaaaaaattactttcgtgccatgtgcgttagatgtagtgtcgtctaaggtgataatctattcttaaactcttcaaggtatatttcatattaaaaactagaatgattaagcccattatctacattttttatttttttgagatggagtctcgctctgtcacccagcctggagtgcagtggcgccatcccgggtcactgcaaactccacctcctgggttcaagtgatctcccacctcagcctcctgagtagctgggattacagaagcatcccaccatgcctagataatttttgtatttttagtagaaatggggtttcaccatggtggccagagtggtctcgaactcctgacctcaagtgatctgcccatctcggcctcccaaagtgctgggattacaggtgtgagccaccaagcctgtccccattacctacatttttaaagacccagattctccaaggactttacctcaagaaagtgagaatgctgaattctctatggcttccattttttcatcacacagagcaaagaatgcaggggacaggaagcttgcagtctgagaagctatttagaaggagctgagttgatcctgtctgaaccaaacggccactagtatggtatggaaagatgacccaaccagcatttccagatccctagagggatatgcatccatagaaaacagataaaccatgtagttttgctaccttccatgcaacctgaagttgttttctcccactggtggttctcaatcccgggtgcacatcagattgcttggggagctttgaaaagtactgatgcccaagccttacccccaggagtctctgaagtaattgatcaccctggagtggagcccaaacatcagtatgtttgtaatgcccagttatcctaatgtgtgaccaggcttgaaaaccactggctttgggactgagtctgttttgagagcaacttggtttatacttagctttagaaggataatggggcggccaacctgctccctgttcctgttgtctgggaatgcccaaccctcagccatgtgctaagattgtagaaacacaatttagcaaacttaacccatggtatgagagaaaattactctcttaccatgggcattagatgtagtgttgtctaaggtgataatctattcttaaactaagaatagatctaagacaggatcttagtgctaaggtctgtgacaggaaaatgagcccatggagaggcttttgggagaggtgggtggtcttatgaaaaaaaccatgggcttggggcacgtcacagagctaagctattactagctgtgaaatcctaagtaaataatctgttctagcactcagggtttggttttctttcttccttttttaaaatgagaatagtaactgccttccatggttgtggtgaggattttaaaggaaatataaatgggaatatgcatatgcagtacccatgtgccattgcacagtacacaatgcccagaatgttgtaggtatttgatatacagccatcattgttacacagcacaggaagacaaaaggtcatcattgctgcctcgtgatagcgccctccctggtggatcttcttattacaatatagaaaagtcacataattccccacaggatgggttttattacatgaaagatctcaccacacaatgaagagattaacttaatgaatttatttgtgaatatttggcagagaatacaccactttgattcacaaaagaccagttatttaaaatctgcatttgtgaaaatatatatattatgtatatattatatatatttttatatatatattttatatacatatatttctattctgctacctgaggaagccactttgctgaaactatgtgccattttaagcaaaggaaaaatggctagcccacattctaaaccatttaggcaatgcaaaaatatagtggttcattcactcactttggttttgtttttgtttttaagacggagtcttgatctgttgcccaagctggagtgcagtggcacaatctcggctcactgcaacctctcaggtttaagtgattctcctgcctcagactctgtagtagccgggattacaggtatgcaacatcacacccagataattttttgtatttttagtagagatggggtttcaccaggttggccaggatggtctcaaactcctgaccgcggtgatccaaacacctcagcctcacaaagtactgggattacagacatgagccaccctgcccagcccattcaatcactttgagtaacacctaacctcaagtacaaagagtgctggaaatcccagtgggaagtatgccttagataaccaaccaagacggaaggagttccagtccctgaattttaatcttgaaatcattagaaaactgtcaaggacacttctcattcttaagacacgttgcgtttattatgccgagtcatggtaattatttgagtcactcattggaagccattcctgagccagtgattccctggattttttggagcttctttgtgccttattccataaataactcaatcctgcctatcagcttcctgaggataggtatgcagtatatgcatccccagaacttaatcacagtattaactggtggtgagaaatatttaatgagtgaataaactactctacttcacattcagtaaccttcataaatcttccatttactaaagaataaatgaatcactttgaatatacacaagctggaaatgatgattgggatctacagatccgaatatttctctctttcttcagcggtgtcttgatatttagattttgctgcccatgtttgcttgagaagaatgtcaacaagttcctttcctctcaagctttcaagtttgagtccttgttttacacaaatgctaaaatcttagctcatttctactggtctcatgataatatggggaggcactgagacatattttttgagccttctttccctgaacaaataggtgaaaggggaggagcaatttaaatgaggctggaaaaatcggctctttttcaaacgatggcttcctatcaaatgccctgtgacttcatgatttaatgctaaggatataaaaatagactaaaaatgaactccctcaaggtgatgatcatctttaattttctcatttataatgtggttataaattttctcatcattaatgtgtttcttcgttttcattttgtttgtcttggcatgattctagttgtttcaatggagaatcatattttggagataacgcaagctaagtcttttgctgtatttttcttaacaacgtgtgcattttcccacttgtgcatgagaagatgggaaatgtaaggctattcagaagctcctatgtcctttgttcacactaacagtggccaatttcagaagaagcctataaagatacatttcttcaaggtgatagagctcctgcataacaaagctggatcaagtgggataggcttcaatccagtccacagtaagtgacaactgccatccttcaatcaactcaggtaaaagacagttgcagagagaacacttaccagagtcttcacttaaaagatagtgcaggatccctcccacaccccaacaatgtgcttgatattggtacatggagcttgatctcactcccaggcagaatacaagtgtgaaagaaaagtggttacagtgaggactatttagaatcagtctttaaccattggcaatgaccttcagagaaaagagcacaggcctgccccctgctaactttgggtaagctattcatctctttgtgccttagtttcctaatctgtgaaatagaaataatagtacctcccttagagggttattgtgaggattcaatgacataatacatgttaaggacctaatgttgtcctgatatttgtagatatgcaataaatgttaaaatatctgtggttgggcccggcgcggtggctcatgcctgtaatctcagcactttgggaggctgaggcaggcagatcacgaggtcaggagatcgagaccatcctggctaacacagtgaaaccccgtctccactaaaaatacaaaaaattagccgggtgtggtggcgggcgactgtagtcccagctactcgggaagctgaggcaggagaatggcgtgaacctgggaggcggagcttgcagtgagccgagatggcgccactgcactccagcctgggcgacagagcaagactgtgtctcaaaaaaaaaaaaatctttaatataaaatcatttaagcatacagaaatgtataaataatgatataataaatacccatactctcaataaagtttaataaaatcttaataatttttacatttgcttaaacattttttgaaagaaattaacacagatagaattaagttacccggcagatcctctctatgatacttcactctcttccctctggaaaagccatcctccagaatttggtatttatcattgctgcgcatttatgtatgaaattattgcatttgtatccacaaaatatctaatatttctgcatgttttgaaacaatataaattgtattagaaagcatatatcttgttgcaacttgctttacttgctcgacattatgctcagcattgtttgtaatagcaaaaagtggaagacaaccattaataggagaatgattatatgtcttttggaatatttgcattataaaatactacacaaatgttaaagtggatgaaggttttcaaataactagctttatattttgcatagaatttcttttactatgcattagcaaacctaatgtatggcaaaagtttttttatgaaaaaacttttaatgaaagtctgtctgtgggtgccatctcttaaaaacaagatagacctggattttttctttcttatctaatcaaataatctctatattttaaaagcaagttgaagccacttgcaattattgttattcctgatatttttggacttatttctactgtttaattttgttttgtgtttatcattctttattctttgcttctctgtcttcctttagccttctattaagttgatacattctcttcgtttattgttgttcatttgttgatttaggtgcctgctgatatggtttggatctgtgtctcatcccacatctcatgtccagttgtaaactccaatgttggaggtagggcctggtgggaggtgatttgatcatgggggtagatttccccctggtactgttctcatgatattgagtgattcctcatgagatctggtcatttaaaagtgtgcggcacctcctcctgtttcctgctgctctggcaatatgaagtgctggctcccccttcaccttctgccatgactctaagtttcctgaggcctccccagaagaagccactatgcttcctgtacagcctgaagaactgtgggccaattaaacctcttttctttataaattactcagtctcaggtagttctttatagcaatgcaagaaaagactaatacacttggcttagtcagcttgggctgctataacaaagtactgtgactgagtgggttacaaacaacagaaatttatttcttgcagttctagaggctggaagtccaagatgaggtttccagcacagttggcttccagggagggccctcttcctcttccaggttgcagactgctgacttcttgttgtgccctcttatggtaaaaacagaccaagctagctctctggggtctctttcataaggtcgttaatcccatttgtgagggctccatcctcatgacctgattacctcccaaaggctccacctccaaacatcatcacattgtgtgggggttcagtcaggatggtgggaaaaattgtaaaataaaccttcttgaaaggccagaaggttttagcaaaagcctcaggatagagttatggctgaaggcagcctaatcctctttgagctatagcaagggtaattaacattggaatgtagaggagtctatctaaatagcttgtttaatcatgtggtcctaagactaacctttgccatcagcaggtgcatgactgctttctacttggggggttggcaatggtaattaccttctagtggtgtttacttgagacttttgtcatttaatgtgtgctgaataaatgctaagaaggccagtgagtcgggccaggctgcggttgccactgtttacagcactctccttggggtctgtaagcggcccagactctcagctggactgacaagcataatatctgtgtcagtgtatgttattcatctgttgttggatcaaggtctgtgggacggaccgctgcaacattggggattggattttaacatatgaatttggtgggaacacaaatattcagtgaataacaatgctattatgtttccattattttactgatgatcctttgtgttaaaaagttacaaaaattacgtagttctgaccaaagacaagatagatcttagcactccttaggtccatattgaaacatcccgccttccatctatagcttctctttcctattttaacacaaaagtcggatgttattttatggtcactagtcactcaaatttaccaacatgttttaattactgatgtgctcacccctaattcctgtgtctcatacattccttgtgggttcacttttcttcttgttgacatacttcccttaacacttttttttttgaatggagtggcccaggctgtggcccaggctggagttcaatggtacaatctcagctcactccaacctccgcctcccaggttcaagcaattctcctgcctcaacttcctgagtagccgggaccacaggcacgtgccaccacgcctggctaatttttgtatttttagtagagatggggttttgtcacgttggctaggctggtcttgaactcctgacctcaggtgatctgcccacctcagcctcccaaagtgctgagattataggtgtgagccatcgtgcctggccttaacactttttttaatgaaagtctgtctgtgggtggtaaattatcattgtatacctgaaaatgttttaatgtgccttcactcataagcaataatttagctattttaactattacatattgctctattttcccttagcatatggaagatattttcttcattgtcttctggcttctactgttaccaatgcaaattttgctgtcagttgattacttgcaacttccctgcacataatcagcttctcatagcatttaaggtttcctcacccttgatgtagctttaggcaatgtcattcaatgtctttaggtatgaatttgtttttgtttagttatggcactggagatgtactttccatctaagaatttgagtctttctttacttctgggaaattattacctctttgttgaaatattgctttcccacaactttctccatatcctgctaaaatttctgagagaagtagtttatggcaatttgtctatcttccatgcttttaaattttttattgagatataattcacaaaccataaattttgcccttttgaggtatatattttgagggttttttcctatattcataatgtttcacaaccatcaccactgtttaattccagaatattttcatcacccctaaaaacaacctcatatccatgagaagtcactctccactctcttttctccccagcccgtgacaaccactaatgtactttctgtctctatggattagcccattctgggtattttatgtaaatggaataatacaatatgtgaccttttgtgtctggcttcttttacttagcaaaacgttctctaggttcatccatgttgtaaaatgtatgagtacttcatttaagtcactctatgattaactttttgaaaaacagccaaactgtgttctaaagtggctgcaccattttacattcccaccagcaacatgtgagggtgctaatttcaccacatcttcaccatcacttgttatttcatttgttttattattattatagcatcctagtgcatgtgaagtggtatatcactgtggttttgatttgtatttccttaatgactaataatgttgaatatctttttcatatgtcatttgtatatcttctttggagaaatgtttgttcaaatccttgccactttttaattgggtcgtctttttattgttgagttgtaaggattctttacatattctggatacaagatcctcatcagatatgtgattctcaaatattttctctctgtggattgtctttccacgttcttgatagtggtttccaaagcacaaaagttttttattttaatgaagcccaattacctaattttttcttggttgtttgcacgttgttatgtttaagaaaccactgccaaatccaaggtcatgaagatttacctctatgttttcttcttttttattttattttttttcttttctgagacggagtctcgctctgttgcccaggctggggtgcagtgacatgatcttggctcactgcaacctccacctccttggttcaagtgtttctcctgcctcagcctcccaagtagtgggattacaggcacccatcaccatgcccggctaatttttgtattttagtagagatggggtttcactatgtaggtcaagttggtcttgaactcctgacctcaaatgatccacccgccttggcctccaaaagtgcatgagccaccaagcccagccgtttccttctaagatttttatggttcatgatctttcatttttttgatatggttccctctccatgctatatttggtgtaaagtcttcaggactatcctccaacattaattaacttttccactgtgttctaccttgaacttatactatcaactgatagttttctcttttttaaaattgcaatgactatatgtttgcttcctttttttaaatttcagattttgaaccacttcttttacatatctctgctttcttgggtttgtacaatttttcttcattgtttttaggataatttttcctccatttggctgtctgagtatcctaaatacattttaaagtgtttgacagcctgcaccaaaaatcaacttcttctagaagaaattcatgttccagttgccaatttctgtggtacactctgctactggcaccaattcttcctcctgtacctgtgccctttgctttctaacctgcacttccctgcttcttgactttgcctttggccagaccatttttcacagcagctgtgttattttatgttcctagaagcaatataccagggttcacatttctccacaccctcaccaatacctgctatttgctgtttgtcttttatagtagccatcctaatgggtgtgaagtggcatctcactgtggctttgatctgcatttccctaatgactagcatctttctatgtgcttattggcccatttgtagatcttctctggagaaatgtctattccagtcctttggccatttttgaattgggttttacttttgttgttgttgctgctgctgttgagctgccagagttctttatatctttcatatgtctagatattaaccccttatcccaatatataatttgaaaatattttctcatattgtgagctgccttttcactgtattcatgtgtcttttgatgtataaaaagtttttaattttaatgaagtccaatttatctattgcttcttttgttgcctgtgacattttggctaatttcaagtagaagatacttggtttgggaggccgaagcaggcagatcacaaggtcaggagatcgagaccatcctggataacatggtgaaaccccgtctctacaaaaaattagctgggcgtggtggtgggtgcctgtagtcccagctactcaggaggctgaggcagcagaatggcgtgaacctgggaggcggagcttgcagtgagccgagatagcgccactgcactccagcctgggcgaaagagcgggactccgtctcaaaaaaaaaaaaaaaaagaagatatttgggttttgggttctttctctctctcgcctgcctagagttttgtagttacttccacctcctcccttaaacttccacttcagagccttataatggcactttatgactaatgctctataatcatattggcatattgcagatccaattccaaagctagctcggtctggcagaaaagctgtcccaatgtccttccatctctctaggccaacagcttcctgttaatattattaagctgtggcttggaggaaacaggctggcagcagttgttttagcctgtccaccccatgtcctgtattcaggttatagccctagctctgattcccagtgtcccctgcagcacttttagtcccttttgctccacaggattcaagctccttcctgccactccttactcaggatgtggatcacagctgtcccagggcttctgcagttctctctctctcttttttttttttctggttcccagagttgtttgtctctggcaccagtttttttaaaagatatatttttttattataattttacctaccttggcgtgtgtttgagcagaggagtgtttgtcaaaaaatgaacttactcaaccatcttgaccggaattcacagcaaatgttttcatctcctaatgactgaattggatcagcttacagcagattgatttgactgcactggatctaatcatgtaggtggtgttgaagaaatataaaaccctaaaattccaattaaatccattcactggctgtaaaatcaaaggtttttaaaagattctatctattggtggtcattcagaagagtcatctcttctacagctatgagatggtaaggtggagctgtgagcaggagccagcatgcatgggcaggggcccccatggcacacaagccagagggaggcatctgtgatgctcctgaggcaggaagggaagtagagagctgggtattgcaatgaggtggtgagcacatctgctagtgaaagcatgattccagctccttccgtgcacccctcaggatgtgaagcacagctgccctgcagcttctgtcctgtagtgtcaatctgcacactgtgtagtaccagttacacagattaattatgtctggtgttttgagaactacccacttccacctctgaccatctctcaagtcctgtagggcagaggattgtggtttacagccctgtaggctttggagatgctcagaatgcagagcctaagacactccttttgggaccactttggatggctaaagacaaggtagctgtgattctgagtcagaggccttgggaacccagtggccatccctgggtccccagcagagcaagtgggtcccaggacagctctgcatattcttggaggtgacaaggatgccctcagaaatcccacctgatctagcaaggctatgaccttgtcaggagcaaacaccatcacttcacactggaattgcttggtttaaagctgatttcttcctgatactctgtagtcccaagagcataataacctcaagcagagacgagatgcgaggggcttccagaaactatagaacaagatctactcactactcaaaagcaagtctgtagagttgaaacaaatccaaactttaagatgagcctttttttctgaggatggttcccttctgtgtagtcgtaaactaaatgggaggctgctcactcacgcaccacgtacccagcttagaaacattaatgcatacccagtaagtgcctgtcaccttggcagcactgggggcagaaaggaataagacagtcctcatcatggaaaaagccacctatcaatgtacaacaggacttagaagcaaaccattgtagtgcactgtcaattccacctagatgattttgacaggactacaaagagaaattagccaagggaagaagagaataaggagcatcccaggcactcacagaggcaagaaaagttcaagggttattcggcggatgtggagtccacttgtttgacttgggtgagggagctacagaaattgaagttacaaaagcaggcagacataagtcatatttcatctaaaatgccactaattgtaaaatgaactattatttcatgtacaaccaagaaaaaaaaatgctgctaattgaattttcacacaccattgactgcaaaacatcccaattcaaaatgggttaaaatgcaaggcaatgtgcctctcagaatggatgaaatatggtaattccccaaagaagaaatgtaaaggtgaattaacactaaaaaaactgtttttttaatagaaagatacattcaaaccaaatgtagatatcatttttctcttagcaaatcagtaaaatattgaaaataatgtttagcattagcaaggggatcatgaaatggacaaactcacactaaaaccatacattaataccatctttctgaaaatcacttaggtaataatgtgtcaggaacctatatatgtctgcattctttgagccagcaatcttacttagtggaatctatggtaaatccgtacttacagactcagaagacttatgtacaagaatgtaaggtcacttataaaaatgcatgttatataaatgctaaattatcaatagacatataaataaactgtggcatagtcatagaaatgttagtcaattactgaaatatttgttgaagtatttaataacatgaagaaagtctcataatgtagtggtaagttttaaaaggaaggaaacaaaactctacataaagtattaatctaattcaaatctagagaaaaagtatttaataaagacaggaaggagaggtaatcttggttaaccctgagtggtagcattattggcaacatttttccttcttatgtttatcattttttaaattttcttcaatgacggtatttatcttttataatctttccttgccccaaacagatgtgcttttccaaattctgctcgttaaaattaaataaaaattaaattgtagttgagaatgtaagcacatgcatggagacagaatgatcaataagtgccccttatattaaacaataattatacttgatcctcatgaatacttatgatttgccagtacatgtgagattgggtcgaacagaggtcatacatgccttccatatttctcgatagtagagattattatgagcactatgtcaatactgggctaaatttacaagcattatttctaattcttatcttctcccaaacagatgagaaaacagacattccaagaagctgaagaagcacatgtgagggcacacaatttgaacacagaaaagctgggatttaaacctgagtctcgatctcaccacagactcacactacttcccttgcacgatctgcctctacaaggcagatccttccatagcatgtacagatgaacatcaaagaggaccaaaattctattctttccataggtgagggggacgattgtgaaccaattatagaaatatttatgtccattcctagaggggcctcacaaatgagggtgacagagacaaagctctctgataacgtgagtagactggataactatggggccatgttctcagtttatcaacccaattcccgagaaaccaggcctttccattgtctgtggtcactaagataatggtgcaatgctgtttacccacctggcaacgtaaggcgacacgtggagctggtgcttggggctggtgagccgtgagaacgctgttttgtgcctgtgaagaggaaaaagaggataaggaaaagtaggattgtggaaaaacctgttggacaagtaaatgttcatctgaaatgttatcaagttggggtctgaaaacaatgtttagaagcaggttaggtgaggttgcagggtggtgcatattctgtggtccagaaaagctgggagcatcgcctttgcctttgtgtgtgtgacagtacgcagttcctctggctggaaggttgatatgttgggaccgatgtgccactgagcaatgctacattttaggatcacaggggaagttttctaaataggaagttgcctgggcgtcacccccacagtacaggggtggaggcccagcactcatgtttttaaaacccctcattctaatgtgcatccaggatggaacaggatggaggactatctgaagaaggggaagttctgatttagaatgagggaatcgggggttttgtctctgctttgtccttataggctttacttgctattggaactcaagcaatgaactggatctctctgaagctcaggtcttcatctgcaaaatgacgagaatgacaacaattgcgtcgaagtgttccagtgaggattaaaggaagcaaagtgtgtccagtgctcaggaacaatgggagacttcacaaatgctagtttagtggggtttcttagtttcccagcaactggcaacagaattcctatgaggaaggggattatctttgttctaataaaccctttaatgggtcacgaggcaatgaaaagtcaaaccccaggatgggatcaataaggagagagcagaataaagggacaaagggagaactgagaggtcctgccaaaaaattttacattttttgtatatatgtatgtgggtgtgtacgtatatacatacgcatatatttacgtataaatatatacacacagacacatatatggacacatatcttatatataaacataaatatttatttattcattcattcatttattttgtcatccagagtgggaaggaagaggcctggaagccagattctagcaacacggcagatgcctgcagtctgagctggcagaaatgcagagagaattcctcagcagaggatatccatgagtcagtgttaggttacttccgttaggagtccccacaaacttcccaaacttttagttaagtccactttatatgcagaggcctggtgtaagtggaagctgtgctgattgagaagaccctatgtgtcaatatagtcactgataaagataacaaaagaatcagtttgtggggtggggggaggggggagggatagcattaggagatatacctaatgttaaatgaccagttaatgggtgtagcacaccaacatggcacatgtatacatatgtaacaaacctgcacgttctgcacatgtaccctaaaacttaaagtataataaaaaaaaaagaaagaaacaattagtattaaaaaaagaaaaagaatctgaagactgggcagtgtcagaggaagcagagacttggggttggaggtgagtgggagagcggtaagctttccctaccccagaatccctggggaagagtggagacatgcactttggatgacgtttgatatcgttccattttattttatttatttatttttgagatggagtctcgctctgttgcccaggctggagtgcagtgatgcgatctcgactcactgcaagctccgtctcccgggttcaagcaattcccctgcctcagcctcctgagtagctgagactacaggcatccaccaccatgcctggctaatttttgtagttttagtagagacggggtttcactgtgttggccaggctggtctcaaactcctaacctcgtgatccacacacttcgggctctcaaagtgctgggattacagacatgagccaccgcacccagccccattttcatcttaaacaacagggcaccaatcctgacattgtgtgacaaatgccctccagacaataacaaatgttattgttaatcattattattctttccttcttttctggcagcagtagtagtaaaaatagaaaacataaaattaatccaaatagctcagacctacaaaaactgttaatttgtatgaagtgaagggaactgtatctggcgggactttatttctccattttccaggtctcacagatgccctgaaggtcagagttggtggagaacatagagggtccaaccctggctgtagctgtgcttcagttcttgaacctcagttgagtaactcagttactcctgaggtgatgtttataaatatgacttccaagctccttgattggaccctgaagcagaatctccagggaatggagccagcaatttgaattttaacaatttcaccaggtgattccaacgatgatcttgtaatctggcacttcactggtctaatgaagtgtcttggacactccggggtgaaagatttacgcaaagtgatactctgtgtcaaagccagtgctgccacaatgcacaaccccagtggatgcccgtcgcattgtatcttacacaaagaatggtggaccctgggtgtgcaacaaataggccccattaggaggcactaccagagggcacatctgtgtcttttatgttgtgatccagagccgttccttctctgcccgaaatgcctctgtgtcccacaagattttttacttgtctcatttgacctttgggatagggtttctcagcagtgacactgtgacatttgggctgtacaattctttgtggtgggggctgtcctgtgcactggagaatgtttagcagtgtccctggcctctacccatgagatgtcagtagctcctccctagtcatgacgatcataaacatcctccagatggtgacaaatatcctctagaggcaaaagtgccctccattgagaatctctattttaggttgcagacagggcttcaagtttttatttagagatgtggttcccaatttggctgcttggtcattgctaatagtcactcccacatattaagcagttactgtggccctggtgccatattacgtaggcaccgtgaaatatagatttgttgttgtttctgattttaacattctgacaacaaaattatcccattttacaggatttgaagacaatttttgtctccaaacattttgtttaaggaacttgactaatgttactgagtgttgtgggaggagggaaaaacttaagtcaagatcattcaaagttcaaactcaaagaaatttttcccctgactcttgctgcttcttaaccaacccattgtctgggtttccttcaagcacagtctcccaaagttgtctaagaggaagaaaaacctgggacaattattttaacaaaaatgaaaaacaaagccagtttcccaggcctcactaagctctcggagccagcacttccagaggcgaggtttagggacctgggtatttcacaggtggcccaggtgattcccatcatcaaacaggcttggaacaccttgtgtggtagaaatttccttttgtcgaactaacgaaaagtgtggcattctgctttctgtggatactcttgtgaagttgagagaacaaatttaatgttgcctacatgagtacctgaaaaactgcaaagtgctcaatgaccacaaacttccaatgttgctacctgtagaaacgctattgccaggttatttcatagaaatgcttggtggaattttttaaaaaataactgactataatcttccaaaagcctgcagcttgatagcttttcgtagaggtagcttttcatccccttggtgtcttctttgcaaacactgagtaagggaactctgggaaccttgagtcagtgaaaaagcagaactacaaggccttctggaaatgctgttattttctctgttagcttggtgagatgcccaatatatcaggacagggatgaagccatcccacctctcataaccatgagccatatacaggtagcaggcggggatacataaaataaaactggttttgattttgccacgggccattggcggggggttaggttctgagtcagcctcccactggcttccagttcactgaggatgtgttcttgaaatctctttccatgaggaagctaccaaattacctatcactttactcaaagttccactcatgggagtaatacccaacacatctgagtttcattttctaaagcccttcgcacttcacccttccgttgctccctctcatgtccaggaagaacatcagaaaccaggtgggaacagccagtcctgacccagcttctaaactgtactgtatgatgcacacagaaggcttcagaccacccaccacatggaactggttcttggattcattgtagaaatctactctgtcagtggttttcaatcctggctacatattagaatcatcaggggagttcttaaacaatatgctgacacctgacccttcaccccaagatgctgtttagttggtctgggtgggacctgggcatgaggactttttaatgttcccaggtgagcctgatctgcagccatgagaaacactgccttcactgaatacccagagatgtttctttcagttgtcgggagggaagccttactttcttctgaaacaactggtgtgctcatcctcacggatgtgaatcttgtaaatggtttatttccatttaaacttaagattccagaaagcttagacccagtttatggcataatgctaggaatcaggggaggccgatttagactgcacgtctgcttattaacatttgccctggtttgttccatctatgctagctctactttgtgactctggttttattccatttacttaatcattaaaaaagcaatgtattaaatttgcatgattttagaattctcaaatatctgataaatgaggtaaaataaaagcaaatgaacaaacaactatgtcaatgctgctattgctaaatttcattttcctcatctatgaaattgagaaaacatcaatgtcaggacaataattgcgagcatcaagtaagagtacacacatgacagtgcttagcaaactgtgtcatacaacacagtttttattatttgttttagaaaggtgtgtgtatgtgcatgtgcgcatgcgtgtgtgtgcacgtgtgcatttgtgtgtgtgtgtgtgtgtgtgtgtgtgtgtgtgtgtgtgtctaagtaggtaatctgtcatctttgggaaataaacactttaaggtcaggaattacatttcccttgactcacagcatgtggccatttaaggagtaaacaacccaatccgtcagctaggggcagagatgtcaccactgcagcttatgtgacttgaggtatcctttgacaaatgaatagctttcagatatttcaaattaatgtccttgtttggttcaactagagggcaatgaatccaattcatcaagagtgtggagaagaggacagtgatagaagtgacaactaaggctacccgcctcagggtgaacgcacacctaagactcgggacttcacaaagttagtgctaaagcacagtgatttgcagcttaacctcaaacaaataatttcccttctgcaaaatggggttagcctggccaagcctatgcctgctggagaaagggtgatttaagagctcttgagaccaaacatcatcattattaatggtctggcaatagcaatgttattatagtacaaccagatcccacagggcagaggaggatgctgaaaagctgaggtatgaaagtttctgtcaacttattggccattttcaatttctctgttttagcatattgtaaatgactgcctttctgatacccacagacctctgatcattattgctgagcatatctgccaacatcttctttgtgttccatttgggctggggcacagggcaacaagccattgcctgaagcctcagaacaaatcatcgtttttgcccctttacagctttgaagagagagcatcagtaaaagtccaagttctgcttcaggctgtgggaacactgaaagagtctggaggtcttcaacgccccaccccccaccccccacacactgccctaagagttatcaaccaagagtatataaattagagctgcatattcagagtatttaatgcttttttcctgcacaatacaaccaccatcaatactaggtttagtttcgtgtgatttgaatatgtctgttcatcacaaagaagaatgattaaaagcaagagctattcagagatacaacaccacaagctatttaaatgtggctttcaaaatatttgaatgtgctttgaacttgaattggacatatgaatgaggagttaaaaaaagtgttaacaacctgtgacccagtaattgtatatctggaaatttgtccagtggagatattcagaaatgtgacaaagcgttatgtacaaagagctccattgctgctatttacaactgcaaaaaataaaataaaagcgtataagttaattgcccaacagcagagaggtggttaagtaaattgcgctagagccacagaataaaatattatgctgctattgaaattatattaatggagaagttaaaaaaacactcacaagaaaatgcttacaatccaatgttgtgtgaacaaaccataattcaaaattaactatactatatggccttaactgtgtaaaaatgcatagcgaaagatcataagaaaataaagtatctacaatgattaattgttggatggggtattacaagtgattttaagtttcctattatactgtcgatactttccaaattgagtaaattctatttttactttaagaaaaaaattaaaaatatgtttcagtgaatggcaagcatggctgctttggagaaacatcacagtcgccttcatcagagcaataataccatgcgaaacgatacaccaggaggccctgatgaaggggtggtatttgtgtaatattcagtatcaccactagagggttctctctctgaggccggtttgaaggcatcaggctggatgccataaaggatgtaaaccacttttatccccacaaaggggagtaatgaatgactacacagagtccctgactcatgatggcccaacttaaatttttggacttcatgatgatgcacaagcaatacacactcagaagaaaccgtatataacctttctgtttttcactttcagaacagtattcaataaattacatgagctattcaacactttattataaaataggctttgtgttaggcgattttgcccaactctgggataatgtgttctgagcatgcttaaggcaggatagcctaagctatgattcaaacacagctggtaggttaggcatattaaatgcattttcgacttacagttttttcaacctacaatgagtttattgggacgtgaccccatggtaagtcaaggaacatctgcattccctagtcagactccttatgttcatggcttgagcaggaaaatattgccaaatatacccctttcaagagtaggagaaagaaaaagtttgcaattcagaaagctagcatcacagggctgtaaaaccatatcattgtaccctgaagaaaattaaacatatggaatccagcttaattccatgaatgctgagatttcttatgcctctgataagcttctgataacccatttacttcatccctcacagtcaaaaaaggtgaaatgaaacgtgatatagtcatactctgtgtatgtctttcagcatgcaggcaaaggcacttggtgcctgggtattatgagacgtttaagggaatacaaaagagacagatggttgactgagtttggacagctctatatctgagacagaacatggacaacaatgggaaacattcaaagaaagaaaaaaaagtcttttcatttttccaattccaattaagaggttaactcattgtttttatttggtaatcagaagaacatacaagtacttatgcattactagatgctgggggaaaattatacattgaaggactgtcaggctcatctgtgcaataaagatttacaataaacacatcattaatttttctgagaacagctcagtatactctgttttacatgaatccttatgatttaatcttgtatttggagatatgatgctatggcatttggataacattggttaagcagcatcttagagaacagaacactcttcctcagaatggatggccattcttttaccctgtgatgtacaaatgcaaattacaacctgcattttatctgccagaagtgtatttcacatcatggaagtacattctatcacaaccatgaaatcaaaacaagtccattattaccatcttcccttttggaagagcattctcagaatacatccagaaataccttccttattcctccaaagaattgtttattcagctagtcattggttgaggtttgggttttggttctgcttgcctctctcttttgagtcttgctaaatgttcttgatagtaatccagatatttctcacaaatccagctgaacagcagcaacatctaaagctgaggagatgagttgagttttccattcatatatggccagtgccctcatcaggaaagagcctacagactcaaggtgagtagggtgtctttaggatgctatgtatttaatgcatagggtgctacgcatcctaaagagaaaaaccctgtgagagcaaaaactgtgctgtacactaagggaggacaataacaacatcatattcacctctaggtgactcaccttgctttgggtaattgatttcccataaagatttccttttttcctgcttccttttcccaagctatttctgcctccccatctatccccagcgacctttgacacccaaaactttcccatacgaattgcatggaacaaggtgcttttatttttcccattattttgtgtttgtacgtgctaaaatgatactgcaagcagaatgggttacctggacagaagcaaaagaaggaatttgtgaagggtagaaaaatgggaggaaaaaaaaaggaaaacataaaggagagtttgaaaaagggaagacatttaaattagatgaggggaatctggttgtacagtgggcacaagagctgataaaaacctaaccaagctctacaaatgaaaatagcaaatatatttttgaaaattttatagcatataaaattgtataaaaatatcatcaaagcaagaaaaaaggaaatgtatactctatagttctacctctagaatcagttattggacaatacctatggctgtaggtttttcctatccatctatatatattaatataatatgtgactgtatttctgtaccatcacacatatacccactcaaagacaaggacagtagtacacaaattctactccaagataggtcatgagagggaagcaaagactatacaatgatgtgtctccaggacaatctatttaaaacccattctatagccatggggttttaatgggctttattttaaatgaattaccctgcaccataaactgactgagaaatgatcctgcaggttcagaagccagcactcatgaagaatacgtggctgaagctgaccaaagctgagaggatgagtctccagttggcactgcctctggcctgcaacagccagcattcaccccacaaagggggacaaggtctcctcaggggagactgaatgagtgtgccctgagcgaacttaaagggcccacaccccactccctgcttctcctggctgagcagatggcagcccaggctgggtgcaagtacagttagtgaagccagccattgccagggttaatccacttctgcttgggaacagaagccagaataaacatgaattcatgtcaaatatgtctggcaatattttccaaaaaatgactagggtgggtatttaagaaaacaatcaggaattaatatgtttaaacttgaccatcatacatctttcagtccaggtcatccactgcacaatcgttccttgtttaatataaaaacaagaagctatttcagtggcacaattcttgcttaattcagacattcctggagaagcagccagcctttttacaaatgtccaaggaggatctttagaggcctgcttcccatttttctaatctccctgggaacatgttcatgatcagataaactgtctaatgcaaatgactctggtaacattctaactctagtgtcacctctgtgcccactagtgtctttggtgagagagaggaaaccttaaaaagtaaaatctggccttggcaggtaatatgtctcttgatacccagagggaggttttataggaatattgtcattgctcattataatttttttcattaagttcattttcttagtgataatgaggcctttaatcatggatcacagttgataaattattactttccatttgttcatgcataagatccaatataacatcattattgcaacattatgttctttaacatctaactttgccatggtttggtgctgtaccaatcatattattggtggagcagaactatgcagtgattcctcatgctgcacatagagaatctatttgctgtaggagagtctgtttaaggttttaaaagtttccactcggattctcagtaaatccactgacgttttatatagattggtgtcatcttcccttttggaaagacattctcagataaatcctgttttagtgcttttttttttttgtattgttctgtttttttcttaaatcaagaggccatagagaagtttttattttattttttccataaatttggctatgacaatttctcccaaattacctgcaatttcctatctctggtaataagctatttgtgtgagtagggtatgcctgcatatacttagaagataagcctttagcagtgtgcttggcatatagaagttgaataaattttcagggaaatttgaattttgtttgcattcacaagtggatagtggaattcagttagacgattttgaatgtgtttcctgaatgctgaccgtgttccaaacactgtggtgggccagcactgcgtctcctgtggggtgtgtgggcatctcaggatcagaacaaagtttccaattaggaaaaaaattgttgcctgaattccctaaattctctttatttgggatagaacaccacatacacagatttccaatcttagaatcttctctatttcactatgagaaaaagatttcatgctttttttctattgtttttcctaggctccatggggaatgttacaaagtaatttccatcatcaaagtctctgctcataggttaagaaagaagaaaatatattatattatctatctatctatctatctatctatctatctatctatctatctatctatctatctatctatcatctatctatctatctatctacctacctacctatctaaggaaaagtgacccatgagagaagtgatattaaaataaacagtatccatacttccaaaatatggataacaaaaattggtcttcaacttttggattaccgtctcacatcccatgataatgttgctttttactttacacttttgtatctaaaggcatggttccaagtggaaaatataatacaatggcttaaattctacaaatgaatgaacacgtgcactaggttattctttggctttcagatgtttagatatcattttactgtttaagtgtatcagatccacaatgggatcctgtcaaatgttttcggtagtttataacagctccaaaaatgaaatggacagtggaagaaagtccatttgaatttaatgggttagaaatgagtctcttgtctgctgccataaactattagggctcataacctaagaaagattggcacaaataaaatatggaacaaaggcctcgataagaatgggtcattatgccactgaaacgtaccacattaacacaacttaaatatagagctatttggtgacatggggacccaaattcaagggctaacttgtcacattttatccagggacgtgtagagcgcatggtttcgtctgtggtaggactatccctattgctgtccccacatgctagttaattcttaattcaggtgtgtaagcccttgctctgtgtgtgtaaaccagagtaagatgccataatctgtgcaatagaataatgtttgtcccaaattgctgctcaacttgaagaaagctatttcaagggaattaaaagaccgcagaaaataagctagagctttggaaatattgcttttgcagtcagcactgatttggaataattactttaatgttttatcagctccagtatcaattcatagcatcatataatatagcattttgtatttttaatagataactgcatttttactcaatatcccttcgaaacactttttaaagatttaaagctaagagtgagttacatggagttttgttttgcttcactgagagttttaggtgaagttctttatggaatgaaattctctttctattctttttcagctgattaatgacttaaagcaaatgaaaaacatttccatttttattggtgctagaaaaaatggctatattcctgtttctttttcaaatgttgtttcttgttgcttgttagattataaaatggaagctgtagactttctattttgactggccaaaaagccccacatacaaaaatacagaatataaatgaggtaaaaggtccaggttccaaggtcaaaaattgacatactcttggttatatttaatttcaatacaaaatcataccacctctaagaacatagcttgcaaaccaatgccccatggattgaatgcagctcacaggcatgtttcatttgattagcacagtgtttgtaagtttttgagttagttgtcaatatgtaaaaatttggagagagcttatatcaaatcctaggtatctaggacccccatccccacacagctcaaattcagttgctgcctaccaactaccctgttttgacagcacccaccctctccaatttctcacagtccccattgctccttcctgtcttgctgatacaaaggcccactatgaattgccatttaccacaatgactgtgatattacatggcttgctttattcatttacttgacctgctaggcccctgaagtcatttgaatttctggccacattatgtggtgaggtcattgttatgaacacagggagcacaacagaaaaatctaagtgtttctccaaggcaaaatgtaaagctgacagaagaaatctgttcaaatatcagcatgctgttgtgcattcgatactacaaagttcttcagatctttctgttggggaacattttggcaaggcaaaggtccaggaagaccacatacagtctctttctttctgcctgaaaaaatgccaatatttcaccttagtaataaaaggacgtttaaatatctgttctcgtgctttttcatgtagaaattaaatctgtagtggggaatacacttaaacctattgcctagctctctttctattactaatccccacttcatcatcagcatattcatgtgcttcactcttgggaaggactcagagattcctgtgtgaccaataaccacattttaagaatcacttttatctaaatcacatcatttagactcataaaatcccactttacttgcactcccttagatcccacctgtaatttggtctcaagggggctgcaatgttattctctttccatgctacatctactattcttattttttattcgtgctattaatccacttctatcttgtatttttaaaaactcactaaaatgcaaagaattatctgccatatctccctgatactaattcccttagcactttactgaataaaaagaagagtgatgaaataaaaccacagatatccaaaagaagatgtccagccagtggtaaaaatttcagtaaccacttagttatcaatgctaccagtggaaacaatgggttcccactcaacagtacagtcaccagctgaacattcaggtttatactaatgaatgcacagagaaaataaattagccatcaaataaagattcctatagaataatcttttttagaaaacaaacagaattctgtattacagaagtgggaaaaaaagcataagaacaattttaagtctgaaaggaaattggagaaaacaaatgttcctgactcaggaaaggaaccagagactggaatcatcatctttgcggtgatgaatgtcagcatggctgtatcatcagtagccagtgcaaaaatgacaacatttaaagtaacggcattgacagtcataaaatggcaattactgtgtgtgtggcttttttcaggcctctcccagcatatccaggatgtccattctcatcaggccagacagatgccttgaaagccaggtcattagcaaaggattttgaggatgccccttcatgttttgtttctgtttgagtaaaaatctcacgttgtttgttttgctcaggggaatatcccccagagttctaagacctcaaaccaacccccaaagattcatcccctggaaggagatggtgtgagggaaggccaagggtcagggggtggggggcttgtgtttgaaagttgtacaccttctccagatatgggtctttgtggaagaaggagaagaaggagaatgaagaagctcagctagaatgatgcaagacactggcagcctcttttattgtctatgaggtcttttttactcttgtgaatctgaaaaaaagaaaaagaaaaagaaaagtgtcaatgctgcctttccccccgcccacctccaccctccaagtctgaggagaaggaaatctaggggaccaaaaaaaatgggataaccaattaaacatttccatactggtcattgctgtctcccttgtaacaagatttgttctattcataaggggaaaatgtcagtgcaaaactgtaatatcagtacatttgaaatcttaatagttgctgtaaactagattagcaaacatttggtcatgcagtagggatattaagccaccttcttttgcaatggagatgacggttttgttgccagatctggtcaatctgtctcaagggtcagtgggattggaagaaatcagattcatctaatcccaactgttttcatatcaaaagcaatactcctccctctcagaattcttgccccaccctcagaagtttcccagagacatttaaagcaagatgtatcctagcccaaatcattttgcagatgggtgaatcacctgagttctccactggacccagagcaagggggtggaggaagacgacaaagatggaaaaaggactaggttaatgacaatagacaatattgtatttcttttcaactggcatgctctaccccatgtaacctcaaaggtcttaggcagaatttaaaacaacaaccacaacaaacccaccatattatttcttccaattggtgttgcatgctctgcaagtcatcatgccttatagttagaaagtgttcccttctatgcagggctccagttggcttggactttaagaagggtaacactattatctacagagatgttagaagcctttacaggacaaggaaagtttcccattcaactttaaagactaagatactctcctaagatttaggtgaatttagcagaaaactcattgggagataggagaactccttctgatctattgtaattacagtcaattctcaattttccaggggccattgatccaagcttcctgctgttcctctaactttattatgttcttgattgttcattatgtttaccctccattaacaccttcacccatttgagagaaataacagacaaaagtgaggcttcataccaatcactttactccaatactagcactgataaacttgccagtgagagaaggaggtgaaacaaaagctgaaatcaaggatgagaaattttccattgatgttgatagtctatgcacagtttggtccacatggaattgcaatacatgactttgtccttagtactctgaccctgccattatcaacttgggatcatacgtcatgaggcttcttttagagagtcatcataatactaaccaccttcagagatgtccccagaccctcaaatgtaaagcccaattttgttaggatgacagaaggttgggtttgattttttaataacagacccattggttggaaggaagctagagacagatagctggggacagctgataaagaccactatttaactcagtgagcctcacctggccaacaaggagaatgatgcacctcctgcagactgggttagcagagacccacggtccagactgctgggtcccagagatggaaagaggcctatctagggtcttaatgaaatccaaaggctgctaaaacgagatattcctccatttctaatcactgcttatgggtgagatggtggagtgttccctctggctgtggatctccatcctcccctccagctttgtgtcaaggggtgaagggaaagggtgaataaaagaagtttgtgtgtttaagctgtgcctgtgttcattgtcattaaataccaccagcagtaaaagaacaagaagcatatgttctatagctgggtctgtgacgtgatgacctgagtcatcatccctggccttcccaaacacatgccctctaaaagtaacttctgtttgtgaatttcttaagtcacttaagaaataccctaaggtccctatatcatagctacctgcaaaataatgttccaacccagactgctgactctttgagaacagggaaaacacctcatttatcgtttataacacttcttgcatgtagtgcaatgcctgacacatagcatatgctcaacaatatttttaatgaaaaagaagagaattgaataagcatgaggaggatgggactgataaggtgtggtgatgaataggaggtttccctccaccctttttctaattttgactttcacagcatgaaacaaaaatttaaaagaaaataataaacacaccaattatatattttattcaatagtaaggtatgatatgtcaaaatatttacattccctatgaagaaacccaattatggatggctttctatggagctaatctcacagagaaggagcacctgctatccaggcagctttggcatggtttgcaaatcaggcctggtcctcttttcactccacatcctatctttcattgtgttctggttttatgtatttgttttcaatataaactgaaattcagtaagcatcagcaagactacaaagtatatgaaaatgaggaccctgaagacaaagtgttaataggccactctgtgtgtaactgagatgcatgactttttgaaggccacaaaaagtagttaaatccttccactttttaaagagtgactgatgaattgaaatggaaactttcttgccacatcttggaataattcaggaaactatttaagtgcctgccccttgacccaagactttttatacctcacaaggtaaagctgtgagaactttaaatcctgaagtgcaaatacatggtatatgaattcacagaaatgtatttactctataggagcatacaatcatgtttcagcaacttcatttagaaaaatgggagacggacttaaaacaatgtggccttatttatggtaccatgctgctcccaaaggtaagtgcagatgctgtatataggtcttaaaaccatgtgatttaaagataattggttttagaagaagattgaagttcaatttaacatgacttgattctaaagatgtgtttatccattataatgtttattcctggatcacaaatggagtgtcaatgaggcagccctcataagaatttgccactgggcttaaaaaatattttaaatgcatttctcttccatttttcttggatttgatgtttttacagcctgattcaactatcacctaaactcaaagaagtaagttgacttggctgaagagagagatggggttcaaaaccagattttcaggtcctaggaactctgtaccatagctgcctccctatggagtcaactttctgcaaaaacagcaaagtgatacagcacacacctgacaagttataaaactctaaatagaaaaaaacgaatgaagaataagtgtagagaaaccaaaaccaatttgaaatgtcatgtaagacttctattgggcatatgaatgggtcctcgttttttttttttttaaataagaagaaaacattaagaaaaaacaattttaaagtatctgttaggctttatccaggtatggacttaattgtcctaggtcacaagtacatgacagctattttaaagcgttattttcaacatgtgcatgctttctccttgccctaaataatagagcatattattataataggattatattttcactacaaataatatccatgctacagcactgctaagacaaaatcctctcatcatgtattattccagcacagaaaaataaaacagaaggacagatagacagacacatagataaaccagatagatagatagatagatagatagatagatagatagatagatagatagatagacagacagacagacagacagacagacagacagacagacagacagacagatagatagacagatagatgggcaggcgggcaggcaggcaggcagacagacagacagacagacagaagacatttgtgggaatgtaacttcttaaaaccttgcctatgccattaactcctaaaatttacccatttgatccaaacacacagaataagaacagtacaaagaacagttagtttagtgcaaaagtaattgcggtctttaccattactttcaatggcaaaaaccccatttacttttgcagcaatctaatagttcttaggtccaaccctttccctctttgtctttccttttgctccactgcatctgtgctaccactgaaaataacaatgatgttaaactcttcctctctacccttgttgctttctctctttcatttagcatgttctttctttccaaacataaaatatgtgaacaactgtctctgttcttctgtctcacactgcccaaggtgtcttactgctatcatgctctgttttaagaatgtagcacattaacacaaagacaatgattaaaacactgaactctctaaatgcccccaatgcctggcccacttttagcagacaagtaaaagtcaggcatcagtaactcctacaactcctctgatgataagtcaacatccctgattcacagaggtgcaggtgagggtagagttaagcacccttgtctgcacaaaagagtttagtttctgatcagtctttgaatctgtgaagtcaggaagaagcccaggaccgtaaagaaagtccttcagatcagtaagtgaggcttggattttagacatgaaacattctgactactcttcatgtttttctcaattttattatttcaggaaaagcagaaaagattctaaatgatgagaaaaccaaacaaacaatcattttctcatgttttcactatggctccagggcatagaataaaaatagcatatattgcagcggactaatacttaagaaatgtagacatggtcacttggagagcaggatgcccatcagtggagaatgctaagaaaaaatgcaaagaggggaagcttgaatacttgctgaatactgcatttaatagcttttttagcatgtgagcgtctagaaaagaaatggcattaccaatgtagatagtgttaagttctgcctttggcacatatttacttcaaaggttccctttattttaaatatttaaatataatgttaatagagtttcttttggcaaatatattgttacttgtgtttctccaatcccttgcatagaatctgacaaaatatcatttttttccaggagaaaatatttatttcatgattactaagaagctttattttaaacatcttgaacatcagtattaaggaaaaaagaaaaatcacaccttgccccgtagttacaaaattttaattccctctgtcaaaccagattcctttaaaaatacagtggtacattagtagttccacaaagtatctagaagacagagtgaaacaatgaaagcttatgtagcaataattgcaaaagaaaagttgttcagaaagtctaattttatcattaacaaagagttcataatatacttttatttgacatttctactatggagttacttggtaagagactgggatctaaacacctacataaaaaacatgaattgatgttagaagtttcccttagtataacacaatttatttaaacccatcaatctcatataatatataatataatccacatattatggattggttaatagatattccccaaattcataaaataaaaccaattatgttgggttaaaacatcactgaattaataataactctcatggttgggtcaacctacagcacagcttccaaaattaagtacaaaatgacaatgaagtatctaaatcaaaatgtttaatcgaaaaaaccttttagagtttaattagtgaagttttaaccagatgcatgagaataacagacacctaaaaataatattacaattctctcctccacttattgactttttgttttccttggacagggacatatatatatctatatacacacacatatatatatatgtatatgtatatatgatttaagatgtatgtaatatagtttatcatagagggtatatattatgtatatatgatatatattaatatatcttacatgttatatgtcatatatgcatcatatatcagatatatcatattgtatcatatatcatatgtatgatttatgtatgtgtgtacatatatatgtgtatgtgtacataagtgtgtgtgtaatttcagttgctattttcatactacaaacatgaatttccagacacaaaaatctgcaagaagacaatggtagtcacctgccatcttgttcctttataattcctttatattcattatataccatccttgaaaagcacaaggacattcactgaacctaaaagtatataaaaaatgcattgatttgaaatggacgtttattaccaaaagcgctaactgttctgattcactatgactcagatgaaatgctagaaccatgaataagtaacaggttttgtacgtccatgctcccaagactaaaagtccatagcaaaaaaggaacaaggtgctttttcaggttaacaccgtttggccacttcccactcacatattatggattggttaatagattttccccaaatctataaaaaaaaccaattacgttgggtttaagcatcactgaattcacagtagctcttattgttgggtcaccctacagcacagcttccaaatttaattacaaaatgacagtgaagtatctaaatcaaaatgtttaatcaaaaaaaccttttagggtttaattagtgaagttttacccagattcatgagaaaaacagacacctaaaaataatattacaactctctcctccatttattgactttttgttgttttccttgggcagggacattggagtggagagtttagatacttgtcaaactacttgagaaaataaggttgtaactgctttagaaaacacctgctaaaccatggcatttccttactattaatgttccacatgacataaatatgttaaggaaatgggtcacaggagttttcatggacaaatggctaagggaaatgggatattagtcagaatttgtgttcttatgacgacttaattggaacccaaagcactccagatatttggtccctctttgctcatgaaaaataacctacgcagatgctggattctcatgctgaaagcaattccttcattaaagaaatgtctactttttgtcactacatagaaggctgcagtgggataccttcctagacctaagaaatattatcctttgagacagaaacaagtttaaaacctaaaggatgggattaactatatgtataaactgcctcaaaatagcagattttgacttcagtggcatgaccactagtgaagtatattacaaatgattcattactaaaaacagttaagcactgaagttataaagggttaatttttaaggtaagtagaagagattcaaagttattgctatggcaacactatcttgggtgtgagagaaaaggatggggtaacagcttgtcttcccaattcacattccttggcctattttacacatcacatgatctgggcacaccttcagaggggtgtagagctagtgaaaatctggtagtctaaagtggacaaaaaataatgaggaaaaaaaatcgagaacatctaccttaaaaacaacgcagtatcgtcaagattaaggcccagaaaagcaatcaaggatgactgaaagtgaacaagaataataatctactccaagatattaacacatctcatggctgaattaatgtgtggctaaaaaacaggcaagaaaaggggtgccatagaggggtgcctcttgcactgtcaggatatagcacatgcaagatgacccatatccactcttcttggcagctccgtcccaatgatagaaacagatttcaagatattctaccttaagatcacaattcatcaactaagtccccttacatgttcagttcaccaagcaaccttctgatacaatttgactttccaagtaagttttccttcaagaagaaaccaccaactggccagttgacatgaggatcccagcatatgtggagtatatatttcacattgtacatcagtaaactgtcagtcaaaactacgcactggtcacaagtattcatttcagtgtcaacaaatcctctccagcataatcaactcttcctttactgtcaatatggaattccttgttctgccattgtgtagagctcttctagctaatcagcagcctctctttctaatcatcacatatcccgagctcccagatgaaggaattttgtgtttcccaaatgagaccattcttatataaagaacaaaatgatgaatggcaaagtaaatttcactaaaaagtcctatgtcaagaattctcaaaatgccaaacattttctatgacttatgtgtagtgacgcaacataaactagagtagaagtctgaacaaaaatggtcactaagaccaccatcctctaagaatggtaaatccattagaatttggtcaaaaatcatatcaacagttccttagaaacaaatagatctttcagaaattgagaaaaatattaaaggaattacaaaattctccataacatcttctatatcaagggggtataagattcattcaaatatgagtgtgctgaagacaagtaagtgtgttcaagtgttgctatggctctgcatggaccaatgcatagccagtgtcaactacaagtgataacacgaagccctgtgggaagaaatagcagagattggaaaactaaggtgataaaatgaaacatcaaccaaaagaaaggttttgaggtgtctaaaatagggcagttctttattctggcatataaagacaatccaaaactatcgtcctaagtagtatggggacattttttttttggaagaaagaataacgtgagtatgattccttgagatgagaaaactggaatacaggtgtccatgccagtaagaaaactgataatgccctcagggtccgtataaccagtgaatgcacacctgctgaataaaggtcatgtgacaaagcatttattgtttctcaaatctctggaaatgaacctaagacagaaacaatctctagtaaagacatacatgtgtcagttctacccacagcctgctgtttgactcttttctccccagatctgcaaagcagggcatacctccacatctgtacaggcccctcctatctttcactaccagcttcattgaagagcaggtcatgatgcctcaccctataggcaactaacatttttcaaaatatgaacatgatgaaaattaaataccactcaagtgtaaagttgtattcttctgctgttttcattaatggcttggcaaatcaattcaaatagaacaaaagatgccttaaaagctcagagtcatccattccaaattcatttatgtactccatttcaaactaacttgttaggaatcatctattttttaaaaaattaaaaaagaaaaaaacagaaaaaacacatacatttcttcaggtgaccactgtgagccatgtagcaagtcaaggtcatgagacaacagccttgtgaagaattatataatgtagatatgattagaggcaaattcctataatgtacgcaataacccttttgatcacagttatttgttctatgcaaactaacaagaatactggctaccctgcctcctccattttttctgtactaagattctaaataggagaatatgattatcttgagaaatattcagaaagaatggttgtaagaaatacaatttcctcattgagaaaacaaactgacaaagctgtgtcctgacagccacagtgaaatgcagagctaagaaattattatgtggatgtaatatacatatcccctcatacaagctttgttttatcttaatatggttttaaatttggcttttaattttcacatccttaatgatgtcaaggatcttttaatgtgcttatttgctagttgtatatcttctctagtgaaaagtttgttcaattttttgtatgtttttaattgggtcgttttcttattatttaatactgagtatctatatttaatgaatatcagttatttaacaaatatatgttttgcaaatatccccccagaatgtgaactgcctttttattctcctaatagaggcttttgataaagcataatttatcaatttgttttttatggtttgtacttttgtggtcatgcctaataaatctttgcttaacccaagatcaaaaagagtttctcttatattttcttaactagaaactgatagttttacattttacatttagctttatgataaattttgagatgtcgcttgtatgtgatgtatagttagaaattccttattttgcatatgacatttcaagcagtcatcatcatttgttgatgactatcattttcccttggaattgtctttgccctttattaaaaataaatagtccatacacatgtagatctatttttggagtatctaagctattctgttgatctgttggtctgtgttgatgccaataccatgctgccttagttaccatagctttatagtaagtcttgaaatcaaaccttctctgtagtcctccaactttttcctttttcaaagttgctttgtctattctggatgttttgtatttccatatgaattttagaatcagcttgtcaatttctaccaaaaaaaagcatactaggattttaattgagattgtattgaacctatagatcaacatgggaagaatttacatgtcacctgtctctggaaaatccccaaatatttggaaattaaacattacacttctaaataactcttaggtcaatgtagataccaaatggaaattagaaagtattttgagctgaatgtgaatgaaaatgcagcatatcagagtttggatcatgatgctaaagcagtacttaagaaaatctacaccactaaatgcctacattaaaaaagaaaaaaaaatctcaaatcggtaaccatgactttcaccttaagaaactatgagacaaagtaaacccaatagcaagcagaagaaaggaaataataaagatggatattaataaaatagaaaacagaaaaacaatagaaaatattaatggtgatgattaataaaatatattaacctttagccatgcagatcagggaaaaagagagaaaacacaaactacgcatataaaaaatgagagtgataacattattaaaaattctacagatattaaaagaataataacataatacaaacatcctttcaatttaattctatcatggtccatgaacatatttgtttgccttgaatccttttgaatttattgggactaatttattctcccagaatatagtctatctttttaaatattctgtatgcacttgaaaaagatgtgtattcttctatggttgggtattctaggaatgccaattatgtcaagttgattgacagtgttgtagaagtctttgtttccttgctgattttcatatctacttagtctattaattattgagaaagagataataatgtctccaaataaattgtgaattaaaaatgtttttgtagtttgtttcaagtatttggtgcataaatgtaaaaaatgattatattctcttgataaacagacaacattatcattatgaaatgaacttctttattgctgaaacttctttattcctgtctttgttctgatatctactgtcatatattaatatagccaccaggctttcttttgattagtgttaagacagtataccaatttaaaaccttttacttttgtgctgtttgtgtccttttttgattgtttttgtttttatttgtatatgtttatgcgatacaagtgtaattttgttgcattaatatgtttaatagtggtgaagtcaggaattttatatttgtgtctttttgtataaaggcataatatatttgaatattacaatctcacaatctctgccttttaattaaggcacttaagtcatttatatttaacgtgataactgatttgctttgttttaattctgtgatcttcctatttgttttctatttgtctcacctgttctttgttcccttcttactctttttctaccttgttctggattaattattttatgatttcattttatctgttgctggctaatcagctatatatctttgttttgttgttttagtgattgctttagagtttataatatatatgctcttaatttacctcaatcctccaatgattttataacacctcatgcatgatactgaaccttacaatagatatcccatttctcccctactggactttttgctactgtagtcatatatttcatttttgtatatgttataaaataaacagtacatttatattattttgtttacctagtcaattatcattaacataaattagaaaaatcgtatatatttacctatgtagttgccatttttaatgcttttcattcttttgtacagatctatattttcatacggcataattatccttcacctttccttaaaatttcttgcatggtgcgtctactggtgatgaattcattaagtttttgtatgtctgatgaaaacatcttaatcacatcttggtttctgaaaaatatttttgctaggcacagaattctttgttgattttttttcctttcattaattaaaaaatttagctccactgtcttatttgcattgttccccacaagacatctactgtcatccttatgtttgtttgtctgtacatatgtgtaatttttctctggcagtttttaaatttttctcttcatcactggttttgagcaatctgactatagtatgcttttgtgcagttttccttatattccctgtgcttgagatgtattgagcttcttgaatctgtggatttatagttttcatcatctgacaaaattatagcccctgatttttcaaatatttttcctcctctctcctctacctggggattccaagtacacatttattaggctatttgaaggtgtcctacaattctgtttttattctttttttctatttccttttgggtagtttctattgctatcgttttgctactcttttcctctccgaagtctaattccatccagtgtactcaccattaatctcatctaatgttattctgtcaataccatcaatcacatttctcatatcagatattgtagttttcatatttagaagtttgattttagtcttttaaaaagatcttccatgtgtctacttctgaacatatgggctacagttataagaactgcttttatgtatttgtctgctaattctaacatctgtttcagttctgcattggtttcaattggttgggctttttctttttattattattattattattatactttaagttttagggtacatgtgcacaacgtgcaggtttgttacatatgtatacctgtgccatgttggtgtgctgcacccattaactcgtcgtttagcattaggtatatctcctaatgctatccctcccccaaccccacaacagtccccggtgtgtgatgttccccttcctgtgtccatgtgttctcattgttcaattcccacctatgagtgagaacatgcggtgtttcattttttgtccttgcgacagtttgctgagaatgatggtttccagtttcatccatgtccctacaaaggacatgaacgcatcattttttatggctgcatagtattccatggtgtatatgtgccacattttcttaattcagtctatcgttgttggacatttaggttggttccaagtctttgctattgtgaatagtgctgctataaacattcgtgagcgtgtgtctttatagcagcatgatttataatcctttgggtatatacccagtaatgggatggctgggtcaaatggtatttctagttctagctccctaaggaattgccacactgacttccacaatggttgagctagtttacagtctggttgggctttttctttattgtgggtagtgttttcttgctgcattgcatgcctggtaattttttattggatgccaaacattgtgaatttcaccttgttgggtgctggatatttttgtactctatgtatatccttgagctttattctgggatgcagttaaattactttgagacattttgatcccttttatgtcttgcttttaagattgttagatagaaccagagcagcatataggctacagcttattattccccatgactaaagcaagacaaatatgagtcttttacctaattttctttaaataatgagatatataaatctggctagtgggaataggcacttttccctgacttgtgtgagcatcaggactgttccctctaatcctcttggatggttctgttctggcctcaggtagtttcctcattgcatgggttgctcagtgtagtagtttccctttacacacagaggatattttctaagactcccaggggatgtctaaaacctcagatagtgctgaaacctatatgtattacacacacatttcttttttcttcttcacaattgcattgatagaagatttcattcttagcatagatcttagcagcctcagtataattttttttctttctttattaagtcaagaactttcgtctttttacttaaaagaagtactttgtggcttctctttggcatatgtgaattgccaacatctccattcttttgctttggaaccattgttaagtaatataaaggtacttaattgcaagcactgtgatacttcaacagtcaatctgataaacgaggtggctattaagtgacaggtgggtagtaagtagaaccagtacagtgcggataatgctggacaaagagatgattcacatcctaggtggaatagagcagtgatatggttggctgtgtccccacccaaatctcatcttgaatcatagatcccataacccccatgtgtcatgggagggaccctcggggaggtaattgcattatggggatgagtttttctcatgatagtaaataagtctcacgagatgtgatgattttataatgggcagttcccctgcacacactttcttgtctgccaccacgtaagatgtgcctttgctcctcctttgccttccaccatgactatgaggcctcctcaaccatgtggaactgtgagtccattaaacttctctttcctttataaattacccagtttggggtatgtctttattagcggcctgaggacagactaatacaagcaggatggcatgagatttcatcacattctcagaatggtgtgcaatttaaaacttataattgttgatttctggaattttccacttaatattttcagaccacagttggctatgggtaattaaaaccacagaaagtgaaactgacaataagggagtactattgtactcttatattcttcagacctctagagtttatctctctgtaatcctcttctctccagtattttattctgttaactaaagccatcttggtcttcctggatttttattcaacttctcaactcagagagtcactgagatgtgcctatgtcactcctctctatgctgtctggaagtactctcaatggctatgggtaattgaaaccacagaaagtgaaactgctagtaagggagtactactgtactcttatattcttcagaactctagagtttatctctctgtaatcctcttctctccagtatttttcctgttaactaaagccatcttggtcttcttggatttttatccaacttcttaactcagagagtcactgagacgtgcctatgtcactcctctctatgctgcctggaagtcctctcaaggcagtaagctgagacaatcgtagggctcatttcatttatttcctggctcccaaagatcactgttctccatttcctgatgtctggtatcttaaaaagcactcttccacatatgctgtctggggttttgggttgtttcaggtgggagggtaaatccagttcttgttacttatctttggcaaaagaagacattcatagactgtcttgccgaccctttccactcttcataactcacttttcagtttcatgagaccatccataaacattccagttaccaggatattcaataaaggagaaactcctgctgaattccctccctaagacttggtttataaccacgcagggcctaatcataatctgttgtttgagaggcacaaaagatggctatctcttatttctctgttaatgtgatcaagtaaagttaacggcaagtttgtatttctggatagctataataaattatggcaagtccatgaggctatgttattacaaacatgactaaaaatgcactgaaaagagtatatttgtgtggtaacccacaaatcttccgatgccaatggaaaagtttaaagatgattagaatcttggctcagagacctggatctttttatgtcaatacatttctccctaggggtaagtaaggtactttcaaaggacatccattctttgaagtcagttagaaaattactgctgcaaggtatgaaatagtactgcagtagacttacagagataatgtacagctgcaatgtgttcattatgccaggatgtaatttacctttcagcacatactacttccccctgtgcatgccctggctcatgggagtttgggaatagccaactgtgattcagtttccactgggtttctctctcaatgttcacattgggcatgaattgtacccagatactccctctcaaatattaaagagaactagtcaccaatggttcccagggattggtctaggggtagggacattaaaaattgttaaattgactcccactcattacctgacataataggatccaaaaagaaatgttcaaaaatgtatccagttttttctacatagttttaaaaacaatcaatatatctcctgatctacatatttcctttttaaatttttctgaagtagagagctttaatgaccaaaaagaaaaggataggtgggactcatcaaattgctttccacttcctgccaccaagaattagctttagtcctgttaaaggttttggactaaaatagtgcaagtcactgaagctcaatgctctaagttctattgataccaaagcagtaatgatgtcatattagtccatcaatgaatataaaatgcaaagttgttcatgattatgtttgtgtgcaaacttccaagtatacagacacaccaggacctacttgaggaagtggaagaacaggctatggagggaaacagagacagacattaaaaaatgtctcttttatttatagcagtctgcttactgccccatgagatccagaatcctgctcattaaacaatcaaactttacacttatttgcacaatagaacataaaatctattttatcacttcccccctccccccaaaaaaacctgtttaattcttttaaatacttgggtatgattcagttacaaagggcgcagttaaaaaggctttatgaaggtgataaaatataatccacaatgcccacatgacatcattatagcagatgtttgtaccacaatatacaaatgcaacaagattcaaaatggcatacgaaaaatttgggacttgatttattctgggcttttatgctatagaaatttaacaggaagctgtgggccaatagttggatacaggatggagaaagtgtctgggttctgggtttgaagttgacagcgttcctccactgtacattttctggctttggttgccttgatttggtattgatggctggcaaagagcctctggtatttaaacaaaccttacctataatagagtctggctcagagactgtcattctaaattctattttgttctgtgtaatttacttcttagtcacaattattcaagaagggtacactcattaggtaagtgatttccatttgcataagcacattggtaaaaaaaaaaaaattgcaggtatgtgttccccaggtattatgtaataagacacctggagttaattatttgcattgtctttttagaaaaagtttgagaacggttttcatgcatgcaagcaaagacagcatgtcataacagcttagggctgaaagctaaaggggctgcttcctttataatagatgtgcaaagaattacgttccaatttattcttactcttccacctggttacccagcatttgttcttcaaaggtattctaaccaaatgattcaaagaagagtttagcatcaaatatgatgtctccagggaggtatgatttagagagtctgggattctctcaaaaaccactccgtggaaactttaatttttagcttaatatgatgtctgtgtatgaggggataactagtaatgaacctgtgtgatagctgaaacaatgaagtttatgtaaaaggccagggcaggtgtttcaatcttatagttcaaagtgtgaagggtaatataatttgaactttcaggttttagaaacagtaaaatgttgttaatcttgcgttttgcattgtcattgcctttaggacttgttcttgctggcaaaactgtattttacaaccatatatgctgcctcccaacattagcactataaagacccctgtttttgtttttgttttaaacaaaaataagaactagttcaaggaaaaaaaacatgaaaacataaaacatggaacatttcttatttatgctgcatgattccccatcaaaaaacttataaatacattagcagtatatgatactccattctagctgtctgatcagcaagtctaaaataaactttttatgatgtttaagatgaaaaatggcaagtaggaaaagaaagggtatagaaaacatttgtgatggagaaagtggggtgaaggggaagagatacagcaataatttataaattattgataaagggataatagtaccctttaaatatagtgaagggtttttttcaggatataagaatatattcacaaccactatttcaattttgggtatgattctaacaagcttacattaaactgcacattttatggaaaaatgtaatgagaataatactcttaccatctgttttctttgaatcatttccgatgttagagtgatccttcttgtctgtcttatttttaccatctttgaagtcacctgaaagtaataaacatgacaaacagtatatgtatgcagctgagggggttgttataaacatctttaagtctgccaagttttgaaaaagtgcagcataattttatagtcataagagtgtatgtgtctgagtgtaaatatcttttgtaatcacgttaggtcctggaaattggattgtgatgcagaaattgaggctgaaagttcttgttaaacagagttgtagttaagttatgtgcttatcttctaagagaagcagttaagatttactgttaagctgtggagtgaggagaaacccgagctaactgtaagttctaccaattaatagctatttaacttctctgtgcttcagttttcctatctgtaaaatgggtatgttaatacctaccttataggcattttggataaattagaaggcatatcactcaatacagttattattattctaaaacagagctagaaatggtattttaataaatgatcttgtcaaaatgtagtttgtaaaagttgtaaaatgctattcttagaacacgtgtcaaaaatgtatttaacccacttatgagggaatagtaagaggattccaagagtactggagctgggtattgacaggtattttagaaacacgtgaaaatatatttgctaagttagagacaaaactgggtatatcctacagggcaataaaaccataacgtttggggttatcttctctctcagtcaaaaatctataaattagcatataacttcacagtacctaggcttgaatcaaatagtaagtaaagttaaacacagtcatgttcttcaagagtagcattcagcaaattaaggcccctgggtcaatggtgcccaccatcgattatggcaaatacattttcttgaaacatggccacacttactcatttacctattgtccttggctgctctcatgctgcaacagctgagctgaatagttgcaaagagacaggcaaagccagaaatattttctctctggttctttacagtataacagtgctgcatccctatctaaaataatttaataatccctgggcatgtgtgttcaacaatatgccagtattacatgaaaaggtcaggggcctcttcacccagccttattttcaagtgttggatattttcttaccagtcttactaatggaagctttctttttagcctgcataaaaccaagaacacattctcactcaaatactggtacttattgaagccaaaagatcccaataataattggagtgagctgggcctccagggaatgtgtatgagggacaggatttactcttgtttactttatttgtgccaggcagtatgctaaatgctttgcatgcatcattttattaaatcttctaatagccccattatgaaggggctactattattgaaagtagacaacttcatcaaagattcattcactaaatgtccaatttgtaaaatttgctgaatatcccactcaccaaatgattgaggatgttttccaaatttaagtttttttcttgaggttcctgcagccagttagacaaacacaggccattccatctatgttaaggggtatggactgcccacacatacatttcataccccaccctgaactcacatctgccacaaccatgcacctggatctccctcttggcataactgccaagccctcaactatagtatttgcaacttctctatgaagttcaagttttagatttcagacttctgtttactatttccatttctaaatgcctttggcctatgaatttataaagaactgattatctaagcatgattcaggactattgggggctgtaatatattctacaaaccacatacttgcaatggaatttgacaaatactaagctaagctagaagtcaataaactcttcaggttccctctcattcttaattctgaaatgggatggaccgtgatatggtttggctgtgtccccaccaaaatctcatctttaattttacctcccataattcccatgtgttgtgggaggaacccagtggaagagaattgaatcatgggggcagtttcccccatactgttcttgtggtaatgaataagtctcacgaggtctggtggcttcataaggaaaaaccgcttttgcttggttctcattctttcttgccaccaccatgtaagatgtgcctttcaccttccaccatgattgtgaagcctccccagccacgtggaactgtgagtccattaagcttcttttcctttataaatgacccagtcttgggtatgtctttatcagcagtgtgaaaacagactaatacacactaggtggaagaattgaggagcaggggagtctactctggccagggtccaaacaggaggattttaagtgcaggacatggtcatcacctcttccaccaccaaaagagaagaaatccttcagaggtcccacaaaacagtccaaatactggcttttccctattttaatgaagccagagatggactcaaggatcttgagcactgtagtcaaactagttccttctagttcattcttccctcaatgagcccccacactcttaatgcatgctttttaagccctctaggttgctctgaactggagctttacccacagctacagcaacaccaggatgtcttctggaagtcgtggagatggttccctttgctggttgctaaccagcagcccatgatggttcctgttctcagccagggatggggaggctgtgggaggaagtcatctcaacagagggcaaagattagaagatcctgtcactgccagtgggtgcccaaaccttgaaaacccctccttcaccaacaaccttcagctctaacttggaagatatcctgggcactccacaaagaagggggctgggacagtgacacatgcttgtttgatgatgttgcctgagcaaaatccattaagtaatttcccatgggttgtatctggagtaatggctgacgtgagctgttactcaataaacaaggggaagtgaaagagactttctgtgcagttataaatcattttaattaggctgctgtaatatagtcccgaaccaccattaggctttcttattattgctctaaactgctttcttttcccacctctcatttactgcttactttttaagggaaatggtagactgttgcttatttcaggaaataagcacagttgtgaaatcaagccagccttgttgaagactcaggttcctgttttgtttctttcaggctttccccttaaccaacttcaaaatgaattattatttccacatctgccctctctgggtctttgtttccctatggtagaattcatatccttctttgtgactagcttatttgcatttattggtttctcccactgactagacctggggttggcaaactatggcccatgggtcaaacctggccctactgcctggtttttcatgacccacaaactaagaatggcttttacatttttaaatggttaaaagaagacaaatattttatgacatatgatattatgtagaattcaaattttaatttctataaataaagttttattggaaaacaggataactcatttgtttgtatattatctgtggctgctttaaaatggcaatgttgagtagttgcaatagagaccttatgttctgcaaagcctaaaatatttactatcttgtcccttatagaaaaagcatgccaatccctggaataagtatattgtaagcctcttataaacagcagttaagtttccatatttctctgatggcccctctccctgaaggcaccaaaccacagggacaagctgtttacctaacagagcattgagactcacacagatcagagtttaacctgagatctctacttaatggttgcttgactttacacaagtgatttcacttctctgagactcagtattcccacccacaacatgggaatgagtttttctacctcatagaattgttagaacttttacatgatttaatgtagatagaatctcaagtacaatgtctgatacatgttaagcattcaataaaatggtggtattattgttattgcttttactaagggcaagacatttctaacccactctgttaaaagaaaaagcagagggaagaaacacaccttgcctttctcaccaccccttacatgttcctcttttgagaggagtgattatttatctgggaggtagggttgagcatgcacagcccggcccagccacccacatcccagactgctttgagatatgttttctgtaagacacacaccttttctgtcactctagaagcagcctgccagggtgctggggtgggggaaaagtcctgtgcctggctatacagtgtctggttgtgtaaattcatttcagagcaaaatgtaaagaagcccatgtattcagcagaccaactctgtgtttcccaagttccagttttagtggagctgatgtcttgatcattgactttctgattttgttacctatctctcagttggttcagtcctcagaaggggtagcaaggaggggcctgtactgccctctaaaacagtaacaggtacataataaatttttgttttaaaaaatttttgtatgaacatatgtttttattttttttaatttttatttccataggtttttggggaaaagatggtgtttggttatataagtaagttatttagtggtgatttgtgagattttggtatagccatcacctgagcggtatacgctgaacccaatttgtagtcttttatccctcacacccctcccaccctttcccctgagtccccaaagtccactgtatcattcttatatttttgcatcctcatagcttagttcccacttatgtgtgagaatatacaatgtttggttttccattcctgagttaattcacttagaataatggtctccaattccatccaggttgctgcaaatgccattatttcattcctttttatggctgaatagtattccatcgtgtgtgtgtgtgtgtgtgtatacatatatatgtacacacacgcacgcgtgcatatatatgtacacacacacacacacacacatatatcacaatttctttatccattcatggattgatgggcatttgggctggttgcatatttttgcaatagtgaattgtgctgctataaacatgtatgtgcaagtatctttttcatatgacttcttttcctctgggtagatacccaggagtgggattgctggatcaaatggtagtttgggtacatgaaaaattcttattaaattctttataacttttttttccagactataatgcacttgaatacaaagcaaatgaattaagagcaatctccagaagggggcaggacgagtcgggacaatggccttctgtgcctcctagggtggtcaccaggattaactgaagtaatttttgcaaggttcctggaatatgatataagctatcattattattacatgtgttaaaatattgttctctgattacatgttataaatggttaattataaaaataattggagaacatcgtgctaagcactttctacatgtagaaatcattgaccacggccctgtggcataatagctagaacacggttctgagtagattacctggtcgcaccaggcaggcaagagaatgaatatgtacaaagagaacttaaaacagcatctagtgtgcagtcaatacatgctatttgttgttattctcttcactgtttttactatcatgagtattactgaaggttccatgaggcctgtgctgtgaataggtattactatatacattgtgtagaaacagtagaaggttaagtagcctggccaaggacactgaaaagggagaagcacagcttgacttgaatctaggtctgttgactgctaaattaccttgctattcagccacaacctgtcaattgcaagctctggagactcagaacttcctgcctgcccctaaacaaggaaaccaaatcaaagccctgtgtacttgctcatcttgttctctccactcagaagtatctttagcccatctgaccagccagcttcagcattcaaaaccccctcttgaagcctactctgacatttaccccattttataatccccagtccccaaaaagctaatgtgtttttctctgcacatgttcctcgggcattttatctgccatgtcactactttcacttgcacatttcactagaaatatttggaggatgtctctatcacctttgatattttgggcttcttgtggcctttccatttctaaatccctagtgctaagcatggtgcttggcacgtagttgttaatcgatatttgttgcattaaatataagaaatcaataactatatgcacactatggtgaccagcttaccccagtttgcctggagctcttctgtttttaaaacagaaagctctgtgtctcccagtcccaggtaaactgaaacagctggtccccctaaagtacacacttgtacacacacagatatacagatatctattacaggaaaaggctcaggcaaacctgaggtctggccctcatagagcgatggtatatatgggaaaatgactttccatttacccactttacactcaggaatgtgctggggttgatcatggtaattttcccccagctggcaggcaggcaggcactggctagagtctccagggcagctggaaatggccagaaaggtatcaatctccctgaagaggatggcacaggtgagctggtagctgcttctgctggaatcctgcagcccaatgaggtgggatcagaaggaactggatgagcagggaagccttgccctgtgagctgaccccatcagtagggttgttcaccagtttccattcattatgtcattaatgccgcgaaaagagcccttcaccagtgtaagtctactcaccattctgttgctgttctcctgatgacttctcggctttggagtttttcccacgagggttgtcacttttgtttgcccgtgttccattgacttgattcttagtttctccagacgtctttttctcagctttgccagatgcgccttcttcagcctggcttttggcttccatttccttttgctgctcctctgcggccaggcgagccttttcctctgcttccttcttggccttctcctctgcatccatggcaagttgggaaagccacagaaaagagaaaaagaggtcatgccgttaggagaatggcctgttttagtacacaaagagtatctaaggtgtttactgagtgtttgggtacatttttgcttaattcatcagattggcatgtatacttaggaaacgaataaaataggttcataatgatgtcattctgaaaacagttagaggagaggtcagggagaaaataataaggataataattaataaaccaatattataattgtattattaatatcaccgttattaatagcttctattgaacgtgttcgctctgccaagtattatgctgagtgttttttggggattatttattttcatcctcaaaacaaccttacagcagctactattactgtgactcaatttgacaaatgtggaaatcaaggctgagagacatcataaaactttcccatagccacagtaaaaactgcagcttcatgtgggcttgcttaagacctagagtttaaacacaaacaattgattacaaaacaaaaagggaaaatatccaacactagagcaattgaagacaaacacactgaggacactgtttgttaatttaaaacaaggaaggggataattgagccttatgaaaaaaacatggtcttcaaactgtccacaagatgagaggtagcctttagtttggccaggtacctggtctgtgtctttccttttaatgaaaagatgctagcattatttctaatccagttgattataaaagggcttggctctgtgcttagtcaaaaccaccgcagaaatgcgtaggttaagtatttatgaaaagattggttcactcatccaactcatatttattgagcagttgtagcgttaagcactgttttaggtacgaggaatacagcagcaagcaagtggatttataaagaggagatcataattaagtaaacaaatgactaagatacttgcagtttataaaaagcgctttgcagaaaaccaagcagagtaatatgctggaatataatcagcataggggagggaaattgcagtagacaaggaggtggagaaggaaggcctccttgacaaggtgacatttaaccaagtcctaaatgatgaagagctggccatgcaataatctggacaaatagtatctcagtcagaggaactagaaaatgcaaaggccatgaggtagaaatgagcttggtatgctcaaagaacattgagtatggttaaagtaaatttgacaagggcttagtgatagatgacgtggtcaaatgaccaaggacaagcagggttcagatcatgcagggctttggaggcaatgaggtggcattgcattatggagaataacctacacagaagacacataacagagcccaatcctccaaggttctagagactcatcccatgcagcgcttaattcactgccaaggtcttctagcctgtgccatcaacttccactgggaaaagtattattacatttttctctacatgtgttttaaaatgctccacacatcattatcaggtgtttactttatttcttttgtgttagccttggtcctagaaaaaagctaatgctcataaataatccatttgtttttaatctaatggacaccagagtgactatgcatctatcatgtttccctttgttttagttgctaaagagctcaaagcccaaatttggtccagattcacacgttcacgaggctttatgacatgtattttgtgaaagtctatgatatcttgtttagtctacttctcctgactttatatttgcttacctaagatgtcttccttaatatattatgttttcattcattgatccatccatccatccaaaccaatgccctagcctcatccccaaacaaattaaataagattctggagaaggaggggcaagaataggatagtttgaatgttttccaggtgatttaaacatacagagttgagaagcactgatttaaatgttaaatgtttgccattcagtatttcatgacattctactccccaaaaggatgtatttgtaatttacattgaaaaggtgaggaaagatttctttacaaataacataattatgtgcatgtaaagtataatgtcttctggcctttatagaaaggtacaactacagagtgaaagaatgctcttgcagaagaagatggtgagatggcattctcagtaggatgcaggaccacaaaaggttccctggaatgttcactcaggctttatctcttccttcttcagtgactgaggatggggtttaaatgtcatctttgctactgaattcccagtgcttagcatggtgcctggtgcgtagcacacactcgaagtatttgttgactaaatgaaatgtaccctacgggtgtgatttatcctatatgcaagtgtaaccttatctgtatgtatcttcatcagtcctcagcaaattaaacaggcataaaatacagaaagtatataaactctaagtcttattctgaaagagtagtcatttgacaaatgttagtttccttaaccaataacgtaggtgagtaaaaagatgactatttttactacagagtgggaaactgaggcaaggaagaggagaattcattcatacccagaacctggtatcaattttagaaaataatttataagcccctcacagaatccccactgaatccatggcaaattttcaatattcaaaataaccccaagttggaaataattttgataaaaactgaaggtattaaatgctggtttgctataagagagtataaaatattatctgagcaagagaaattcatttgacaactgagtcagaccaatttcccatgggaaatctagctaaaagcatacaaaaaactggtggcggggggtatatttcagaaacaaacctggtttttcctcaactgtagctatcgggcaattcaagtttacatgaatgaatggtagcccttctgacatcatgatctaatcagatacgagcctatcctactgtatgatttctctacagcaatcatgttccagcaggtggtcctgcagcttttctactcaatttccatctcttagtcacatctctgagatagctgacattagtgtgatcgactgcatgacacccaaagtggtacaactcaaaatttgtagactgaaacaagcaagcacataaataagaaaaaagaaaatatattgacaggaggtaggtctttttaactgcaatcagattcctttatattttctgggtgaaattatcggtatagatgaaattttcgtataacaagaaaaaggacttgagaacagttattttgtacatgctcacagcttccaacgacagcaagtatacagagaattcacttttcaggtcttagatttagcatctactaggcttcttgactagtagaaagcaagagatgtgcggttcatttctgtttcctttggcttcccatgtcagactgtctgtggtgttgggacttgggatgaaaacagccaagagcaagcagctaagagttaaggtagagcagagccctcgagatccataaatttgcttcctcccagtggagagccagttctaccccacaatgcatgtccgtacagttttggggaaatacattgatttctttgtcttcctgaataatgatactatagggtctcagttaaaaactgtattgggctaattatcccttgatataattttctgaaatgcctacttaaactacctacaaccagagagagaaagagagagaaaaaacagagaaaagagagagaaactgaccagaaaacccaaaatactatatgaattttgactatttcaaatctcagttctatacaagaacaaagaaaggtgcttctagacatttaagaacatagaaggtgttcccgcttcctgaaaattttagtcaaagaaagaagtgctccagctgacagaaaacttcaatcaacattaaaaactcaaaaatgagaaaaatatgtaaacgaatcatatactgtaaatctaaatattcagtatcagaataaaatattcaaaagaaaggccaaatacaagacaatattatattatgatcccaatttgtcggcaaaatttttacttatacatatgtacagaaaagcaaattacaaagaataacatcagaattttaataatagttatatatgtctagagaggtaattagtaattttcattttcttttatatatattttttatacttcagcatttgtaacctaaacatgttagtcttacaccagaaaataaatgttaaaaaaaagtactaaatactgaatggaaattaatcaatattgatcagacttgaaaattgttatgtccatacatctttagttggcaatagtgatttttaactctaagggctataaaaatatttatttaatctttcctaataattatcagttcttgcctacctagttttgtaaatcaggttggttaacaaaaccaagacccatttccagtgcatttactaacaatacatgttcaagtgccccacggaggacagcctttcttgaaatcagggtcatctggaaaaaaagagcaacaaacaaaacagccaccaccaacagaaaacagatgcgaactagatttctaattagcaccagtcaaccagtcaacagcattactgagctgctaagaatgttataaaatattagttacaggttgctattttcaccaccaccttaacttcgtattcaaacctttaaccttcttttccaatttgcatacataacagctactacttaggtaccaaccttgtgcaggctgctttctcagtgctttataggtattacttctattcacctcaattctgcgatgtacattatcatccccaaagtgagtctcaaagaacctatctgaatttgccaaaaaaaaaaaaaaaaaaccttgcaagtcaagactcaattctctctccccttccctgctaattgaaatgtgccctgataaccaaactattctcccacaagatatccgtaacaccaggctctgtgcctttgcccaacccctttcttcttgttcccatttctaaatataacacctccttcaggtcttaatcccagaagtctgctacatgatgccttcccaaactcccaagcaaggctacagacaacttctttgtgcttccaaaatagttcaaacacacagttatctctatccccataccaaatgcatttaaaaattattagctgtttatttatctgttctttttaaagggccagttttctcctgaaactgtcaaatgcttccccaggtgattagtttctgaaggtaattttagtaagccagataattgcaaacaaattattttgaagtacctctttaaattgcatgttgtcagaaattgaattttcaagtgtaatgagtgtaattgattataagagagtgtttctttgcagatgatgcagtagctgccatcgctgcttgcaatgcctgccaacagggaagattgaaatgtttaaagcatttgaatggactaggagagggtgcacttaaaatatggaaggtgttggctccctccatagctcagggtgcaacatctgtcctgaaatgataagggttcaattatgccctaaaagtgccataaatataaaccctttgcctcacctgaaatgagcagccacttgaacagaattttatggacaagtcacaaaattggacagaattttgtgaacaagcctttgaataactccaacagtgaggctgctgctttcctacactagaagcagaacccccagccccaacccaatatatgggaaccaacactgctagaacatgctcttacccaccgtccccacccttctcacctggtatactgacaccaggagggtaaaaatgtgagatgttgtgtttggggaggggataatgtgtttttgtctgatgtgagggcctagggcttagactggtggtgctggtggcaacttcagggctttgactgaacttccattcttcctttgaatgaaattctgtagtaatgtctcttcccttcccctgccacaagattgtgagttttgagggcaaggatgtctgttactcatctctgtaccctgggcaccgggcacaacctggcacacagtaggcatgcaatagatgttagcaaaaaccgactcttgttgaaggctcacctctaggaagcccagtcccctcactgggctcccagagccaccatgtctttgtccctacctggaatcagacatcacagtgtcagaccccttatctcaggtttgcgctacctgtgcacaagggcatctctccctagtatgataatgtagaatgtaccgatcatggaggacatgctcagtagtcacaaatgcacatatgaacaaaggaatgtaagctttccaaatcatacaaatttccatatttttctgttgatagtaccaagggccacaacttttagttttgatgatgtctgcttcagggaatttctgtttaccgacaatttaccatcatctcagaagatcagttatatggtttgagcaatgagtgaagggaaactgagaatatgaaaggaatataaaaatgcctgtaagaaaattaaagctccttatatcccaacataatggccaaggcaaggtggctattagcgggtctttacttaggtaaaagaagaaataaaagcctcacagttgtgccacatgatatcaagtgaaaacgacaagatgtttagcagaaatcaagaaataataacacccatgtcctgtagagtcttcatactagaaaaaggagtttagtctcacagcataaagggaatcatgtcaggaggcttgcaggtctgctgcattttatcatgcattgattcgtagatattatgaagatcaaaagatggtagattctaatattcggcaatttgaatctgcatcctgagcaactgtgctttatttgtaacacacataactcagagaggacaaccttgttttatgctgaattggtttggacaggtctgtggcatgttacctttgggtaccttggccctccatctctcccgattgatgtgcaccacttccgtccaagtagctttaaagctcttatagtcaacggagatgacagaattgttgatcggggcacttccctctgaaccagaggtcttgacacctgatcgcttggcatctgacgagctgatgctattcaaactggaaaacaaaaaaatcataccaaagaagagagttagtgtttggaaaatgtctgccaatgagcaagcccagaggaggaatggttagcactcctaaagttattgctgtgaaatatctggatcctgaggtttataattattctattttccacatatgaccggtgggaaattctgaattttcagcaggaaaaacatcaacattgcagtctcaagagtctctatattcttcatatttcttctttgctatttggcctcttcttttttccccataaccagaatcccctcatgtgaattttctctgctctgttctctgaaactgactaatttgaactgggacatctacttaattccacagttcacctacctgcttccacactgaccacttttccaagttacctagcaacttgctcctctttctttccagctctaccattcccctgcaagggtctttctgatcccagcatacccaagtccaggggaagtgataatttccttaagttgctggaagaagatggaaatgcggacagcatggagattgtgagggactaggtcatgcaaaagaccttatgggtaactttgtaaatattagaaagcaccatctttctggaaaatctcaaagaagtaactactgctaccaagtggttaaagaagtgactggtaggaatacaaattcatgatggactagacaagcagaatatatttcagtcactgcctgaagagctgtggggccatggggactctggcagggggctctgtcctccttgttagcaaacttaagagggtctatccatctggagcatccctggggtcccctgtcctaacgcctgtctttctttactccttttcctgctctttgcttcttcttttcctattcattccacttctcttcttcctcctttatgacaaagcccactgttctacatgaacaaggagattagtagtagtcgtaatagtagtagtatatctaataaagactttatggtagctagcacttcctctgttctagatcctgttgtaaggtttaacatatttttaataacttatttcgtcttcccagtcacctctgagtattataatccacgttttctcagatgggggaagtgagacaattggcctgcgattgcacagctagtaagtgatgaggtcaggagtaagtgatgaggagctgcccttgatataatgatgtggtggtagaaggtgatttcaagctttcgattctttttctctacttcattctttgtgcaaaccttgaaatgaaagtcagtttcatttctttgtaagtattcttgatgagtggtactgtctttgtggagtattacatgagcaaggattgtctgggcacagcaggtaaacatgcagcaaatagggtggcaggggggcagcaccaggtgcctgctggtcacgatttagaccttggtcaccctttacagtttagcctggagagtacggataatacaatttcaactcctctgagaaaaggaaagaggcagacaaatttttctgagaaggagctaaggcaaatgccattatgaaataccatccccatccccagcaaaagaagaattctatcctcaaggacaggccaacctcaccctcagccctcaagcttccccactgacctcgaacgcctctgtcctgtcccaccagtttgagaggtttcatcgattaatggactcacaatcttctcggtcatgtccgtaagcacagtgaaggtgggttccacgatgaaatcaatgaaacctgaagagaaacagcaatgcttcagaggaaccacatattaccttgggcctttccatactttccagaagaaactgatctagaagttccagatcagattaaaagagaatggcttgatcttatgtactgtatgtattccttgatttgaatattacatgtcagtttcatttctcctacataacttcctatgacttttcaggatacagttcaataaagtgcctaagaaatatacactcaacacccactatagaacaagcactgtgataagagctgtgtaaaagaccaagactgaataacacaacctgcctgaagttgtgacatttgagctgaacccttaagaatgggtggagaggaagatgtggctattcactctgggcggtgggaatggaaaaagccaagtgacagagatgggagggtgtaagatgtgtctggggactgactagggagtagggattcttttggatttggggaaggaaagcttgggaaggcaggttatcgacagctctaggaagggaggcttctaagtgttcagatagagggttgggacttaggtggacactggaggctcctggagatgtttgagccgcattgtcataagagtttttaaatgttctttggaaagttaatctggcaagatagataagaaggaagaaagcaggaagggagaaggatgagaaaatcatttagaagctattgcaattgtttaaacaaaagataaagaaggctggaaccagtgccactataaagtggaaatgcaaagcaggcacagatacctgcacagcaggaggtggtactgcctctgtatgggatctgccaaagacactccaacaacaaagcagggaaaacaggaaatagaaggagaataaggccaagaaaagacaatgggctcagtttcagatttgctgactttgaggtacaggggggcacatctagatgggagagggcaaacagagttggaagaaacaggattggaaagtggaagagggctcaggcctagaactatacctttgtatagtgatagagagatggctgaagtcgggctacagagattgtcccaacagctcagacacccaaatgttctgcgacaatcaggagagaaaataggagctgaagctagtggggatgctggtaattcattacacagtcacatgaaaaccggaaggaaactaaatatcaaccagaggaaatgttgtccattctccttcgaagggcatgtttggaaatgtatgaatgcatatttagttttcacaatggcccaggtagaggtaaagctggcattaatgcccagcagtaaaggatgttaaaagtcctacaatgtaattgacaaaacaagaattgtctcaaccaaataccaatagtatcgtgattgataaggaaacagtgatagccaaaagtgtattatggttaatacagtgttgtaattgtgtatgtgtagtatgtattgtgtattatggttaattatagtgtagttttaagctgaaactaaagtatttgatgacaccatttttgccttttttttcctgacaaattaagctcaacatgtccaaaccagaactaactcataagcttccccacaacctttgtaaatgggatcatggtccaaccacttaatgtagagttctgcctttatctcagctttgcgttcagccaaatccttgataccttatgtgccacctctcttctggagaggccccgttactaccttagttctgatattcatcatctcttctttgtaatcctgtaggaggcagtcaactactttccttgcctctaatcttactgaaaatcctccaattaatcctctatgctactggcaaagaaatcttctaaaaacagggtaggcaaactttatctgtaaaggaccagatagttattttagactttgcaggccatatcatcgctatcaaaaccacttaactctgccactaaagtgctaaagcagccatagacaatatgtaaatgaatgcacttagctatgttgtaataaaactttatttacaagaacaggtggtgggccagattaagcccacaggctaaaacataaatttatatatttttaacctcacttaaaattctttagatatgccctcatttcctacaagaaagtataaacacatgctattattaacactatataaaatctgggcttgatacgtccctcactacatcctactccgtacccaatgttcttgccatatggaaatgtttagaatttgctgaccataccaggcagttttaagtttccctgctttgtatatgctacattctctgcctggaatacccttctacccacccctagctcacctccaacacagatcaccatttgcccagacaatgcctactcacttcttgggactcaattcaaatattatcccttaataaacctaatggttcacacactctgttgtgtaccttatcgtactaggtacaaaagtctaccttggcattataacattctaatagatttttgtttttgtaacattttgcccatcacccaatactggtttaatgtctttgagagcaggtaccatatataatttgtctttgttcctataacatctattatcatgtctagcagtgcccaatatatgaagactcaatatacattataaaaaaagcataagcactcaaaacacaagtagaaaaatgcctaattcttattgaattttcttaaatgacttcagactcttcaaaggtggagatcactgacaacatttaacttagatagggcactggtgtcctctcccacagatgaagatttttaaaatgcatatattatggttattagcaattcaaaagttattcttaccttaaaaaagtgctttaaagaaaagaaaggatggaaggaagacaggaaacaaggaagaaaacattttaaaagatccattcatggaagtagattcaacaaggaaatggggctgtcctgaaaacagggctaggagaagcatcagtgagtagaaatgccttgttagcttacagtcctgcatgcagaatggcgggatggagtagaatgggcttcctgccaatgacacttgttatctccttggaaagttggggccccctctttctcttgacagggaatgacagagacaccaagagtatcattgtccaattctcccatgaacaagccacattccagggaaaagaatggacagagtggttccataaattgaatcaggcagagccatgagcacaacatggcagaatggagccagtttcccagccaaagaaccactgggatcatctgtgcttacttctacaggcttcctgctttggtgcttctatccaaagagctgcaaacacgtacctacttgtgactgagcaaccatagtggactttcggtcacacagaggagaaaaaggcagccccagctctgcttctctgtcaccctggaaaaataaaaggtcatagtaaattaaggaacagtaggctgggtcacccagatttcatttagcaacttctgccgccacggaggccactggtctttattttaattattacaattacattataaaataagtctttatggagcctgcttctctacataaaagacaccaaaaggctgaagccctctgggatccaatagttccacccaactgcaaagttcatgttgctgtaaagaaagcctcattgggcagtactaggacctccatggaaaataaggcaacaggcaatatgtcttgtggcctgcagccagcactgcaggcagaatttctgtgttttctcaagtcatcctgggtcaacctgtggccattgtttagctaatgaactcctcccagatgtgggcagtgtctgaaactaaaattcaaactggactgattcagactgattcttctagtgctacctaaagccacacacacttggagcaagtgcttctgggtttttaacctcagagaccagtccataatgaaaagtggaccaaaaagagaataaataattgcttgtgtctatgaagttagacaacaataaaacacaattgtctaaccaatatattctcaatctcaccaaaaagcatcaccataataagcattatgaagagtctaaataataatggagatgttttctaaaaacttgggccagaggcttaatacttgtcatacccccagaggaaaggaaaaataatatgtcacccttcttatagtagtgaagctgtgctaattcattttactggctcaggataatagctactgacttgtgcttgaatccctttctcctactagatgtgagatagatcacaggtaagttattttccttccatacattttagtttttatcacttgctaaatgtgagatagtaatctctacctcatagggttataaggatgaaagaggaaaatgcatgtaaataaataaaaagaactactgttgtttcccaacaggtggctctaatatttaaggccaagactcgagaaacctttagtgaatttgttcacctaatacactccgattgtaataagtactgtcaataaattaatgtaatagcaaataaagggtagtaacaacctgcaaccaggcctggttcaaaactggatgattcttccttctaaggcatgctaccaaagagaatggatattggctcacatgtagcattaactgaaaggacggaaaaggggtgtgtgtctgaggcagctcaacagtggggtcacaatgggagctggggacatccaagggtctcaggaatagtccctaagtggctcagttccttctgcaccctcttcctatatagacaccccagcggacacaatggcttctttatttcaagtacgcactactgaaaactgctctctcaagtggcatgataaaaatgatttcctcctgagtgatttctacctaggtgatatgtagaaaaggaagtgcatttataacataaattctagtggtgtagatggtttggtgggatagttcagctaaaacaaacaaaaccctttttattcccatgtagcagggatacaaattgttctgtcagtacattttaatggggagggtgtgaacactctccatgactattaaaatataaacactaatttggatttcattactgaacaatcacctgatactaaataactcctaattccacgaacttgtctatacccaaatatacacataatttacatgctttgtatttaattgagctgtgtagactcgactaataaaagcttatttttaaaacagaggtacttgaattccctttggaaagcagatatacttacgaattgaaaaaaaaaaacagtgctgataatgtagaggaataaacttctactcatgagtccaacttgagtgataacacaatactgtatgactctacagctatagcttaaaattattcatacacttcctctttattgaagaggtcaacattttcaaaagagggcaaaagtctctatttacacaaaggatttttaaaaactcactcatttttttttcttccaggacagcgcagaaaaataagtatcattcctgcagtaggggttaagataactccaactgataaagccacatagttggcacacagaaggaagataatgaatatttgttgaataaatgaaaagactaatttggttagaaacactcaagttcctttggccactcagacattcatgacagacaaactaaagacagcagttaggcaggtagctgttcaccacatccctattcttctcctcctccatttcctgtctacacagctagaccccattgcctagaatcactgccagttagtgctcaataacagaacgagagaagggatgcatttctaccacagttcaggcctacaatatctcttatgcctacttctccatgttttccccagtttgctggtttgatgtagacaagcactttggaagcaaggtagatggcagaatacggtctaaaatcattgcttatcatagaaccatctgctaatcaagaaacatgagtcctatactgtacatgagtgagttcaaaacttctgtttatgtgtgttgttatacatttgggggtagctatatgtaagcagcaaaccagtcaaaagagacaagggctccatctgtattggaagttcacagagaagatggcacctgtcaatgcaagagcttccaaagacatttaggtaatatctcaagtgagtcttttcaggtgaaatgaagaaaaagcaaatgtttgggaatgcaacagaaggatcaagttgaacaaagcacagcaatgtatattcttctttcccaggggaggaaggcacaaatataacatatgagaaaggcattgtgatgttggatttaagatagcatagtaaagttttagctctttcagaaattatcacctcaaaaataaggagagtaagaaacagaaatgcaatcacacatcctaggaaaaatctgtaatctaaaatcaaaactatatgagaaagggctgccaaatgctgtaaatatcagagaggaataaggcaagatgccaagaggctaggcagagaatagacattgaattgcaagaggccctacaaaagtaaggaagtaaaggcacacacacacacacatgcacgcacacacacacacacacacacgcacatacacaccgcttcataggaccctaataataaaccaaggacaattctagatagcttagaatactactgctctgattgccctgtggtacaaatctgcaaatagttggtctgaaaagaacacatttcactcaaagattgtaaataacaataataaaataaagtgaagaagaaaagagaggaggaggagaaggggcagacggaagagtagaaggaggaggacaaagagatgatggagaagatggaggggaagaagaaaaaggtgaagaagaagaagaggaaggaagagataaaagaaaaagagcaaagggaggagaaggaagtattataccatcagcagcagaagcaggaataaagaacttcaaacaaacaacagatggggaatactcatcagataaatggtgccactactaacagaaagaagcccctgaaattgttaagaacaagggctcaggggaatgagacctagcagagcacaggaaagacattgaaaagggaagaaaactagaactatcacattaatgcagattgtgctggaagcagctcaaaggagaactgaattgataaaaataaaaaggccagtgaaggcactataaacaaaaagagaaacaataaaacaatctgataatttcatagagaacaaaggaaaaaactcaccaacacgtgtaataaataaaaatgggaaaaatactatagacacggattaaattaaaagaattgtaagagatgtttgcaaaatataaaattgtacaacaatacaaagaaaatgaacctcacagtttttccaacatgacatatttaccaacgaggtgaacttatacttctttaaagtcaatatttcatcaaaaagtaccctgaggcagtggctcggattttgtaaattatggttataaaactgaagatgtaacttactctcttagtaaccatggaatgtgtggtccatcagcactgagactatgcccttattttaaaatgtaacccaactttccaaatgtaatttttaaaaacactctatagtgccattgagatttcccatttgaattgtccaatttaaaaatctatagttaagaactgaggcagcatttctcttacatgtgttacttactatagcttatggcatctaggttaaaatattaagtcaataaaaataatttactgaattttaattactaaaaaatagttccagtccaatgagttaacagtcccttcccaacaggcaagaaattcaatatggttattttcatattgcctctagcacatttttattcgagtatatgtatgtgcaaacaagttttcctttacgaggaaaaaatgttcatatgtttaagtaattcatttttactttctcataattagaaaaagaatcactttaatacctcaaactatatgagttagctattatctatcctttcgccatggaccaaatactcctagctgtagagggtttgttatggtttggctgtgttctcccaccccaaatctcatcttaaattgtagctcctataattcccatgtgttgtggaagggagcccgtgggagataattgaataatgggggcagtttcctccatactgttttcatgatagtgaataagtctcatgagatctgatggttttacaaggggaaacccctttcacttggttctcatgctgtctctttgctggctgccatgtaagacatccctttgtttttcctttgtcttccaccacagttgtgaggcttcctcagccctgtggaactgtgagtcaattaaacttctttcctttataaattacccagtcttgggtattctttatcagcagcgtgaaaatgaactaatacagtaaattggtactggtagagtgtggctctgctataaagatacctgatatgtggaagcgactttagaagtgggtaacaggcagaggttggaacagtttggagagctcagaagaagataagaaaatgtgggaaattttggaacttcctagagacttgttgaatgtctttgaacaaaatgttgataatatggacaatgacatccaggctgaggtggtctcagtggagacgaggaactagttgggaactggagtaaaaatgattcttgctgtgttttagcaaagagactggcagcattttacccctgccctagagatctgtggaactttgaacttgagggaaatgacttagggtatctggcggaaacaatttctaaacaggaaaacattcaagaggtaacttgggtgctgttaaaagcattcggttttaaaagggaaacgacacataaaagttcagaaaatttgcagcctgatgatgcaatagaaaagaaaaacccattttctgaggagaaattccagcctgctgcacaaatttgcagaagtaacaaggagccaagacaatggggaaaatgtcacacatcacagaccaagaggcctaggaggaaaagatggttttgtgggctgggcccagggtccccctgctgtgtgcagcctagggacttggtgccctgcatcccagatgctctagtcatggctaaaaggggctaggtacagctcaggccatggcttcagaaggtgcaagcctcaagccttggagatttctgcatggtgttgagcctgcaggtgcacagaagtcaagaattgaggtttgggaacctccgcctagatttcagaggatgtatgaaaccacctggatgtccaggcagaaatttgctgcaggggcagggccttcatggataacctctgctatggtagtgtggaagcaaaatgtggagttgaaacccccacacagagtccctactagggcactgcctagtggagctgtgagaagagggccactgttctccagatcccagaatggtaggtccactgacaacttgcaccatgtgcctggaaaagcagcagatgctcactgtcagcccaggaaagcagtcaggagggaggctgcacctggaaaagccacagggacagagctgcccaagaccatgagaacccatctcttgcatcagcatgacctggatgtgagacatagagtcaaaaggagatcattttggagctttaagatttgactgccatgctggattttggacttgcataggccctgtaacccctttgtttgcccaatttctcccatttgaaatggctgtatttacccaatgcctgtacccccattgtatctaggatgtaactaacttgcttttgattttacagactcataggtggaaggaacttgccttgtctcagatgagacttcgaactgtggacttttgagttaatgcagaaatgagttaagactttgggggactgttgggaaggtatgattggttttgaaatgttagaatacgagatttgggaggggtcagggtggaatgacatggtttggctgtgtccctacccaaatctcatcttaaattgtagctcccataattcccacatgttgtgggatgaacctggtgagagataactgaatcctgggtgcggtttcccccatactgttctcgtggtagcaaataagtctcatgagatctgatggttttataatggaaaaatccctttcacttggtcctcattctctctctttgctggccaccgtgcaagacatctctttactcttctgccatgactgtgaggcctccccagctatgtggagctgtgagtcaattaaacctcttccctttataaattacccagtcttgagtatgtctttatttgcagcatgagaacagactagtacagggtgatattgcaaaagtattatcaaagaaagcatatgacagggggagtggagatttggagaacatcctcctactactattagaaaaacagcctttggaaaaatagctcaaaagaagctcttggtgaaggatgattttgcggagtcacctgtatagttctagttccccccacaccatggagtcccctttgagaattactctgagagggtgagcaatgactctgcaaagagaattaaccataaactaaatagggtacctgttgacatacacatataatagctggggggtgctgcggtgtgtgtgtgtgtgtgtgtgtgtgtgtgtgcgtgcatgtgcaccatagacagagtgaaggaaatgccttgcatttcctaacaaaagggtcttaagaaaacatctcgtccaaccttatcctaaatccttccctccccccgctcccccaacataaatcacagataagaccatagggaattagagaagcaatttgattagactcaggccataaatcagtggaaataaactccaataaagggtcttctggcatttgtttaatgtgctgttaactctagccctacttcattactagatagtttcagaaggaaaacacacacacacaggcacacacacacacaggtgccttctacaatttctgcattcagacttgaaatctaagagtaagaattatcacaatctaaatttattcagaaaactaaataaatagcaaaagagcccatctcttgtcagtttgcgggacgaagttgtgacttgtgttattaagcagtgttttatggaatcagaagtctctgaatccatgctgttgaatctcttttcttgaattagcaagaattaactgaattagctgtattaacttgaatttattataatttaggtcaccaaatctatgtatcatgtcttcaatctcaggcccgcatgtctggatgcagatgtttgaatggcagcacctctagagataaggttagcacatgtgcctgagttggaaagacttcggtcttggtgctatgcatttatttccctatttctctagttccatgcaattttaaaatttgtttttaaacaatttataataattaaagatcctgcctgttctttttttctttttctgagacagagtctcgcgctgtcgccaggctggagtacggcagtgcgatctcggctaactgcaacctccatctcctgggttcaagcgattctcctgcctcagcctctcaagtagctgggattacaggcacccaccaccacgcccggctaatttttgtatttttagtagagatggggtttcaccatcttggccaggatggtctcaatctcctgacctcatgatccacccgccttggcctcccaaagtgctgcaattacaggcatgagccactgcaccagaccgatcctgcctattcttatagacaacacaactctggaacttaggatggagtgaagtttaaatacaactggaatggcagtttctagtgatttcctgaccccaaattgccacatctggtttggaattttgcgtcttggacttgtccattagaaagaaacaacccaaccaattataatagagacatgagttcaagattaacatcttaatcccatagggtgatgccaaagtaactgtcattttgtcgagccactagaaaaaaaaagtaaaagaacccctcaaatgacattttgacaaaagactgctacaaggaaatactttttttcccccaaacagaaatgcataggataaaaataccataatgtcctaaaaagcagtatttaggtaagattcaaatatcacatgaccaagaggcaaaataatctgtggagcccccctcccctctccaaaattactgtaatctcaatagtccttatcctagcattgctgagatataaaattcataaaatatccaatgatgacagtcctgatggagagagagcaacaaggtacctgtctgaagaactcctccaggagtgacattgtccagcgatgatggaggtcccatgcttttgctggatggctaatatctgctgtatgcagcataagggataaggcttttggcttttcaatgctgtaaaccaaaagcacccaaacacatgataaccacactcttcagaacctcagtaagagttttttaaaaatcattaagtttttaatctcttttgttcttccatctcaaaccccacttcagctaaattgaggaaaagacatcatttcatcctacaactgggatactcattaacttggtctccatatttacggaattggactctctggactcaaatccatttctggaatgactgcatccttcaaaaagagagcaagaatccaagagtcactgacttttattggttgcttctgcattggggatctctgataatttagtttcccacagggaattatttttaattctcactggggacaactgatgctgcctctattatttctttcaaccctgatgagaacataccttattgtggtaggtacaacttttatgctttctccttcaaacataatcattgcataagaacactctataaagttgtgttaaaggagatgctctttaaagggatagccacatagacgaggacccattcaaacacctatacaaacaaaaacacaagccacaagcacacttacgcttctggctgctgcagagcagtcttcattgctttgatttgttggaagtgacaagacatatctgtggccatcaccatttcaattaccaaggttcgaaactcccttttagagacaaccatggagaaaaaaggatggaagtcaaaaatggaaagtaaaaatcagtgttttttttttgccactgctaatgaaaatcagtcaacgatttctgacatttctaatctaatttgggtctttaaggtgagcttttcaaataaggaataaatgaaagctaagtattaagaaaatcatttattaggaatatgatacatggaatacacatatcatttggaaaattaactcacaggaaaaaattcaatgaaactgaaaattgtattaaaatgctcttttctccaaatgaattcagagttttaagaaagaattaacttgaaaataatccttggaggtaaattaatcatccgtatttcacattggatacaggtattccatctttttaaaaatagcttgatttttaatagagttttaggttgacagaaaaattgagcttatagtatagctagttctcatgttacctcacttccagcacagttttcttatttttaaagtcttgtgttaatgtggtgcatttgttacaactagtgaatcaatattgatacattatgttaactacagtccatagtttacattaaggttcactgggcatgctgtacagttctaccagttttgacaaatgcataatgccatgtatccaccatcacaatatccatacagaatagattcagcaccctaaaatcccctgtgctccttcgattcacccctctcttttttccctcaacccctgccaatcactgatctttttactgcctctaacgactttattgaggtataatttacatagaataaactgcttacaatttacataaattgcagaatgtaatgagtttaacagttgagtaagtttttgaaaataccactgtaatcatgataccaaatacttccatcatcctcaaacctagccccaggcaaagtttgatctggcttatgtctatctaaaatagtttgaattttctagttttatacatgtgtacataaagtatacacatatatatttagtatatatttcaaatatttaatatatattatagatttcaatatttatatattatatacacatatatttcatacatatatacatatttattatatacatacatgtagacatacatagatacacatatatgtattatatattaaatatgtgtgtatatatgtatatatagattatgtatatatgtatgtatacacacatacatatacgtatgtatacatacatacatacgtatatgtgtgtatacatacgtatatgtatgtatgtgtgtatatatacatacatatatacacacattattttaaaatagtcacacattgaaaatatacacacatattattttaaaatataatagataatacatattatacacacatacatacgcattatatattaacacagatactagatatatacacacgtgtttccatgtatatacatagacacacacacacacacatatataatacaaaatgtactctttctttactcagcataatgatttacaattcatctatatagtggttcatcaatagttcattttctcttattgctgagtggtattctatcatatgagcataccacagtttgttatccatttactagctaacggacattcaagttattagattctagtttggaactattgtgaataaagctactatgggtattcatacataaatctttgtgtagacacatatgttttcatttatctggggtgaatacctagaagcagaatggctggtttataagacagctgagtgtttataagaaactgccagccgggcatagtggctcatgcctgtaatcccaacactttgggaggctgaggcaggtggatcacctgaggtcaggagttcgagactagcctgaccaatatggtgaaaccccgtctctactaaaaatacaaaaattagctgggtgttgtggcatgcgcctgtagtcccagctacttaggaggctgagacaggagaattgcttgaacctaggaggtggaagttgcaatgaggtgatatcatgccactgcactctagcctgggtgacagagagagactgcatctcaattaaaaaagaaaaaagaaactgccaaatatttgtgaaagtggttgtatcactttacatttgaccactagcatataacattttcagtttttctttgcctcctctaatgagtctttaatttcagccattcttctgatggatatgtagtgttatctcatcttggttttaatttacatttctttgttgactatgtcaggcacattttcatgtacttatattccatttgtatacattttttagggaaatgtctgtttcaaacctttctcattttaaaattgaattgtttacttattattgagttataaaagtaccttacacattttggattcaaaacctatgtaaaacataagtgttgtgaataatttctccaatgtcttggcctgcttttttttaacggtgtcttccaaagagcaaaaggtttaatttttataaagttcaatttatcattaaaaaaatgcttcatgctttttctctcctatctgagaaaccgccacctacttccaaggacttcagtattttcctctggaagtcttgccattttagcttttacgtttaggtttataaccaattttgagctattttttgagtatggtatgtgataagggtcaaagttatcttttcccattgttccaaaaccatttgttgaaaatattttcttttccccattgaattaatttggcatcataaatcaattgatgagtcaatttcaaaactctcaattctgtcccatagttacgtatgtccatctttcaccagtgaaatgctgccttgaatactgtaacttaagcatgcttggaatcaagaaatatgagtcctctaaccttgttcttcatttaaaaagtattatttggcatttctatataaagtttataataatcatggcaatttccaacataattctgctggaattttgattggaattgtattgaaacaataaataaattttggaagatttgacatctttataataccgagtgttccactacatgatgacagtatatctctctatgtatttagttcctctataatcagcaatactacataatctttagtgaacatgagctgcatttgtttttgaaagctactactaagtattttatatgttatgtgctattgtaaaaaattattttattttccaatggtttgctgctagtgtctctctccctctctctgtctctctctctctctctctatatatatatatatatgtatatgtgcatatatgcatatgtgtatatataatgttttttacattaaccttgtattctgtgaccttgcaaaattcattatcggttccagtagctcctttacagatccttaggattttctacttaggcaatcatgtcatttgctattaacatcttaacaatgttgatgaatgtaagatcaagcatctttgtcttactcccagtcttaaggaaaaaacattcaatatttcaccattaagcttgatgttagttataggtttttcacacatgcactttatccagttgaggaagctcccttctgtttctggcttgctgagagtttttatgatgaatgtgttgaattttgtcaaatgcttgttatatatctattaagatgactgtatgattttctgtttgtttttaaatatggggaattcttttaattaatttttgaatgctgaattaatcttgcattccttggataagcccaatatatgagtcaggattctccagagaaaccaataggatagaaagagatttattatgaggaagtggctcacataattatgaaggctgacaagtcccaagatctgcagggtaaatcagcaagtggagatccaggacacccaatattgtacttccaacttgaaggctgacagctcaagacccaggaggagccattgttttagttcaaagacaggcaaaaagaattctctcttacttgggaggtggtcagcctttttgttctagttaggccttcaactggttgaatgaggtcaactcatgttaggaagggcaatctgctttactcagtctaccctcttatatgttaatctcatccaaaaacaccctcacagaaacaacagaataatgcttgaccaaatatcagcacacactgaggcccaggcgagttgatacataaaattaactatcacacatgatatattacctttttagtatattgttacatttaattagttaatattttactgagaattgttatagctatgttcataaaatacattagtctttaacattcctttttatgaatttttttccagagtgtggtatcaaaattatgtcttataaaacaaattgcacagtatttcttccttctctaaatacatttgcataagattggtattatctgttctttacatattgatagaattcaccagttaaactatccaaggctggatatttctttgtgggaatatttttgatgacaaagtcaattttttaacagacataggattgttcagactttctgtttcatcttgtgtgaattttggtaagttgtattttgcaaggaatttatccacttcatcaaagttgtcaaatttattgagataaagttgtttgtaacattttcttatgtatttcatatgtataggatatactgttggtactttgtgttctctcctttttattgaccagtctaggtagaaggttgtcaatcatgttgctcttttcaaataacagcttgagctttcttaattttttctttttattttttctattttattgatttttcctcttatcattactaatttcttctatctactttgaatttacattactgttttggtctagcttcctgaagtcattgtgtttggaacttttttctttcctactatgaacatttatagctgtaaatttcctctaggcactgttttaatagtattgcacacatttttaatatattgcattttcattcttgataaatttgaaatgtttcctactttcctctgattactttttgatccacaaatgatttagaagaatgttgtttaattttcaaatatacaggattttcctagatatcttattgatctctaatttaaatccattaaggtcaaagaacatactctttaagcttatgatattttaaaattattaaaacttattttaaaatgtctcagcatgtgtacttgaaaagaatatgtatattgcagttgttgcatggtgttctataaatattaattaaggcaaagtggctgatgttgttcaaatcctcttaggtccttagtgatatttttgtccagtttgtctatcaactgctgacgcaagaatcttaaaacctcctatgattgtgaaaatatatatttctcctttttctcctatcaatttttacattttatgttttggaagtctacagttacctaatagttatttatgactgatgtatctttctgatgacactcttattatcagaaaatctcctttctctttcacaatatcctttttcttgcagttcattttagctaatattaataacaccactgcattctacttattcttactgtttggtacatcttacatacttttactttgaacctttttgtgtatttatatttaaagtgtatctcttgtacaattgcagttggagcttgcctttttatcaattctaataaccttttccttttaagtagaatgtttagtcctttaacatttaatgtaattattaatatagttgcatttgggtctagcatgttattatttgttttctaattatcacctttgcttttttccctttgcattaacttttctgcttgagatattttttgtattatttattttttaaatcaattttaatttatctactgctaaatggtcaatttaaatttatcttttgataaataggtaaactttaacaatctttagctattatggttaatctttttagtggttgcttggggattacaacatacatctttaattttctgtctactgtataactttatgtaacatttaaaaatcctgcaacagtataggtccatttactaacattaactggtctttatgttatcattgtcacatgtattacacctctctacatacaaacctcatgagatggtgttgtaatttttgcttcaaatggtcaaatgcacaatttaaataagtgaagaaaaatggtattttacatttacccagatatttatcagtttattcttttctaaaagtctgatttcactatcatatcattttccttccaataaatatttagatttattaatctaaaaattaataaaatataaaataacaaaataatatttttgaaactaccttaaagaaagctctaaagaaatttctttagcatcccttgtaacgcagctccattagtgacacattcctgttgttttctattatctgaaaataattttatttcatcttcattcttgaagttcatgttcacaggatgtagcatcctgtgttggctttttgttttctttttagcactttaaataaattattctattgttttctggcctctatagtttctgatgaatagtctactgtgattcaacttgttctcctaagtgtaatttgtcatttttctttattttatctttgcctctcagcagtttgactataatatgtgcctcagtgttcttttcatcgaatttaacctgttttaggtttgctgagtttcttgaatctgtatatttatatgtttggcaatatttggaaactgttcagtcattatttcttcaaattctttttctttcccattctctctcttttctctccttctgagactcaaattgcccttatgttggctcatataaaattatcccacatgtccctaacttctactcatttaaaacagctttttcctcttactttttcaaatcaaataatttccaactttgaaacctgaaaaatgaatttttaaaagtcactgtttccttcttctgtcttctctatcatgcactaagcctatgtagcaaattctaaatgtagacattttatttttcagttctaaactttgtttttaatttatgttttcattttactcataaaccttataacaaaataatatttttgaaactaccttaaagaaagttctaaagaaatttctttagcatcccttataacacagctccattagtgacacactcctgttgttttctattacctgaaaataattttatacacaagcacatttttcattacctcactgagcatagaaataatagttgttttaaaagtccaaagtcctcatctgataattctaacaatggcttatcctagagtgtgtatctattgattgtcttttcccttactaagaaatcacattttcctgatctttatatgtcacttagattgtatcctgaacattatggatataagttgtagggaatctgggttctgttatattgctctgaagattgttgatgttttgttttagcaggcaattaacttgtttatactcaaaatacaaactctgtataggttcagtaagcaatacatcagatatcactggacacaaggagggaaacatcacacactggggcttgtcagggggtcaggggctagggaaggcatagcattaggagaaatacctaatgtagacgatgggttgatgggtgcagcaaaccaccatggcacatgtataaacctgcactttctgcacacgtatcccagaacttaaaatataataaaaaaaatttttaaaaaggtttgaaaaaaataataaaaggtggccaggcacagtggctcatgcctgtaatcccagcactttgggaggccaaggctagtgggtcatttgaggtaaggagttcgagaccagcctgaccaaaatggtgaaacactgtctctattaaaaatacaaaaaaattagctgggcctggtagtgcatgcctgtagtcccagctacttgtgagactgaggcaggagaatcgcttgaatttgggaagcgaaggttgcagtgagccaagatcatgccactgcactccagtctaggtgacagagtgagactctgtctcaaaataataataataataaaaggtttgaatatggcagagaacagcttcacacatattcagatacatcatggttttgaaggatttgtgtgagggcttatttagatatttagatcgtgtataatcctggcttcctgacaatctagtaaagtgttctaaagcttgcataattgcctcttaacatattttccaaacatacgtatgctacttctgttatacatacttttacttttctttttttttcttttttttttttttttgagacggagtctcgctctgtcacccaggctctgttctgtccaatggaatagaacagaggcctcagaaataatagcacacatatacaaccatctgatctttgaaaagcctgacaaaaacaagctatggggaaaggattccctatataataaatggtgttgggaaaactggctagccatatgcaaaaaactgaaactggaccccttccttataccttatacaaaaattaactcaagatggattaaagacttaaagtaagacctaaaaccataaaaaccctagaagaaaacctaggcaatagcattcaggatataggtatgggcaaagacttcttgactaaaacaccaaaagcaatggcaacaacagccagaattgacaaatgggatgtaattaaactaaagagctcctgcacagcaaaagaaactatcatcagagtgaatgggcaacctacataatgggggaaaatttttgtaatcaaaccttttattataacttttaccaatagtaaaattggatagagggttccttttttcctgaagtggtgcaatgattaattgaattgctctgcatttttcagatgctggctgagtctagcatattccaataaaatttaagtcaaatattcccatatgttttaataaactaaagctacatggaaactcttagccactcttaataaaaatcagcctctcagattgttcagtaaagttcatttctctaaatccttgaaagatggtgagcacacaaatacccaataaacagctgattatttaattaaaatatgaggactatttgagtcacaacggattcagagttttgtaaggatttagatgatctctgcctgcagggtttgaagtaccttaacctatatttatagctacgatgatttattggcttgctatatatgagacaaagtgtgctaagcattttaaaatgattatgtcatttatcataatctatcccaactgcagaataaatgttactatctattttcaagaaattaaaattttaaagatgtaaagatattgagtcacttcccgaatgtcatacagctagtaagtgactgagtccatattcaaaacacaggtatgtgcctaaatccaaacacacaatttctgtcattcatgcaacagaattaagtgtacataatttttttaagtgtccaataatttccttagaaaatgtcaaaagattgataagaagtccaaatcaaatatagggtgaaaaacacatgttattaaataaaagataaaattcagatttaaggaattcagataaaagcaacacaagtttcctaaggttaaaaaaaaaagcaaatatatccaaagtgtcctcagttgaacactgttagaagtgatttttcaaactttcttctttgagaatttttaggacaatattgaattatttgactcaaactggtttcacttcccaattcatcaataaaaagcaatgtaaagatggcaaaataaagtagttggaacttaatcataacattccatagcctttatttataaatatttgaatatctgtataaagaaaaaagagaaataagacatacatacatacacaaagagagggtgagagtgagagaaagaaagagagagaaagcaacacgaatcaacattttaagcaaggtgttcttttctcaaaaacagcatacttcatccaacttcaaagttccttccctggcctacaaatctctctcttttctcatccttacctccagtcatcctttgagaggttaatcaaaatattcatttcctcgtcatcttgcagaaggcgataagctgcacttaaatggtgattctccagtacagatctgtcattatacagaatagctggatcagacctgaacagaaagccaagcaaaattcagaatgttaaacagttgtgatttacttgggtaattctaacaggctagaacgcaccaccacttttttccatgtttagaaattatctttgtccccatgccagttatatgaaccaaaagctcaactaacactacaaatcatcaatagatgaatgtagggtatgttatatcagtacatgtgtgggcaggaaatatgtgacatccagcctgagaactctctcaaaactgttttacaaccagatctcaattacctatattagttgcaaaggtgtttttttaaaaatatgggtcatgtcaaacttctttatattttctggaatgacatttatttttatttttattttattcaatgaatgcactggtttatttattttagttgtaattttcagaacacatatcacctggtgggtactatctgtaagctgcctctgatagtggcttgatctcaacatttttccatgcaaaagccacatgtggaaaattgagaataaagaatataaagattataatgtcagtttttagttcctatctcaaagaccatactatagctgaatgtcactaaacacacgactgtataatattttaagatcttaaatttaatgaaagcttagattatttgtttctcaccaaggaagctgagtttcagagacttaaaaaaacttgttagagccctttggtggccaagtggcagggctgggatgaaggcaagatcttctgacagttgggccagtgcttccccaagataacttccacctgccattggccaaactttgggctgtatctatcataccttgaaactgttaggcttaaaattttattcatcaaaggattaagggcctggtcacagactttgttttctgaacagggatcacacaggctgagaggctttggataaagttctgttgaacagggccaatgtttaaatttcattccaaaccaagcttaactgaacacattggaattttcccactcctatggagataacgcagaacattcaaatcccgaggtgaaagatctgctgttacatctgttgagtaagttagataccaactgatgtatatttcgtgacacttttccacctcctgtaataaagccattctcctctgtgttgggactggttttgatcctcgtctccaggcaagacccacatatgttcaacccacctctcttccttgggcaggtgatattcaccatggtctctgtcctcagagcaaaggttccacccacagacatacattaaacagtgctactctatggaattccctgtattaaagggaattctgttcccttggaacacaaccacaaaaagctgcttttctgtggctgagactaagtgaggaggcaagaaggtggaactgaagcaagtagctgaagttcttttgtctgcttccattcaattaaaattctccttctgaacagagatcagacaatattgtcttcttttgtgtatactgtaatcaagtgttgagttcattaaatacatgtagattgatttaatgaacacaaacctatctagagtgtgcacctgctttttcaagtgaaatcagcaagtatttatttggtgttaaactctcatccctccctgctacattctttctctttgacttaccacctttccccataccctagctccttttgattactatgtcaaggataatgaactaactctactgtcagactctctccagttccacatcattgtcttaagagagggcaagttcttaggctaggagagggcaaggaaagttttatcctaagtagaaatgacaattgactggtgctattgcctggaattctgtgctgagaggaatactcagaataaacccacagtttagtaagaaaaagtaccaaaatcaactaacagtatctgttacaggtcaggaggttccgagtggggcacttggacccatatttaatgtctccgacgggaggtttgtgattacctgtgcagtccattaggaaggatgcacaggttgctcacggtgaaagtagcctacaggagacaaacttactcccggggccctgtgccagggagtggtgcaagcactaaacagagcagatacgaaatcagagaggatgagaagagatctcatcagaatctcagagatcagagggtaagattggtcaatgttgttaatgtcaacaaaaacactctaatcctcactgtccttattcttttcctttatgtgtcatctgggcctttacgtaaactgccccatttcctgttagaagtaggtcaagtatgtacagaacatacataaacaaatagcgaacattagaatagagaagaaaaagatatctatatgagatctgaacaaaataggagaattaggagcagatggcttcttaaactctaagtcttgattgaagctgatcagactgatctctcatttagaggttcattgtttcagaaattcaaaataggaaacctatgcaaaagaaaggtgactaacacctttctgatttctaaaactgtctctctgacccctcttgcctctcttccaaacatttaaacaccctcaccgagtctgaatgtggaaattgttggtggttccggtatgctcgtagtcatggatggcagctgagaagattatagcaaagatctccagctccgtcagccagttctgaaaggagattacagagcaatcagataatctgtttctttctcaaagtcttcagcttgctgacaacacacccacagtgctgcctttctaccctgcagctggtaagctattgccaaacacaagttttctgagagacagaaataagttattttcctgtgaagagacttggagacttgtgatttgttaacaatgtgttcagcaaggttgaataagctaagtagtagttttatctttttcaagaaatcaaagagaatgaacatgaagacttgaaaagccctcattgcatcctcccccaacttccaaataaagttcctaggtagacacacacacacacacacacacacacacacacacacacataaaaaaattagaaatttgaatgcaataccaagaatgaagagtaatagaaaacctaacgtctgattataggaggatatccactaggaagtgggtagagacagatggaaaaatactggctttctgctctatgcatgctgatgatgtttgaaaggacttctccccatccacaccatcaacattggctgtgggtcagtggttcacaaaatgtgttccttggacatgcagatggtgtcagctgggagcttgttagaaatgctggcaaattcttcagccccaccccaatctcactggatcagaaacgctaggttgtggcccagcaatctgtgctttaccaagccatctagatagttctgatgcacactagagtttgaaaactactgctgtgtttcaagcttccttaactgacttccatttaacggactctgtggatttacttcctatcgcttctgtaaaccatcctgccccatgctcacacgacagaatatgcctgactcaggccaccttctcatatcctttgctcacttttgctactagttaaattcatgcctacatgattcagtatgatttattctaaaccacattttaataaattgtatttgttattataattatgtaattaaatatgacacaaaccaataaaatatggacacaaaattggagttgttatttctgtagaacctaagtttaatgctttggacagtcactaaaagaactgctatcaaaatatgtgtgacaactgtgaaagagcagaacacatttatagaaaagttagagagcttctgcactcagtttgcttcatgcacatctttaagttcccacttaactttaaagagatgagactagaaatcttagataggggcagggttgatgtaagacaaatgtgagtatccaaactggtgaactcataaaagccctgtggtctgaattaaagatcagtgcataaaatagattcatatgatttaagttaacgcaaaatgagttaaaatgaacatttaagtgtttctaatttcccacttaagccatatctttcaattaactactaattttggagaattattgccttctttaaaaattggtaaggggaaaataaacaaatgacatagaacttatgaaaaatacttcagagtgagcataaacataactcatgaaaaaataaaccactatacttttgaaaatgattcctaacagaatccagcatgaaatgtcaggaagctttctggcatcttcaataatatacctcaaaaacacaaattgaggtacacggaacagaaagtcaaagagaaaacagactaagatgaaaatcaacaaaatgagatgaaaaaaagatgggcaagataaggaaagattgcaagaaaaatcaaagctgcaaaaccccttgtaaaggcagcaaagagcctcctcatcagcctcttcattgtctcggggggccccccatgtggcaggcactatgctaggtgcttttatatagaaacttatataactctcacagctctgtaatcataggtactgttgctatccccacttgacagataaggaaacaagccaggggtaggtgcaggactcactcaaggtcacacagccagtcatctgacaagccacacaccacgcctgcagaattctcactcataatcttacattgtattttctttggatcattgttcatgtgtttattcaattttgcataaaattatataggcataaatttatattgcacatttttcttgatattatccatacatatattacatatgcagttttttttccattttggcattgtctttcttttcttccccaatattttgtccccacccatctgtccctggttccctctacctcctctcccacatatatctcttattctaaggtcacgtaaagttaatttcactttttaaaataagattatgaatgggagacagtgtaacatctcaacgaatcctagtcacagaacatcagcccaggcagcagaaagcatctaaataacagtataattacagttctcacattacaaccatagtgatgcttccctccttacccaaataattgaacaaaatcctatcttagatataacctacttctattaaaccaaaaacaatgaatggttaaacaggcattcaacaacaacaacaataaaaaacaaaaccattgtctttaaaactcattttaccaccttagtttttcaacaaacgccatgcatgcttagaatcagttatgctgctttggggataagaagaaagaaaagtagtatctgggagaaacagcttcacagaggagagatgtttaagatgggccttgaaaatttgacagagaaagaaatgaaggtgggcattttcagaagaatgaactaaatgagcaagtcccagcagcaaaagcatgtccacctcaggtaagaaaatgatgcccttgactggagcgggagagaaggctgattgaggccctatgaggtcaggcattagaaaacacagtgagcgaggaatgtaaaccagattcagcaggcagtgaagttcacacgcaagagagtcatgccatcagctccccacttcaggaaggatatttggacaggaggagagaagggagataaaaagcagggtttttttgttttcgttttgtttttgtttttgtttttttttaaacagggtctcactctgttgtccgggctggagtatagtggtgcaatcttggctcactgcaacctctgcccccagggctcaagcaaacctcccacctcagcctcccaagtaagggctgggaccataggcacccactgccatgcccagctatttttttttttttttttttgtatttttagtagagatgggagtctcaccatgtcgcccaggctggtctctaacttctgagctcaagcaatccaccaatctgggcctcccaaaattctgggattataggcgtgagcaactgtgcctggctaaaagctgtatttttagattgaaaagttcatataggatgtacagacagtgtggaggtagaagccatatgacttagcaattatctgaattttggaagtggtaggaggaccagatgaggttgcagttaaggagaacaatatgttagatgacctcaacactcctagcctcactgagtggctaataaacccctcaggtgatattagatagcatcattaacagaaacagagaaagtgggagaagctattttggaggaaattgaacttcctattttaatatacctcagatttccttgcctcttccaaattaactactgtgaacccagaaggttttatgtcaacccataagaagtcagaaattaaagtcccactggtattttattccagaattaccaattggtggcaaggtacaagtcacagatgctatcagtattttcctatctacaaaatatgagtgtcacaactagttcatttgaaaggatgctttgacaagtggtaattggggaccttgagttttgctgtgtatgactcaagaaagcaagccacttgttcccgcatataggggcagatgaggagacatggggtacaacagagcagaggaaacctgaagggaaaggacatggccaatttctcattgttagaggagatactacaagcaagttgtgacttttctatgtgaatgatagagtttctttagtaatctgttagttttccatgctaccttaacaaatgctcagtcttggaggcttaaagaacacttccgggcctggcgaggtgcctcatgcttataatcccagcactttgggaggccaaggtgggtggatcacctgaggtcaggagttcaagaccagactggcaaacattgtgaaaccccatctctactgaaaatacaaaaatcagccgggtgtgctggcgggtgcctgtaatctcagctactcaggaggctgaggcaggagaatcacttgaacccaggaggcggaggttgcagtgagctgagatcacaccactgcactccagcctgggtgacagagcgagactccctctgtctaaaaaaaaaaaaaaaaaaaaaacttccgtttattggcacgcagttctgccagtcagaagcccaggccagtgtggatgggttctctggtcagggtatcccaaggctgacatcaaggttgggaaaggtttcctttctggtggctctgggggaaaatctgctcccaagagtattcagggcattggcagaattcatttccttctaaccttttccacagtttccctcttcaccttcaagctggcaatgactgttgggtccttctcacacttcaaacctctgactttggccatatctccttgactttgatgaacttgtgtgattacattgggcccacctggaaaatccaggctaatctccctatttaaattcttctgattgttagccttaattgcatctgcaaaatctcttttataatccaatgtaacatattaataaacacatgtgacaccagagaacaaaggttgcaggagccaaatgtctaccaataacaaccccaataaaattatttggcactcttcaaacaaaatgtaattttgatatccttagtctttcctgttaatacattgatattatgtattaatatgttaataatatgacattatggtaatgtcataaacgaccaaaaaaataaaaaataaaataaataaaaaataaaaataaaaaaataaaaaataaataataaataaaaaataaataaaaataagatatgcagcttctcctttctggaaaaaaaaaaaaaaaaagacaaagggaaaattactggcaccttgcttgacaaaagcaaggaaaatggccaagggatagctttggagtttgaaatcttttcacctaaatcaaaagtacactagagcttagaatctaatgaacatctattcaatcaatagatagctcttcaatttatttctgtctaaggattttctcttggaaatgagcaaaataattctgaaaggatccaagtatcttctaggcacttaagttaaacaataatgagtaatacaaacagattacaatgttttacatttacaaagtatcactgttgatgttgaagcccagacaccactttatcaatgggttgttttgattctctacgtgtcttacaatttataacactgaaatgatttaaagcgttttctccctcttggtttgtaatgaaaggttagagtaacagtatgttctccattcatcagaatgctccccactgtttttgtaagctcacaatgaaagaagtttgttttgagctgcatttcaaagagagagtaggtaggaaatagtttctatatttaagaatcattctaaatatggtctgaatcgatcacggaaattcaacggcaaatgagaaatgagctcatttaagaaagcatgcagtaaatcatgatcactgctatgatacaacatttatgttaatgataacttgtattggcataaatgctgggtgtttttggtgagagttgaagaagctgtgcatgattcacttttatgtccccagagtacactctgcacaataggtgtgttgaatagatgagttcaaagtgcatttttgcatccattttcatcctcatcacaatacgtggaagtaagtgcacatgaggatactgaggtgtaagaatataagaggctttttttttttttttttgccaaaggcatattgtagaagcatgcctaatatttaaatgcatggcctctgaagtcagagctgggaccgaattctggctcccgtactgtactcagttgctcgggctgccataacaaaataacacgggctgcgtggcttaaacaacggaaatttattttctcacgtttctggaggagaaaagtccaaaatcaaggtgtcagcaggactgttttctcctgagacctctctccttgccttgcagacagctatattctctctgtatcctcacaatggacccttctacctgcaagtgcatgtctgtgttctaatctcctctttctctaagaacaccagtcataatggattagagcccatccatacaactttattttaccttaatacctcttcaaaggccatctctccaaatacagtcccattctgaggtcctggggactaggatgtcaatatatgaatcaatgagaaatacaatttagcccatatagctactttgtaatagaataattttaatttctatgaattagagatttatcttccttaaaataagaataatattacttgtaatgggaatcacttttgattgcccaactgccctttttttccttactaacaatgtctctgattttgtttgagatggcagtgtgtcagacttccctatatatcgcagtggccatgagacacagttctggccaataaaacagaagtgaaagttgctggttcggatttctggatagctctttaaaagtgggcagatttatttggtttccaacttttgtgctttgtattctgccttatcttcttacctggatttgcaaaggtacatcagccattttacaagcataaggacaagagctacagtcaaagaggtgggaaggacactgagaagactgttgctgatgaagagctgccatgccctccctagaagtctctctggacagaccacacaaacacagaggacacccacacccctgacccatctaacccacctggacattcacttacaaatatgttccaacaaccaaacttcactagacattttgagggaaaaaagccaatagtgtaagaagattctcataaacaaatagcatattccccatcagttaaaagagataattctgtttttaaaaagacttttaaaggaagttttcaaaacgtgtaggtacattcataaatatgtaagtttgctaagacaatagcacattcaaagggcaaaaaaagaggagttcctgaaattaaaaatattgctaactaaaaatgttaaataaacaggttgaataactagaaggacatatcggaaggccaaactgataatgtggaagaaagagttgaggacatctctcaggaggtatcattaaaataccgaaagactggaaaacatgggagaagctaagaggtatgaagatgcattcagaaggtctaagagaagtgccagaagcagacagaagagaaaacagacagggagaaataaataaataacagagagtgtttggctttcttctttccaagcatatagtaggattagactttctggcccctttatggttgggagggactgtgtgagtcattttggccagtgagttgtgagcagaagtgatgagcagagtttctgagccatagaatttaaatacagatataggaaaaccagagcccctttctctctaccataatgcctgacaacactcaggagggtggctgtttagaaaacctaggcccttggagtgagaatgacacaggcagattctttaacttactgttacgggaagtgaaaaaaagcagatattatttctaaaccattgagatttggggattgtttgatcctgtagcaaaatacagcctaccctaaggaaaacactccaaatgaatgaaacccttaggagtgaagaagatgcattctcccactaatatgttaccttatgttatttttaagaaagtctatatataaggtcatacaattaaaaggcaatcacaagttttgaaatatttcacatatatgacaagtgttgctagtcatgattacttatgtttagtaataataataactatcatttactaatattctactgtatgctaggcattaggtaatcatttttattaagaatactgagaaattcaaacattttctcagcaaaatattaagttctcaggaatggagatgttataaccaaagaaaataaaagtggttaatacataaggaaaatgtttaatttactagtattaacaataaaaagtaaaaacacacacatatgaaactttagtgggaaaatattgctatgcaaggaggctaaccagaatatcatttacagtagtgaaaaaaaattttaactgtttaagtgatagaataacccaataatgaactattaagattttcttataataaatatataatgacatagggaaactatcataatatatgatgtattgactatatatatatactatatatatagactatatgtatattgactattgactatgtacatttatgatttattgactatatatagactatatatatatgtaaacagcctatatacatatagagagagtgagagagagtcaggatcacagtattagagacttatttatcctgtttgtttcaataaatcccagtattatagacttatttatcctatttgtttcaataaataggacattggccatatatatagccaatggtacaataatgtacaatgtacagtaatggcacaatatcctatataatatagaatatattatatatcctataactttaataatataaataatataaagttatatcataggatatatgatataatataatgttacaatagcctgtaatgttatatccaatatcctaaaatgttcacagctcactttacctaagtaatggtctcatagagaagtaattttacaaataacatttaaacaatgtttaactgtttaagtgataggatgacccaataagggtccataagatgatcccactactgggatgacccactagtgttaacaaacaaaaacttcaaacaatacagatataaagttccctttggccattacttcaggatgagaatctccccagaggtaaccactatcttcaatttactgtttatctttttagatgtttttcaatatactttcatatatatctatgtgtatatacatgtgctatgtttaataatatacatcatgtagaacatatttttctacaactttttaaactgaataatacatcttgaattttagtcatagaaatctatggtattccagagttctaactccctattgataggtatatactccgtaattgttcactatggcaaacattgctacaatgaacctgattgtataggcctccctgagtacacttggaagtgctggaggattggtatgtatatttttccttatagtaatcactgcaaaattgttttcttatatgactataccaatttaccctcagatgagcagtatatgagaacataatttcttctcaatcagtggttctcaacctgggacaattgcccctccaaccagtggtttatttggcaaggtctggagacattattggttgtcataactggagtggggagtagtgctactggcatctcgtgactacaggtcaggcatactgctacactacaatgcatagaaaagcaacaaagaattatctggccccaaacgtcaatagtgctgaggttgagaaaccctgctctacatcctaaccaacagttaatattatcacactttcaacatttttacccatatgtatataatggattaaaactgtataagtttatatatccttagatactaatgaatggtgcatcttttcatatttcttttattgattaaatgtattaccttttctgttaattgcctgctcatactgtttgactgaatttgtgtcattttcctgattcatttatacaatctggatcttaatctatgttctctatgtattttctccaaatgcttacttcattaatttgtttatgatgctttttatcctacaaaagcttttaactttaatgtattcaaattaatcaatattttgttgtataacttttgtgtttaaaagcttaattttaaaaagaatgtcttttttcaaggccataaacatattctcattttttcttctaatatgatcaaatttttacttttgtacttacatctttaattcatttgtcagattttttgggggtgaatgactcgaagtagagtgaaagcattctcttttttctaaataaataactgtagccaaaacattttttaaactgggtgattttccctattaagttgtctatagtcatgtcttcatgttctcacctgcaattttttttcttcattatactctagtcagtgttccattctcaccaaaccactgagatgactcatgtcaaggtcaacaatgacttccatgttgccagagtgaatggtcatttctctgtccttatcttacttgaccatcggcatgtcccatgcaatgcaccactctcttcttgaagcattctctttccatggcttccatggccccaaactcccttggtttataccccatgtcactggccactcttttttagtttctattgttggctctaattctttgccttcattttgatctttggagtgttccaggactcacttcagagccccttctaactatctattcactctgtctttagataatctcatctagttccatgtcttcttatactattgatatgtccaagactacctaatctacatgtttatccctgatctcccctggaactctagcaccctttttctttctgcttggcctctgtaaatggatgtctactacggatcttaaactctacatgtctaaatcagaattcttgatcccctttcctccaaaacttggtttgccaccaggcattcttgtcaactgtttatcaaaccaagaatctaagatgtattctcgattcccctctttaatgttccaaatcctattcaccacagcagtcctttgaactctgtctcagaaacagcactttcttctctccatcccagcagcatccttcctagtccaaactatcagcatctcttcactagacttctgcagaattttcctagcaggctgccttaaaatccattcaccacagtaatcctttttgaatctttatcaggtcacatcacttccctgtctaaaaccctgtagtggcttcctactgactgcacttaggataaaattggaactcattagcgtggcctgtaaagccagacctgatctagctcctgcttcttcctcagcctcataatgcaccactgtccccatcatgtgctgttcccactaggcttgccttacttctgctccttgaatgtagcaaagttattctcttacaggactcttgtactaaaaccctgcactaactctgtggtcacactcttctttcactcttagcatggctgaagccaaaaaacacaattatctcagcttaaatactatctccagagagagtcctttcctgactatgtaataaaacacccagctttccctgggtaggtcctctattttaattctctacagagtattaataacattttcttgattgcttcccattggtctcttctatctgtaacttcacaccagaatgttaagttctacaagagtactgataccctcttaacttgtccattatcttagtccatttgggtagctgtaactgaatgctataggctgggtgacttataaacaacagaaatttatttctcacagttctggaggctaggaagcttaagatactgaatgccataggccgggtgacttataaacaacagaaatttatttctcacagttctggaggctaggaagcttaagatcaaggcgctggtagatttggcatctggtgagggcctgcttctggatttatagatgactgtgtcctcacatggcagaagagggaagggaactcatttttataaaggcactaatcccattcacgacagctccatgctcatgacctggtcacctcccctaggccccactacctaataccatcacattggaagttaggatttcagcagaggaatttgggagaacacaaacattcagtctatagtatcccataataaaggacccagcatataagttctcaatacacatttgggtttattttttgaaactctaatcaattctattgatatatttgcctattttttcacaagcagcacatgctcagcttcagtatgtattgtaatatctaagagagtaagaactattccctattagattgttcttttacaaaattgtcttttctaaggttgtgaaatacctattttacatgaatttcagattcagattatcatgtttcatattaaaatccttgaaactttgaatagtattgctttgaatttatagattactttgagggaaactgacatctatatagtactgaggtttcactcacattaaaaacatgatgccttttccatttatttaaagatcatttttgtgccctttgatttaattttagtttcctttttattgtttttgaggctctttataggtgatttatatactttttaaaaactgctgggaatgtacatttttctattacactcgttaatttccagtgcataggagagctcttttgtctagacctatcgaggtattttatttgatctaaaagggctttattttctaaaggagatgatcacattatttcacagaatatatcttcaacttttgaagatatcatattgcatactgcattcttgaggctgagacttccagaaaaatgccaagtaggaatattaatgtgggtatccctgtcttgctccatgtattcacggaaccatcattcaatatgatgcttgctctaaatgtttggtaaaaatcttttattgagttaaaaatgttccctttataatcttgttataactttaaagatagtgttttaaatactatttttaagaaatcagctttataataaggaagaactgaaaaaatgatcataggttttacaaaaattctgcaacgttttaacaataatgcctaattgttgagcttcctttatgaggcagagtacttaatatttttgatactttattctaaccatcagagcacttctacaaagtggaatatttttcaccattttaaaaaaatgaggaagttttcgctcagagactcaagtaatttatcataggtcacaatatctagtaagcaattaggcagggatttatagccactgtatctagctccaaagcccacaatcctcccacatattccatttttaattcagtgagatattaggccaagtctttcaacagtcactggaggaaaagataacaaatgtgccctggatttatgggataattgataactatacccaaagtatgtctatcttaatgccaattctaaaggagatttcgaagtaaaaattcatacagacctgtttttgcctttaatggctatatctttttaaatgaatggcttacatcaaggaaaaaaagaaaaaagcaaagacaaccaagttgagcaggtcagtaaacacagaacacagattcaaaaacaactgaagatggtgcacgcccatagtcccagctactcagcagcctgtgatagcaggaccacttgagcccaggagttcgaggctgcagtgagctatgatctcaccattgcactccagcctgggtgatagactgagatttccatgtcttaaaaaaaaatttttaaagcaaaaccaaaaacatctaaagcgctaaaatgttgggccaaaagaagcaaggaacatttcaaatggttagaagtaaagatttaccattaggttaaaataatgaaaggcatacaaataggatgtgaataactatagtccctgtgaaaaagacttagtggcttaaaccaaaagctaactttgcgtaacacggttgccaagtacattgaatacaatttcagtatacatgaatatcattgttattgaccatagcaaaaggttaacagtaccactctccatatctagaaatacatatttagttgtagtctttatatttaaattggttataacccagtgaagacgcaaatcactactaggtatttatctcatcaggctcaggatggagaaaatttcagaggcaacggagaactccaagactttccatattggttagattactcctgggaaacaggaagtccataaaacaatgcatgactcgtggcctccacctcatcagaattggaacagtcaccattaaaaactcatccttacatcttttggggaacctaagagttcctatccctacttaccgccactcctgtcttatagaggaggtaatgcactgtctgtgtaacatcggcagcgtgcattaagttatggtaaggatttttgtgcttgctgtatcccacttccagggcctccacaaatgagacaagtgcagaaatggggatctgaaagagagcagtaaggttaattaactagtgacttcactgctttcaatggagacacagaagtctaaggcaccaggactgctttttctctgaaggcataacacatgaggaaattggaacttacacagttaataaaaattactgacaaaattatcagataatttgaaaatctaacaggaagtccttggttgagaaatagcctgccttgtaaatttttctttgttgctcattttagaatccctgagaaatgacatctgatcattttaagatacttagttttagtaacatgtaaagcagtaatttttaatacacacatagaaaactgagttgttggtgactatgttaattttctgtatttccttgtcctcctctactcttaaatacccttcccctctaaccctaagggaaaaaaagatgctacataggacaccaaacaatgttgtaaataacactgaggaattcaaaaataatactaataattagtaaccatttgtggaatcattcactatttgtaatgtagtatcagtagaatgaaatcttccaaattccaagtcactaacaataaattgccaagtaacaaacataagaacatagcctgtttctgttcccatatataacagactatcgcattttggttttgagttttgtttttgcttggttttgggttttgattttgttttgtttttcttatgtgtccaatgtatataaccactcctttcaaagggcattgttttcaggcagtttatatttgttttgcaataattttataacttaagatttttgtgcactttgttttcctacaaatgagatatgctgcatagtatgtattcatttatttctcaacgaataaaatacttcagtctttatttgcaactaccagtcactcagaatatttccaattagattaattgttttgtcgtctgaaatatgtataatatacatgccttccttttctatgtaacagcgaagaacattgcaaaatgcatatacaaaataagggcatccagaaaactttcattgtattagttttctggatccattccatggttcagggtaaattatacaatataaggctaggggaaaaggagaggatatgtcttcctgaggattaacaattacatttgtgaaaaaaaaataaggaaaatgctaagttaatactcctgagattccataatctgttctcccttggtcatattcttccattttaccatttgcagaattttaaaaattaaaatacaacctttaagaggtcagagatgaattcattaccatttttaaaaataaagatccaatgaacctgggctccttgggttgtttcacagagatctaagagtcgctgaaagggctgtgtgtgtgcacaggaactttgttccaaggaaagtctccagcatcctctccagcatccacaagattttcatacagatttccgatgcaaagaaaaattaaggacctaaggaccatggccatgaagtatttgtggtcatgtaaagacatatttcctcagtgggaggggcttcaagatggctaactataggcatctggcactcacctcctccacaaaaaagaaccaaaatagcaagtagataatcacatttcaaatagattatccaacactagaattcaacagagaagtaagaggaaacacctaaagcaaggaaggagagagaatcaaggcatggattggctggaatcctggagaggctatctctccagcgaaaagaaaggtaagtgagtgatggctagcagtccacattcccaccttggactcctgtatcctagccaccagaaagcccctaaaccctggcagaccctgagactaagacagggagctgtctggagatcacatgaagacattgctccatacagggagctcatgctgggtcccacacatcccctaaccccctacccagctacagcaaggcaccatattgagagcccagcccccaccagactgcatactacctgggggctcaatagtccttgtatccccataactctggagccccattgacattctctgcctgcagccacaactgtggctggctgttgcctccagggatgaagtatgaaccatcagcaaagactgcactgcccccaggaacaaacccaccatgcaagttcatgcaccctaaggacaaaaccccccacctgcagcagcttccatggagggctgctgcagccatgaccaaagcacaagtgaagtgcatgctccccagccacccgtatacagctgctgccactgaaagcaacaataccctccacagtagcagggctgcagatccaacaggcccagttccacaccttccagtgcctcaacacaccatctgggggcctgaggatagcccagtccagtccactactattgggaactgagtactcatctcaagcacctgaggtcaggcccactcaaactgatgctgcatcacagctggcacccacctatacatgccacctgtgagcctggagactggcccacctagcctgttgtagccacctctatgatgcttggaactgaggggttagtctcaccactgctacttccaatgctcatgccatgcctactgttcaggggactgagaagcccccaatccacttggcccactgctgccaccactggctcctgagcaagccacctggaagcccaagaatcaggcctcttggatctgctaacaccagtgcaagtgtagaactccctggggcccaaggcatgggacaggcatgcttggcccaccactgccactactggggcccaaggtcaggcccaactggcatcccatctccagtgaaacttcaccacagcctccactaacaattacactctaagctactgaagaaatcacgtacactgctgacacggtttacagccaaaggaatcatacaaagactgcactactacacacagccagaattaaagccaaagttctctactcaaccaacatcatagatacttcttcaggaaaaagtcttcccatgtgaaagcaaattttaaaaatggaaataagtgactgtttaacaagatgcaaagatattgacacaaggacacaataaacatttataaagcaaggaaatatgacacttccaaatgattgactaattacccagcaagagaccccaatcaaaatgaaatttacgaagtcttggataaataattcaaattattgattctaaagaagctcagtgatatacaagagaatacataaaaataatacaaagaaatcaagaaaacaattcaggatattaatgataaatttaccaaagagatagctatcatacaaattagcaaagagaaattatggaatggaagaattcatttaatgaaatacaaaatacatttgaaaccttcaacagtagactagaccaagcaagaagaaaaaagttcagaactagaagacaggtcttcacaaaaaatgcagtctggcaaaaataaagaaaaaagaataaacaaagcctatgtggcgaatggaccaccattaaacaaccaaatatttgcattttcagggtccccaaaagcaaagaggaaacaaaagagtcagaaaacctatttaacaaaatactagtggaaaaattcccaaacgtagcaatagacttagacacccagacacaggaagctcaaagattcccaaacagatacaattcaaaaagatctccacagcacattagagccaaactgtcaaaatcaaagacaaaaaattctaaaaacagcaagagaaaaacatgtagtcacttataaggaaaccttcatcagatgaacagaaaatatctcattagaaaccctacaggcaaaaagataatgggataatacagtcaaagtcctaaaagaaaaaaaaaaaagccaaccaaggatgctatattgagcaaaggtatgcttcattaatgaaggagaaataaagcctttcccacacaagcaaatgcagagggaattccttattacttgaccagacctacagtgaatgcttaagggagtcttacgcctggaaacagagaaacaacatctaccatcatgaaaatgcaaaaggaaaaaactcactggtaaagcaaatacacaaatgaggaagagaaaagacccaaatgttaccactacagaaaaccaccaaaccacaattataaataataagaatgtaagaaaggacatacaacacaatctgaaattaattaataaaatgactggaataagtcctcacatatcaatagcaaccttgaatgtacatcaattaaacttcccactcaaaaaatagactagctaaatggattaaaaataaatccatgacccaactatatgtcgcctataagaaactcttttcacctgtaaagacacatgtagactgaaaagaaaaagacataaaaaatattccatgcaaatggaaatcaaaagcaagcaggagtagctatacttatatcagataaaacagactttaagtcaaaaatggtaaaaagagacaaagaaagtcatggtataatgaaaaaggaatcaattcagccagaggatataacatttctaaacatacacacacccaaaagtgaagcacccagatgtataaagcaaatattactagacctaaagaagagagagactctaatacaataatagtttgagacttcagcactctatcatagcatcaaacagaacatctatacagaaaatcaacaaagttggatttaaacttcacattagaccaaatggacctaatagacacttacagaacattttatccaacagctacagaacacaaatttttctcaccaacacaaagaacattttccagcctagaccatatgttaggacacaaaataagtctcaaaaaattaaaaatcaaaataatatcaagtgtcttctcagatcacagtaaaataaaactagaaatcaataacaagaggaaatttggaaactgaacaaatacacggaaattaaacatgttcctgatttaccattggattaagaaagaaattaaggagaaaataaaaatatttttaaggcaaatgaaaatctaaacatatcaaatgctatggaatactgcaaaagcagtgctaaaagggaaattttagcaataaatgtgtacatccaaaaagtagaaaaattccaaataaacaatctaacactgtacctcaatgaaaaagaaagcaatatcaaaccaaactgaaattagtaaaaaaacaaaataatgaagatcagagcagaattaaatgaaatagagactaacaaaacaatgcaatggagcaatgaaatgagaaaagttgtttttttgaaaagacaaacaaaataaataaattgctagctagactaacaaagaaaaaaaagagaagatccaaataaacaacatcagaagtgaaaagggagatattacaactgataccacagaaacacaaaaggtcatcagagactattatgaacaactatgtactaacaaactggaaaacttagaggaaatggataagttcctggacacatacaacttaccaaaattgaatcatgaggaaattgaaaacctggacagaccaataatgagtaatgagtttgaatcagtaatacaaattctcctgaaaaagagaagtctaggaccagatggcttcactatcaaattcctccaaactttcaaagaaggactaacatcagttctcctcaaactattccaaaaaattgaggggcaatttctccttctccctaactaattttacattgccagcatttccctgataccaaaactggacaaggatgcaacaacaataaatcaaaattacaggccactatccttgatcacactacataaattcaaaatatgttacaaggctatagtaaccaaaacactatatattattttatggtattagtataaaatagtattttatggtattagtataaaatagtatttttagtatacttttatgctaatagtatatttttatactattagtataaaaaatagtattttctggtattagtataaaaacagacacacagtccaatggaatagaataagaaacccataaataaatccacgtatttgcagctaactgatttttgacaaaggcaccaaaaacttacagaaaggaccccttcttcaagaaataactctgggaaaattgaatatccatatatagaagaataaaactagacatccatctctcatcatatacaaaaatcaactcaaaatctattacggacttaaacataatactcaaaactataaaactacaagagaataaaacacttcaggaaattggtctaggcaaagattttatggctaacacctcaaaaacacaggcaataaaaacaaaaatagacaaatgggactatattaaactaaaaatcttctgcacaggaaacaatcaacagagtaaagagacaacctgttaaacaggagaaatatctgcaaaatattcatctgacaagggactaatacccaaaatgtacaggaaactcaaacaacttggtaaaaataacaaataatcccattaaaaagtgggcaaagatatagacatttctcaaatgaagacatataatggacaatgggtacatgaaaaaaatgctcattatcactaatcatcagggaaatgaaaatcaaaagcaaaatgagatatcatcttaccccagtaagaatggctgttatggttaaaaaaaaaaaaaagatgcactggtgaggatgtagagaaaagggaacacttctacaacgttggtgggaatgtaaattggtacagtcactatggaaaacagtgtgcggatttctcaaaaaaaaaattctaaaagtagaactaccatgcaatccagcaatctcactactgggtatttattaaaaaagaaagaaagaaagaaagaaatcagtgtatcaaagagatatctgcaccctcatttttattgcagtactattcacaatagctaagatatagaatcaagctaagtgtccaccagtggatgaatggataaggaaaacttggtatacaaccataatggaatactattcggccataaaaaagatgaaatcatgtcatttgcagcaacatggatagaattggaagttattacattaagtgaaataatccaagcatggaaagacaaacagcacatgttctcactcacatgtgagagctaaaatttgatcttatgcagtcagagagtagaatgatagatactggaggctgggatgtgtgtgggggtatagggggttggtgataaagagggattggttaatgggtacgaacatacagttagatagaaggattaaagtctaatgttcagtagcagaatagggtgactacagttaacaagaatgtattgtgcatttcaaaatagctagaagagaggacttgaaatgttcccaacacatagaaatgataaataatgcgggtaatggacaccccaaaaaccctgacttgatcattacatagtctatgcgtgtaacaaaatatcacatgtaccctataaatatatacaatatttgtaccaattaaaaaacagatacctctccaaatacacagtccctaggagaaaataaagaaccacatctccggagaaatcaatatgtggtacagaaaaagacttgtgttttccagaggctcatccctttgatgagggaagtcagaggagcttgataccatagatgttggcagatgactacatcaactccctgaggatctgaccccacctcgagagtctacagtattagaaggctgtagggagttgaacactggaaatgattcaagttctttatgtaaagttgaagaatcaatttgaagcatgaatggctggaaaataccaatgacctgtcacagatgataagtgatagtatttgtctgaatgagccaagtggtgggaaaaaaaaaagtttacagagacagcagatgttcactctgtctccactactgcccctctgacagcgttggtcaataggacacaaagtcatgtggaaatgagacctttgggcagagcctgaaagggagcttggttattacaggctttgggttgtacttccaggaagaccagaatctaaatgggtctctcctgtctctcccatgccgctgagacccaccagcaagggcgcaatcaaaatcaccctccacagaggaattcacagcagtggctatccgaaggatgcttcctcagtcgcctggagcagttttcattccgcatattaaaatagtctgaacccaaaagtcatatgaggataaacatatgcatgtagtttatttattttttctttttaaagaggtactgaccttgaaacggctgatcagatcataacgtgtgagtagttcatagaaaataaatttcagtgcatgatccccactggcctcattgagggaaaagacgtcaaaggaccacttgtccacatcctgcaggacagggtggggagaaagaacacattagcccacagacacttacacacctaccagtctcctcactttcaagtccgcctgcagccctcactggagatttcacagtgtgacactcaaacagactttccactctcaaactttttccaatctggctagtctacatagtatctactgttaaaaaaattaaatagtcttattactaatacaaatagccataatttattgagtacctactgtatgacaggcattatggttggtgataaatatgtaaattatcctgaaaacaactctaagtgatagatattagtcgcattttatggataagaaaactgataaattacctaatttccctaacacccaaggtgcgtaagtgctagagatacaggcagggccagaacacaaacataggttggatgcctaagatcagttgctttccattaagccctgcagctgctactgtttaattcactacagcctacgatgcttctcttctctgaacttctctgcaatcccttgacactatccaatgacttcctctaagtttacagttaagaatgttaactcatttagaagtgttcagaaacatgcatgatgtagaacacaaaacaatatgccacatcaatcgaaactgctgagctgaaaccaaaaagaaagcattcatttcatatgacagaaaaatgctaccatttctggagtcactagtctgggatcttgtcctcaaatctgttagtcactttactgaaaaaaagtaaaaggaaaaactaaactgaacacacaccttatataccatccctgaagttcaaagtctttgcctgtaaatagctactccaaaatatatgtaaatacagtctgttgagctttggcttatcataaccaacttcttgtggatgtagtaaacaaagatttatttaagcaatggttaaagcaacagtcatttggcttttcacagcaccaaaatctcacttcccgtggttaggtgaagcatattcacttgagcttgacagcaaggattcacatgagaccacactgcctacaggcaaggtgtcagatggtacactggcagagaccttggttctcatgagtgactctcaccccagccctcactgaattccaacataatccatccatcctaattttgttcctgaccaaacattccaactgtcaaattcatcccaaggccatcaagggtctccctcctggatgctaataaactgttttcagggaaaatagaattgcatataggaaaatcagacttttccagaggggtttaaattgaattgttccaattcacacttagtggtaacctcacttaagtcttcaataactgcccctccattaaaataaccaaagaaatagtgacaggcacatttctgtgagcacattttctgtgctaggcacagtgtgagtgtttacacgcatttgcaaaacctcgcaagtctagagataggtgttactttctccagttttatagatggcaacctcagagagattaattgaaatgtctagtgccataaggtagcagagccaggtaataacctcaccaatgacccttaatgatctcactgccaacagatgaaattgtaaatgccatgaatatgtgctgtgacccaggcctcatccctttaatatcccactagggcgcaggctatagacagcaaggacacttaagattaacctaagacctaaagctttaccttggttactatcattggcactgccatgagtcacatacattgtcttatctttagtcctaaggaaaaagtcactgacaactgagtaggctggaaaatgctgtgtcacttctgacaatttttaatcctagtgtccagaaaggaaagggctctctatcactagaaataaagagattatcatgataaaaagccaagatttattctgaatatcaggacttagagaacaaagaggatgagcaaatagagacagtgagacggatgtcctctttggtccctcatgttagggaaggcttagctgtaattctcagtctaatgttcttcagaaccagttgaggggcttggccaaaatatggaccctccagtggggactccagagaatcctgctgtggggcctggaatccgcatttttaacaagtacccagtttaactgccttcaaccattcttcctcattcaccaaattttgcccaaggacacttcctgtagagaaattgcaggaacttcctgttagtctaacacaaaggaagcgtgaacctcctcatctcctcccactttaagcctggagtctttccaaggtgtcacttcctgagtcacaaaacagatgcccttctaaagaagagcacacagctacatttccattaggctaatctcagaagacaagaggtagaacacctcaagttagaagcttacatctatatatatatatatatatatatatatatatatatatatataatggaaaaagtaaaataacataatgcaacatgtttcaaatttagagactgattcattactatcttacttaaatatcattttatgtcatgttcttacgttaaccacaaaggttaacatgacagtagcataagggttattttagggaattgtattctctcagtctttagggaaaatttctgtaataaaagaaagcagtaatgattccatatgaacttctggcaatgaagtggaaataatcttttttctaacatgtagtacataaagaaagaaacaaaagagtctatatctgtgatcgctccaactcattgcaaacaaaatcagcctctggagaagtggaaaaaacattacattgtaaaaagctttgaacttccccagtaaacaggggacatagccaagagaaatagcagcttcagctttaatgcacatatcaacaatatatgtgaggagaagtagcaatttatttagagagctagtaggtcttccttatctgaataatctaagtacctgtcccctcagacaacatgtgtgcatctgagattttcttttctctaagtataaaataacaattcatgcacatcacagtttgttccaattctttctcagttattctgcatagaaaagaggcttcaatttggatagaaaagaggcttcaatttggaagaaacattttcgtaaatgtcttggtaccagtataccctcttgtatttatgttcccgataaaggaaaaaattaaagacaataatgatgcttttaatgtttctaagagtttgattgaacattcaggttcaattatgaaaattaatacaacttcatagtggatgttaagaaatatcagatttcctgaagtgatttcactgattaaaatgggaaatatcactgtacattacactgaagtattgggcatcagattaggggttaaagaggaatgggagaaaagatacatcttcttgctgggtccttcctgagtatccttcctgcttttaagattaggtaagaagagacggaaagggtagagacaaacaaaggagaaatgagaatctgtgtatatatggtctctcaaattcagctagtaaatgtctctgagacaagagaaaggcctatgaatacataatcaagattgtcccaaggggctctttcttgacattaaattaatcaagaagcactccccaccccctaactccatgaataggtaatttagcttctgaaaatatcacctttttcaggttttggagaaagaaaacaatggctttagcaaaggtcaaaatgctacaatgtccctaagcacatggcccaagtccatacatagacaacatgtgatgtcaacaaactcagtgatcttgggctacaggatcagcaacacattggaatccagaagccaaatcaagtttagcaaatctcaaataccctcagaccaatgccttcaggaatgcatctgctttggggctgctggagatattctatacaattccaagaacttgcctgactagaggtaattctgcaggatttagcccatttaaactcaagcatttgtatgacttccatgggaacatttggctcagtgagagtctttggaaaacaatgggctatatagatgggacaaaggctctcaggccatacgttcatgcagtaaaacattactaagagcttaccatgtgctgaaaactctgatatcaaacattagctctgtctctaattaactctttttttttaaatcttgctgagtctcggtttcttcatctataaaatggacttggagtaggtaatcagataatgggacaattgcaaatactgaagatcctcctaatgctgaatacttacagccataacatatttgatctcgtatggcaaaatcagataactctcataatgacagatcactgtataaaatctaaactactctagagtactagaaagaaatgaaacccacacagagtttgattgtttttaaattgggaagatgaagggtgaaaagacagtgatactgttagaacaaataataaaaagataatgaaagaataaagtcaggaataactggaaaagtaactgtaaatgaaagcctcttattttctaacaaatttaactctactttttattaggtaccatgtacattgtaaaatcttttcactcgtattacctttaatgcctcaataacagctggtggatagctcagtccaaccatgtttgatgtccgtctatacattctgaaaagccaaaagggaaaaatgcaacatgatatcttataaagtaggatttgtaatccacagactcataccaagtattgacaaataataagaagtcaagtggggtgatccaaagaacctaaaattcattttttgacatttttaatattcactcaggtggtctaagtgttaaattcaaaagaaattaaagcaatcccaaacatatgaaccatgggggaaaaaaaacctaactctataggccccagactggaaattgaattattaaatgggtcacttcttccgccagagtgaattatagtacagaatagacagtaagcagagtagtaatttagcctgaatgaagaactcctatgggtaacccatttagaatagcttgttctttagaactgtcaaaaacaagaaggaaaaatgtcccaggtaatctttaaacttaccgtggtgtttctaaaatgtataattacactataaggattataggaagaatatatctatttctggaatctattgctgggtaaggaggtcaatttgatttcaaagagtaaaatagctaataaaactgaagtgtcttggggacttcaaaccactgaaatgaactgtcttccctgggccagcaacctcaaagcatcccagatctgtttcaaatggagacatcatccacctatttcaaaagatgatagatgagatgatttcctgctttaaaaattagagactgaactcaaactaaatcttctctggtaaacaaaaaaattctgagcaaaagcaaaagcttttcctaatgatgctacagagattaaaatagatatgtttttgccatttctcattcaagactatctgtttctacccacaattttcagtatttataaagataggaaaactacattaaagcaaagcttccagttattggaaacgtgttgctttggctgctttagtcactaaatgacaatgaatgacatctttacctctccacaaatatcccagcctgcactgcgtgaacgatgctcttgaaccggggcttctcgtcgctcctcctgagcatcatccccatctgccgcgtgaaggtggaggccagccagtctcggacctcagaaggcacagcatctgactgaatgtcactgagctcatcctctgtatccaggagtctcctgaacacaagaaacagaatcagcacactgagattaaatctgaagttggagctctctgttcaaagcagctgctcctctctgcctcacctgcatgttaggtgcaaagaaaccaaattaaattggccacaaaaaatacagtgcctttttggtaaggcttatgtaagctcgccatgtgtgtttcgcgatggtcttggcttccactgatatttcaggatggttctctctaccagactggacaaaggaactggtccattgtacccagaagcactctgtggcatttgagtgaaatttaaaccttctatttaaaaatgccttcacagggagccttgtattatttcatagatggaccatgtgacgttattttgtttaaaaatataaatggatacttaagagactttgcaaagtatttaccaaatcacagcaacccagtcctctgaagtagtgatcctaagtgatgacaattaagattctttccaggttgctaccaaaatttaaatgtctaaattcaaggaaaattttcaaaataatgcagttctttatttgcgcacaatgatttaatcatctaatagctgtgttttgctgatttttcaaacttgttcataggtcagaccactagaatcgaacacaaagagcaatgttaaaataaaacctaaaatagcatgtcatatttacagtaaacccaactaaaaatcatcagtaaaagtagctgccaatgtaaaggtgtttggattttttttttcctttagacttaccaattggggtggaggtaagcggaggaaacataacatttggaaaaaagctatgatatcgaatttccttaaattagaaaccaagtgtgtcagcaaaataataataatagtaaaccatacaaatcttagattactgtgaaatactttcagattggaatttggcaaataaaagacatcacaaatactgacagagaagcctgtctaaattagggggaaaaaaaaccacacctttcgtattcaacatttcaacatttttcaaaagaaatgcaattttataactttcaaacgtatgtagtaactgaaaccgctttaatacgtttagataattcaagtggaataaacctgctaagtaaatcagcgacatacgtaagactgaagagggaatgctgggtgcttaagagaacacatgcttctcgatcacttcaggagcctccatttactaatggacattatgaattaaaacataaactcaatttttagactaacactaaaaacatacaataattacaatggagctctatatctgatttttaaaatcttagtggatttttaaaaattcgtttttctcctctttcatgatctcacttccttgtcatggcggccatatgagatttgttctattagctccttttatagatgaggcggtacagagagtaagtgacttgtccaaatctatcctctttgtttgtggaaactaaaactcaaagatgagtaatttgaatgtcaccccattcctggcatgggggacaatttcagaaaagccatttaagagaaaatttactatcactatactaatctcttttgttatttttagcttaccttgtttcatcaatatacacagattcaagcactgtggctgcatattccaaattcttcttaagatctaccactgaagcttcccctctctctaattgtttgaccaaagaccgtaatctagaaaaataaaaagacataatttcattagaatagaggaaacaaagaataatcctacaactatggtgatacattttacagtcatcgaatattctcacttattctgatacatctgaaaggaaaataattatgggaccaaaggagcaggtaataaaataaatgtatacatttttgccattgtgaagtaagaagaaaaaatttctctccaaccaggcactgaccatactttctagctagcttttatctttatgaatcctaaattatcaatgattttgctttttctcaaattttcatcttttttgttctatgtggatgtagtaaagcctgaccagcagcaaaatcaccaaatacctcttgagattctgctctgttgaaggcacttggtccagcagtggccccagataatggcagccccatgacccaggcatgtcccaagacagatgaaaacatataaaccactgagaaccacaagagggctacagaaggaatagatgaaagtaaattgttttactggacagaaaaaatcactctgagaggagataaataccctagttaaaaaagaaaagaaaatatgaggattgattttaaaccgaggaattccagactatacaagagaagcaataaaacatgttttttctgttatttatatgaacattatctgcacagaggacttagtattcatgagaacaataaaatgactacagatgatcaacatgcggtaactgagaatactgtaaataccacagagatttggagattgggcaactcttcaggctgtttgataaccagcaatgaaaagagtagagactttgaagacgaactggggtttgaagctcacttcataacttattagctgtgcaaccctaggtaagttatgtaacatctttgagtgttatcttaatgaagagcaaagtatgaaatttctaaagttgacctaaagattaaatgaaattgatatagagtatgtgactcggttgttctttgaaaaggcaatcgttatagctattgtcattattcaatgactttgatcaccacagataaccaaatgagaaaaattctagcaagatatttaaaatgattgtcaaatctccacttcccgttggtatacgcaatctgttctcaccttcctgacatcaaaatatcctcaaataggttgccttcatggcaaggtatagactactcccttcctgatttgcatgaaaatgacccacaataaagaatgagaaaaaatcttggatcaaccttaaaaagtaagcaagagggtcaaccataaaataatttccaggagtttcaatgatataaaatacaaataacattagattcaggtagtatctacctgaattacgaatctgcaatatatcaaacggaaatatgcaaaggaaatcagcagaggcccctgcaggcttggaggtgaaggtcagccttggcaatgccattagcagcactgggaagagttctgaatttcagaggcagcacgagacagggagttggcagggaagggcatgccagtcactcacacagaaggatagccagcctgccaaagaatggggagacagcagcagggagctctgactgctgctccaaataaggattggaagctctttagcaaaacacattcctggctaagtctgcctccagttctgattctcacctcaaggtgcccagctatcccctaggctgtttggactcccaaacgaaaaaatgagagtaaaattaaacttttcaaagtttagtctcaaaaatgaaagtaaaattagactttttaaagtttactctcaaacataagagtaaaattaaacttcttaaaaatgcctctctccatttggggcttacaggttctatcaggaactgacatgtaactctagtagaatccatctcaattctagaacctaagaggaaatgacaaaaaccaagaaaatgatgagaaaaattataagagtaatagaagtaaaagccagaagatcctatctacctataatagaacttccctaggaaataaacaacagaagcagctttaattgaataagttttcctaggctaaagtaaaacctgtataagcagatgaaaagggatcaaatacaattttttaaaagtaaatgaaaacatcaaatgtatgctactgtaatttttgatttcaaagaataaagaaacaaacttgaaaatctttgagaaaatgaaatataatacttacaaagtaacaaaaaattgtcctggccatctacttctatcatgtcaaacatcaaaaagcaatttaataacagtaccaatttttgagaataatatgggaaacttcaagacatttatatctacatctacagagttaccaagtacataagaagccaataaatacattctcaggtgtcaacaacttcaaaatttatcattcatatcctttccagaaaacaaaacaaaaacaaaaactttaagcacagtggtcttccaagggagtgaattcgtgagtctccagttaaatggattgttgattcatgacctagatttaactaactcaaactgtaccaaatggacaagtaatttaaaaagattctggaaagaagagacagataaaataaaatgctgataatacaaggacaactaaacatgaaaatgagctgacacgtctccttttactaggacaatctcctatttctcatacaaacacttcctctcccacttttacaaactaaaagctaattctcatcagttgaaaaataattggaattattaaggacattatatggactatggatgtatagccactaatttttaacaattcccactcctgggaaagcacagtattgagagaatcaagtcatgaaggggcctcatatcaccttgtgatcagggggctgggaccccagggccagaagaggagtggggccttcagggaaagcttcacttagaatctcactcagctgttccaatgagtagcactgaaatcggctccatcagggagacccaggctttgtgccacaattagcagaaaatcagccattcagaggcttctccctgatgtagtcaccagtggtgccaggcagacattaggcagtcacatttatgcattcagtgtgaagttctgacccaacaggaagctgtaaatagaaagcaaaaccctagccaagtggtttcaacagatccagagaggaaatgacacagaaataatgcaccttttggatgcgtgggaggcactagaaatttatatgtaaccctgtctttccagcttatgagatgagcagaagattcaatcaacttcctggcagacagtgagggaacctagaacaacccgtcactctgtttatggaagaacacccagctgacattcacctttctttactcaaggatgatgaaacagaaaaaaaattcatgaagagatgcagcaataaagacagaagaaaatacagcattcaaaatgtgaaaggattcacttttgaaaaaaaaaatcactaatggaaacagaagtgaattttagggagcatctgctgtgtgttcaatacaattcaaaaaaaacccatagatctctgaaacaaaggtaaaagcccaaatcaacacaataagaagtttctttaaaaagaaaaaaacatgacaatagaaagactacaagaacttattgttaaaaagagttaagtggtgaccagctttgtatatacccatctcctgtttgggtgtcacccatgtcagatacaagctgcagctgccaactttctgctttatgtagctgccacacaaagcctagtgattccagatgcccctttcaaattctgttgagctttagcatagtgttcaggtgcttatgctccataggcccctcagcccacctttctctagctctttatccattccatttggaatatccagccctgccctgccatatcctacctacctcttggtgaaatggctattctttgggcaaaagagtttcaaattagctcttttatcattggccaatttaagttcatgagaataaggacccctctctatttgtcattatagtgaaggtattccttagatcttaatctatcttaagaagggttgtctgaaaattagccaggatctttcatacccatgtcataaagtatttttgttcaactggaaaagactagctgaggccagagggctcaactgctcttctttgttttcctagtaaagttgtctagatgcttttcatgtgaatccattccatctaaaaggcaaatgtcctcagaggccaggtcccatggtatgctgcagcctatattttgggaaagatggagatctggtgttttaatactacccaggggaatttttggtctggacacctaaggggaatttatttcatgagcatttgaaataaatttacaaggaaggaagataaagaagtaggaaaatatacaaataataataatattaataagatttctcttctgagagaatgaatgttcatagtttccagcactccatccatttctgtcactgcagctgccagataatagttccagtatagaagtgcaacaccattttaggaagtgcttatgccttccaactttggcaagatgcctttcagttaagacagtgtgcaatttcattgtggatgagccattgcatcttttcatgactcttgcatttcttggcgtaaactgtttgctttctgtatgcttcttacctgcaaggcatatgatgagatactgaatctcttcagttccctgtgccctcagatccagagcgagccctggatgctgacttcccctgaccccacaccaatcaacatgtgggatgcacaaaggtgttggaagaggggaactatgtgaggaaaggccagagcactgtattttgtaatttaaaaggatgttagggaggagagatatttcttttttttccacaaagataattcctaggaccaatggagtgagcttcattaaaaagcaacttattggttcaactttataatttagaaaactgccttatactggactaggcattattccccaccccagtgaggtcgcagaaagccctataaccctatgccttgaaaacatatacatttgttgagcattagaccctactagaatttcattcttttgcacaaataaaaatgaactataaaaagaagctatggaaacatactttctcatgtttgtctattctgcccaaggttattccctctgaggatgggggggcagctcctaaaatgccagtgtaaccaacaagtactgctgtctcagaaaggctttgttttgtttgaaaggatatgagagagaactggatcttttacagtactttctctacatgtcccaatggatcatgagccctaaaaactcatttgaattaaaaaaacttcatttcagttcatcacacccatgtattcgaacagcatactcatctctgtgtccttttcatacacctgcctcctccatgtcactcctgtcctctgccacttacctaaatgccataggaaataacttaaaacaactcttccaaatgggatgccccaacatgacttttagtcttatgctttaatgccatccaatgatgtcacccaagcatttttctggccattgtttgtttctataattaatgacagctgattaagatggccacacttgaaaaacattcaacattgggtgtcttttgtgtgcaggcactgggagagataggctctaggaatacaaagtggggaaatgcagtgccttctctcaggtagggaagacagaaagctaaccagcacccacaatgcagtactgtaagcgaaatggcagaggtgtgatgggggctaagaaagcacagaggagaggaatcttctaataacaaagccctccccagtggagttgaccagagccattttgaaggccacgtaggggtcagccaggcacagaggatgggatagggaaacggcagactctgcatggagagagcagactgaaggcagtgatctattcagatctattcagaatagatcttttcggatcttttcagaatagatcttttcggatcttttcagaatagatcttttcggatcttttcagaatagatctattcggatctattcaggggcgtgtcaaaagataaaacagaagaaggtaggaactacaccacagtagacttagaatctcaagctaaagaaatgtaattttctcctggagataatggggaacccctggagaatgttaaaatggaggaacagaatgatgagattggcattttagaaagatcaatctagcagctgagtagaggagcacacatagtgagtgagatggaaaattctatgtttccattgtaatcaggctggtctgatactctgaacagcacagtgtgaatactctctctcacatgatggaaatttgatagagtgatgcgtgagtttagtggtagtatggatggttgcttttaagaatttctgggaaagacattgttttggggcatgcggtttcctcattgagtgaacatcaaaccaaaaacaagaacagtgccaacaaaaattatgactggcaagaatagcctacttatgtagcttttaccttttgttaatgctataaataaaagagaattttacttctacagtttctaattacatctgcttaaagcagatgcacacatggattgaaataaattactggactccagttactttttcacttaagaaaaataattagtacctaggtgcatacttatgtttctatacttttatatgcctcactacataacttgttaactaaaaaaaaattagtaatgttatagaagattttgaataacgtcatgaacaaaattgacctagttggcatggaccggacactgcactaaattgctgcagaatgcaccattcttttcaagtgtacatgtaatagtaatcaaaactgaccatgtgcagggtcacagagactctcaataaatttcaagtaattgaactcagacagataatgttctgtgacaacaatgaaacacaattttgttattgattagaacccaaaacaaaaaatggctagaaatatttcaagtgtatggaaatttagaaatagatttctaaataacccataggtcaaaggttaaatcacaaaataattctaactgaacaataacatacagccttgtagtatgcagctaaagcagtgtttagaggaaaatgtgcagccttaaataaatatattagaaaaggagaagtctagcctgtaatcccagcactttgggaggccaaggcaggtggatcacgaggtcaggagatcatactggctaacatggtgaaaccctgtctctactaaaaatacaaaaaaaattagccgagtgtggtggcaggtgcctgtagtcccagctacttgggaggctgaggtaggagaatggtgtgaacctgggaggcagagcttgcagtgagccgagattgtgccactgcactccagcctgggtgacagagcgagactcagtctcaaaaaaaaaaaaaaaaaaaaaaaagaaaaggagaagtctaaaaataagtgatctcgttatgcacctcaagaagttagaagaacaagttactccaaagacagtaggcaatagcaaaaaataagcacaaaaccaaaacttaagtagcaacaaactcacagcagaaataattagcaaagccaaaacctgggtctttgaaatgcttaataaaatggataggtcaagcaagactgatcaagaaaaaagagaaatgatataaataaccaatatcaaggataaaaagagactattactacagattctgtggacatttagaaaggtaaaaggatatcataaattcctttctgaagatacatttaaaaatttagatgaaattttaaaattccataaaatattaatttatcaaaattgacataagaaaaaggtaaactattaataattctgtatcagaataatgatacagaattgtatcagagtaattgatctactgaatattgtatgggaagtcttcaccagttcaacaaagaaagaagaaataatagacataggactggaaaaaaataatatctttaaaaagcagcaaataagttattctaattaagaggtgaatttagcaatgccacttgataaacagcaataaacaattagaaaatggtaccattcacagaaacatcaaaacgaaacagtttctaggaataaatcttacaaaatatataaaatcatctacatggaaaatggtaagatattattgagagaagtttaaatgacctaaataatggaagaagaatccatgctcatgaattttaacactcaacatttagaaatatgaattctccctaaattcacctgtagattaaattacaaacaaattcaccacaagtcatttggtggaaaccgattctaaaatttacttagaaatgtgaagaatgaaatatagttgatgtggtaaaacaacaaaactgttgttactatcctacatatcaagacttattataaagcatttaattctggtcccatgtccctctaccacttcactattccaactctcttcctttcaacatccagctggtatgtgtgaggatgtgcatatgtatttttatattcatataagcacaacataagtggacaagaaaacatgctacaagaaaaaagaaaacaggcaatgtaagttgtttttgaactatcctattctacatgtgattgttccattccacatgcagggacccactctttggatacccagtcaagggcatcactgcatactctgtcttggttgccatggattttctgatgaatatttccattcctttggttttcgtgaagctatgccacagaggagccctgcatgctcagtctcctccttgttctgctctacagagtgaatctcctttggggatatatgtttgtgggtgtgagagtatgtgggcaactgtgtgtccaaagtgagtgtgtcagctcactgcatgggaacaccagccaaaatgcactgtcaagtccaaaagaagccttctattcttatggtactctagaaggtgttacgactcagggttaaagttttaatccattttgagcaataatattgactttgttcctttgcacttcttatcaaatgcagtactttagaaaggagctccctaacagtcattcttggccttataaataagtgtttcttaaaaaccagtttatcccctgtttttattgccaatcaactcacacattttgttaaaaggacatagcggatttttttttagagtaagattccaaattatgctaagaaaatctttcgtgaaggtaaacattctctctccaaagtttgtaggcgagcagaccttattgggaaaggatgttattatgaaaacccacttgttcttctgggtgaagaaataaaaaagaatgaaaaatacaacccagagcatcattcagaatccaccccaggccatgctggggactggggagagggaagcagttaagatcctgacagactaccaagaggtaagttccagaagccagtgttcatttgcagctattcatgtggaaagaatcactgtcacttctgcctgctgataaacatgccacttcaacatctgtcttaatagaccaaagaaatgagaagaactaaaaacatctttgaatggcactaatgagaacaggaagctgagcagaaatgagaagcaagtttgcaggaagatttaggaaggttgcaacccatgcctagacacgtcaagacacatctttccatgtcttcatagtcaacccggtcccgtgactcctttgctttccttttctgaatttagttcctcattcaacctcaattgcatcatgttggtatgattatccagaggagctaaagctccctcagccagcaaaatcacaggaattctaccatactacaaatataagttttggtaagataaacctaaggttacatttttctcatttctacttcttttttcttttataataacagaaataaataaattaattcatagattaaaaaccttcaaataatggctaacaagatgctgaattggcacagttccctttcttaagattaactcaagaaaaattataggaaaaaaacctcaaagaaaaccgtgagaaacctctaaggtgacctgaggctgccgctttgaatgtgtgtgtgaagacagtgcatcttcttggtctgggacaggaggcagccccaccacactggggaggaaatgatgggaaaggaactgttggagtctgctattgtttccctccactccacttcctccaggcgcacagtagctgctcccacacctcctgtgactcagaactctaaatgtcaagaaatcctggagagctaaataggggttgtctgtcccaccttgtggctcctctaagttcaccatgggtttccaagattgtcacagaaggaaaagggatgcaaaaggacatgtgcgagaggtttttatgaaccagactggaactggaactgattgctcctggtcacttccaattgtccagaagccatagtcacctaactacgtctttccaagagagaagctggaaaacacagtcctgtggtaggctcaagaggaagaggtggtggttttagtggagatccagccaatctctgccccacctagaaaatgcaatcctatcaccaatacttgttttttcctttaaacctttactttctgctcctttgaaagagtcaaatggaatgttgtatattaaagatactttctaactttaaaatcctttaaaactaagaaacgtaatcatcctaattatcagataatctcccaagcattttgacaaaaatgagacagttctcatgggaattatgttgagtgaagaaagccaatcccaaaaggttatatactatatgattccatttatgtaatattcttaaaatggaggacaagattaggggtttacagggattggagagaagggagaggaagagggagacacgtgtaagaagggcaacaaagggaacctactggtgaactattctataccttgactgtggtggtggttgtacaaacctacacttgcaattatgttgcacagaaccaaatgcattcatacacacacacacacacacacacacacacacacacgtgagtacaataaaactggagggctctgaataagattggtagattatgctaatatcagtatcttgggttgtgaaattgtcctgtagtttttcaaaatgtttccattggaagaaaatgggtaaagggtacatgggaattcctctgtattatttcttacaataatgtgactctacaattatctcaaaattaaacatttagttttaaaaagtgggacacagttatccagctcaatggaatattgatgacaaaaggctggacatagttgtcctttccccagctggttttataagtgtctctctgttcttaaatagtggtctacttagtgtcctccagatccttcggcttggcctcagcagcagtaagagagttaggggtaaatgttcaccagtgagctactaactgtgtctgatgactttggagagcatccagtgagggctataatcagtgatgcttggagcttggtgagaaccagactcatgccttgaggaaaccctgggaaagacaaatggaggttctcaggatcaactgaagaaactcagatgctagcaaatggtcaccacactaaaacggtgagagaaaaagaatcccagtgactttactaaaggctcactaattacacctctactggcagtgatcccctgggactctaagatatgaagcacgatttgcatcttccctctcctttttcagttcattctcagaagtttgtttcaatttgagggtggcttcactatggcaggctggccatgaaggggttgtaaagaatgaaattaatatacacacccacacccaacctctagtaaccaccattctatgttctgcttctaaaagtttgatttttttttagatcctgaatatgagaacatgtggtatttgtctttctgtgtctggcttatttcacttagcataatgtcctctagggagtgaacagggaaaggagagatgttaatcaaagggtacaaagttccagttacacagaaggaataagttctggtaatctgttgcacagcatggtgactatagtgaagaataatatattatgtatttcaaaattgctaaaagggtagattttaaatgttctcaccataaaaaatgagaagtatgtgaggtaattgttatgttaattagattgatttaatcactccacaatctatataggtattgaaacatcacattgtaccccataaatatatacaattattgtcagcttataataaaagtaaattttaaaaataaataagagtcgattccataaaaaaatgaaaggaatgaaatctagagctagctatggactaagggagtgagggagtgagggtagacaagttggggtgtgaaaacacaggtcacggagacggtgttttgttgtatagtcatttccaataagtaggaaaacaatttgcatattattaacatttcaagtttgtattcaatgtaattaccattcaatttccttccaactatacatcattttgtaatagctttggggtgggataaggggagggatctgaaccagtaattcattgtcgtttgtggtcagctccagtatattctaataactgaacgtgtcaaaagcctaaagctttttcattttgtgctatatttaatagaaaaagaaaagaagaattgggaagacttacttatgcagtcccatctcacttgccagcaccacctccctttctttgtagatgaagaatgggactcctttcacttttagttctattaaaatagctctggctttctctgtggttaaaaatatgagcttgatatcgctcaggtagtgacacaaggtaaacgctaatacaggaccaactcccatagctatttagaaaaaaaaatcctcctctgttagctatttctatcacaatttacaaggagagttgatttacagaagaattagcagtaatagccacaaacactgttgaatcaatctggacaaagcactccacttgccccaaacaacccctcattgttcacggtggtaatctgttcattttaaaagtattatctagtgctttggagtttgtccctcaagaacagcatgagcctccactgtaccaggacttcctcgcttagcatttctaaaacctcttaaatctgggaacatactttgtaagatttgttttaaatgatatttgaacctacatggtgtcataatatattctatcattgtgtgtaaaaagaagaattcttttccaatgagctttattgagctttagactctgacttggggactggaaagaggaagaaacaattcctttaaatgattctctcttaaagtaaaaagagacaacaagggaatcatagaatgttcaacatttgctactgactctctcaaagtgtacgtgagaatttttaaagctccagaggtggtgttcacagctacgctatcgatcgagtgtttcttgagagggagtcttcttttctccataccaggtgatgctccgtgctctggggtcacaggagaggggcatctgccctgtccacagcctgacagagccaaaggcaagctcagacagctgtgacacctaattatgggtcttcccatgaagtctgaaaaatggctgaacttggtccagccctagtgtaaatagaacaaaataagcatatttgctggaagtgaggctggtctttaaaattcataatcacacatatggctccatgaaccatctgcaccaagccatgtctgtgtgtgacttttggctctgggctatttgctattacttgctgtggaccaggtgcagattccttctttctctctcagcccccacattcacatatttctcagaaaagaaattccattggaatcagaggtgaaaagctaaaacctgtggcctgggtgatctaccattttgacttctgtcacctaaaaccctagttccgcctagtgcagagatttttaccacttgaatgcactgatgtgtgacagagaagagtatgttgtgtttatatttcccccataccccctgccaacagccattcccaccacgagaacccccagggagcagtggaaagaggaatctcaggaaagtggtgtctatgaagtacatcagagttctggggcaaagtcctgaggcaagagattgttagacagggcaaggagagaatggatagctggggaatttagccccatttccttttcttaaactcagtaaagagatgacctccaaggtgactcccaggacacccttacacaaacccaagatggttacatcagattaaaaacagctgcatctgagatagaggaaggccacagttcagaccacctgcatcttcctcagctcctaggcaggaaggaggaagatttcagaggtcccctgtgccctgcaaagggacaggaagcagctgatagtgctgactggagggattattaggggcactgccatggatgagggacagagggtcagggatcaaataggtgctacagccagacctcagctggatccatagtgccaggaggagctgaacagggacaagctggtggggagaaaggcagtcccagacattagctagagatgtcactaagacttcctgtgaccaagcagacaagagatatcaccatggagtcaagaggaaccagaggacaatacaagaccctgctgtcttggagagtaacagcgagcagaataaagaaatctcaaagtctaagcatttacatttttttaagtgagttacctaaaaagaatgtttaaattgctagattgggtggtttcatgaattggattattattagtttctctcttttctctctctctctctctctctctctctcactctgtctctctgatatggtttggctgtgtccccacccaatctcaccttgaattgtagctcccataatccccacatgtcaagggagggacctcgcaagaggtaattgactcatgggggctggttttcccgtgctgttctcgtgacagtgaataagtctcatgaacaccgatgattttataaagagcagttcccctgcacatgctctcttgcctgctgccatgtaagacatgtctttgctcctcttttgccttctgccatgattgtgaggcctccccagccatgtggaactgtgagtccattaaacctctttttctttataaattacccagtgtcagctatatatttattagcagcatgagaacagactaatacactctcccttacatacatacatacatacatacatacatacacacacaaacacacacacaaactgccccatcacccagcagggtgagctcatgaaggtcaggtcatacataggaagtaaagaaacctcagtttctctgcacatctgaataaatctggccctgctatatgtacagcactcagcaactccttagtggcaggcagggcatagtggaagcagagatgggcacaactgttgtagtttggaggtccctgctggaagggtgaagggtgtctgccccaggaccaaagggaggaatataggggtagaaacaggacctgtacagaaaatgcacagtagttgggaagacatgagacatgaggtcaccaaactacgtgaatttattaccagaaataaagattcctactctcggacttctgtctgttcactcctactagctcttttgatctacttggtaaggatttattcccaccactgttacttaaaactgacagctagccttgttgaatatactccccagaaagctttctttagccttcttgtggtatattcacctccgtagcagccagtcagcaggcactgataaagagataagaataggaaaaaaagacagaagatctcttgaagaagtaagatattggtgatactattggcattgttctaaatccagtgcaatgattcccaaagccaacattgcattctaatttcctgggaatattttttaaagtacagaaaccaaggtctgactttagaccagagtgtgaaatggcataacaattgatggtaattctgaccttgtggggtgggacaacactttcagccaagtaattggaataattaagctaccttgtcatggtgttaattgtcttaataattaaacgaccttgttatggtttgaattatcctgacaagtgctttctaaactgtataccacaggacatctagcccacaggatgttaacatgcattgctggagagaagatttctgttgcacaaatatttgagaaatccaggttaaactaagttaagcaaagtttgtttggtcttcaccagctcagagctttttacactgatgtgcgcttagactctccacgatgaagcaattgtgtacgtcatttccctcctagatctgacaaggtcttgtatttttcttgtaaatcccccaggattagagggttttattgcatgggatttggcgagtgctgctctggagtgctgtcacagggctctacttccctgctgatgcaggtgcagtcagggaaggcatggattcaatgaacttgacatgaagtgatgattgtaaatttaaaacgagacagtttttttgtcacgcaaggaaagtgtcctattacaaattaagatacaaaggtaatgggcagaaaacatgtaagattatacattcgtggacttaaaatagcaaatcatggcatacagctatctttgaaaccagtttttctattttatgaatatttcaatcacttctttggttttctctcatatccaattttgtggcattattacattatgaacctatgatctcataaattaaacaggctcagataatttgacatacttcacttttacctcacaatgacgagagcatatttttaaacatctctcccccttttgtctctgaatactacttttctctaatattgttttctgtctctctctggacactctctgaggaccagttaacgtcatgtcaaggacaaatgggtgcatcattatgactgccaaatctcaagggtcctgttacatatttggattgtttttcctgaataaagcatagaatctccaacgctcattaattcttctatattcacatgcttttggttagaagaacttctgctcaagactacaaaccaatgggtttttttaaatatatatattttttcctttcttatagtcagaaaaccaacaataatttgtttactcaccacagaacattctcaattacaatgctggtatatattttttctcaggttttatttaatacttttcctaacacttcctaagtaacagaagggtttggtttctttgtgtgtgtgtgtgtgtgtgtgtgtgtgtgtgtgtgtgtgtttactatactgaaaaatgtgagatacaaataaagttttaattcatgttcttttaaaagagaataattgaaataagtatttcacaaatacctatcattagaaattcctttcatagtctcccacaaattttcttaaattttaaaaacctttgctttatttgtatttttaaaagaatctatggttattgtgggaaatttataaaatacctattagaaaataaaatcacataaaattgtaccacctagggattacaactattaacataaaatgtttatataattattatattgtatcatgtatccatagagtttaaacttctctacaaaatttatttgatagtatgctttaacacttaatgtattataaacactttcccttgttattaagagtttttctctgatataattttaataacagcatagtttgtctctaaatatacatatcataatttataaaatccactattgcaggacatttaggttgtttctgatttttgctgtcataaactgtattaaaatgaaagttttgtaactacatttttgtacacttttgttattttggcttttatttgattaagacaaaattcagaagtccaatcaggattaaaggagagaaatatttctaaatttgttgatgcttattgctaagcatctaaacacttatagcaacctcctctttttctccagcagaacgtgagcgtggctacctctcccagtaatcacagaaacctggtaagactgtttggaaggcaatggaaatatatgtgcaaaaatgttttttgtctcatttttgtaatccttggattttcaatggaaattttggaaagggcagaaataaagggcttgagataagatgaccatctttcactagcgtggcttcctccattgcaactagatttcaactggaagaagttatttatatttctaatataaaagagtaaagaagttacctgctcccctccctgcctctgtctgaagcgctccataattcatgcagcctggcatcctgtcagtgcccttagtggactgttgcttttagtactgatccttaccaagagcatgggcagtcccacttttttttttttttttttttttttgagacggagtcttgctctgtcgcccaggctgcagtgcagtggcgcactcttggctcactgcaagctccgcctacctggttcacaccattctcctgcgtcagtctcccgagtagctgggactacaggtgcctgccaccacgcctggctaatttttttgtattttagtagagacggggtttcaccgtgttagccaggattgtctcgatctcctgacctcatgatccaccctccttggcctcccaaagtgctgggattacaggcgtaagtaagccactgcgcccggccggacagtcccgtttctacaactcagtcttgcctataggtcacaatgcagtgaaaagcggcagctgatagtgtaagccccgggagatcccaaatgcccggttattaacaagtgttatatatttttaaaaagcaatacagattttacatcatatatgagaagggtgttgaaatcaagggaagaataagagacagggtggaaaaaaggaggcttccacgtgcgggagacagagaaggacaaaggcaggtacagtaatgaaaagaatgtgtaaacccttagtatgagcaggcctatgtaaatagcagattaatctattacccagttcattttgcccaaaggctttctttaaacggatccttgaatatgttccccattatagtctcatggtaagggagtgattctcaaggggggttgcaattctgtcccccaccggaaattagcaatgtctgaagacatttcggttgttaacaacaggaaggtgctactggcatctaataggtatgcagggatgctgctaaacattccacaatacacaggacagccccacagcaaaaaattatctggctcaaaatgtcagttacgccaagaaacctcactccaagaaaagcgaaagtgtagtattttttcatattggaaaagagcaataccattggctaaatgtctctttaattaaaaattaaaacccacaaaaagaaatgttcaaaagtagaaaaagaaaaatccctagcctatcacagatactctctacttatataataattgttttataagtctttccaattttatttcatattctctctcatcatatcaacccatttgtattaaatgtctgttgcataattacaaatacacaataaattattttatcaaatgcttattgttccttatatgaaatacgccattctaaaagttacaccttctagaaaacaagaaaaagaactaagtaacattcattatctttttattcctggctaccttttttttttttactgtaatatacaatcctttattgaaagttgtgaaagtactaccaaaatattaggttagagatggtttatcttttatattaacagtaagttaaaatttactacacaaacataatgactatcaattaataaatatggaaacaaaacagctgtcaaaaatgtactagatatccaatatcccatataatatttatgtgaagaaaaaagctcggtaattttatacatattcatatatagcaatatatattcatatattgcagctatatcacaacaaaataaggttgttgtctatgaagccctattgacttcttgagtatcctagaattttctgtttcagagtgtggttttcagctttaaaaatctaaaaattaaactttttcagtgttgtcattgtttaataagttcttcagattcatgctaccaagaatggttcaatattttaaaatctatttatataatgtaccaaataaataagttcacaaaagtctatatgatctttttgacagatactaaaaaaaaatttgatgcagttcaatatttttcttgatttaaacaattacatagtaaaccaggaatttaatgacttttttaaatgataaagaatacatatttggaaacaatagccaggattatatttactgaacaaacaataaaaggattctattaaggactggaataaggcaaggatgccctctagtagcattatttacaaaaaaaaaaaaaaatggttacgaattatagtcaatgaaataagaccaaaaaagtaggtagaaggaatgaaaaattgaacaaaaatttcattacttttagattataaaaagttcaataaattttaaagccattagaacacataatgaaatattatatagtaagtgattaccaaacagatacacaaaaataagtatcttcccattaaaggttcaataacatttaaaaatataaagaaagctattctattcaatataacagccaaagtatatatctaggaaaaaatgtaaaaagaaattctctaattccatgtgaagaaaactataaagttctactaagggatataaaatgaatattgaagaaagtgagatccacatcatatttttggatggaaaagcttaccattttaaagatataaatttctcctcaaattaaattctaaactatggatttgttgcaaaatttgagaacttattatataatttaacatagaaggctaaacttttaaacatagccaagtaatttctaaacaaaaaggaattcaaaagagaagtaattttatgtcttgtcctaccatctataaaaatataaattttaaaaataaaaacaatacagcactattgtcaatattgagaaaacaatctgatagaataaatagaatttccaggaaaaaatactaagtcacaggataggacttatatatgataaatttatttcataacagtaaaaaagtctgaattattgaacaaatagtatataacgtttgtcaagtatagctgtaaaaataattaatgcatttttaacaacttaccccaaaatattttccaaatggaaaagatttaaagatttaaatgtagaaaagtaaactcatacaaatacttaaaataaatgtaagatatatattgtatttatataatttgtgagtggaaaaggtttctctaagcatggcatcaaagcttgaaagcagaaaagaccaatagagcaaacaaactaataacaacttataattgtaaaagatttaaaattatattaggacatgagaaaaaatctatttactacatattataacaaagtatcatttctaagagacttgtgaaatcaataaaaacacaaatatgctttttacggaaaatataaaaaggaaatgaaaaagcaattcacagaagaactataaatgtccaataagcctagaagaattcatgagcctcagaaatgcaattaaaatttcactgggatttcattttatttattaaattggctaggatcataaacaatagtaaaactctgtgctaagcagcacaggaaaaaatggttgcttttgtaaattgctgatgggtctataaattagtatgatcttcttggtaggcatttggcaatatttgccagaaacttgaaaaatgtaggtatcctttgatttaaaaatttctcttctagttattcatctaataaaataaataagcatatcctgaaatattcatttacagacattcatcactgttctggctatggcagcaaagatggaaaacagcaaagtttccactaacagggaattgattaaaaacattattgtaatatcacacgatgaaaaaatcttcaatttttatagctatcattatcattataacacatgcaatttagaattatgtaatatatagtataattataatattgatatactatttataatatcgattaacattaaaaagttcataatatattgagtgaaatgggtaggtacacttacttatcagttacctgatagagtctacataatagatctgtcctagtcttcctaaaccaaatgctgagattatcaaacaagtatgtcttatttctgaaatcagaatgttttgttttctgttacatatcagaatattttataactgcatatttcatttgaacaaataaacttcacatgctaacttatggtaaggcaaaagctgtactactctttcctaaggaaataatcattaactagacttaaggcattaaataatgaatagtgattttataaaaccattctatttctaatgaaaatattaaaatattttcaggaaaaatgagatttctgaaagaaaattaaaaattttgcaaatgggagtcatgggatactacataatattgttttaaaatgctaaaccaaatcttgtcatataaatcagaaaaatatctgaagttgtatggaatgctcaaaacttttagtaaattataatttattttctgctagaaattaaagtcaagagatcctatttttacaaaaagtcataaaatacaaggaagaactttttataaccttaagaacaatgctaataataaagatattcaactggtgaaaaattctaaagaaccaacttttcatacatcagtaccctggtgaattgtaaatgtcactcaaataccacaaggtcagattcttagatcaattcctgcattaatacttcttgtataacctgccaaccttcaagtactatatactctagtcagcctggaatgttgtattataataacttaaaaattaaatatcaggatagtctattcttttcccaaagcttcaaagtgaggagcccaaaatgggaagactgattccttaagagagatttctccaaagatgagaaagatttgcctgagtcaaataggaagtcacttggtcaaacccatttattattacaatctaattatgttttacagctgctcatgagatgtctaggaaattacatttgcaactttagtcaaaggaccaatattaatgcttatttaataatcagttctttgggtatctctattattgagataaatatgattgagacatgataggaagtggtcatttctctcataaacttattctgaccttcaacgttggtgtataattgcacatttatacaaatgtatgtcatttataattgcacatatgtatgtagaacagtgaactttggctggtgggaaaattcagagtgaagattttgaagattttcttggtttcatgactaatcatccttatccacaagaacagagagtgctatatgcagcctttcggaaaatgcctgtcctttcagctacacaccacattaggacagaagctggaatccagcctgaattgacacaggactgggcaataggaagataaaacattctaactcttcgtttggttctcattagagctaacagtgaatccagatctagagacactgctattataacacaaaatttgcgagcaaatcacccaaaataaaaaaaaaatctatatacaatttttaaaacttctcttagatttagagtcctaaaacaattgttaattttgcagattcttcagattctcctgaatggaggtatcacatctccactcacttaaaaaaaaaaatctaaatccactgtgtccaaatatttaaatatggagcaagttttatgtataagtattactctactgatccctgctacatactacttcgactcactatagaaatggctaagaacaactaagaacttttttccagcatttacaggtggtccatcatttctctaaagaaaaaaaaaacactaaataaagatcttattaaaactcccatctcaattgcaagtaaaattaatattttaattgtaaattatgcatcctatcctctatgtttcatgcctataactgattaactttaaatggcttatggaaaaaggtttggatcctctgtcaatcaaccatatttgttgatgaaataattttatcatcataaattaagagcattttatccagtagttgaatgtgttacctagttattattcaactaataaacatggtaaaaagtatgctagatttttttaatttttacattcttttatatattggctgaacatacttactatgggctggatactatattagatactgtggagaatacaggtgaagctgacatggaccttggcctcatacagctcacagcctaatagtatgaattcactatgaaataccaaatgattagttccatttaatataatgaacacttaaagattatcattgtgccatacagtattctagacccaagaaataaaaagcaaacaagtcacaaattgataatattccacttggtttcaaacataagagagaacatctgtattgttgtggattcttatagaacatctctatttttatagattatttaagtatcatcactctaatatataattagatgtcagtagacctggactttgttatcttggcttcctgaaaaacaaaatactggattaaaaaaaatgttatgccatctatttttacaaaacttttagagatgaaaatgtctatttgaaaagattataccttttcttgcaggattatcttgtataaagaatcagtaaaataaatcccttctacactttagagccaaaaaacaatttcccacgttaactggacaatggaaactatacaatttaatgtgcacaaatttttatcttcttttaaagcccctgtggtcaaaatttcctttatattgctatgagcatagtggacattgaataaataggttagatgaataatgaacaccaaaccaaatatttcactttagacacactttcttgtgctcaagttgatacaaaattggttagtagctgataaggtttggctgtgtccctacccaaatcttatcttgaattgtagttcccataatccccatgtgttaagggaggaacctggtaggaggtaatcgaatcatgtgggtggttacccccatgctattgttctcatgatagtgagttctcacaagatctgatggttttaaacgggacttttccccctcttgctgggcacttcttgctgcaagaaggagaattgggcacgtctccttgcttctgtgaataaggacatgtttgcttccccttcccccatgattgtaagtttcctggggcttccccagccatgctgaactgtgagtcaattatacctctttcctttataaattacccagtctcaggtatgtctttattagcagcatgagaatagactaatacactagcagtttcttcgaaaatcttcacatttgaaaccattatctaacgataaccttcttctctttatgttaaacattctcaagtcatgtcctcacaaacacccatgtttaacaccttaaatcatctcacttattcttacatcatgcttctagtttctccagggccttttaaaagtgttaataacatgagatccaattagttattatctctcaaatgtcaacttctcctaataattctcaagagcatgttaactttttgtattacagtagaagcttacacttagactaaagtcaatctgtgattcctgaattttaactttgctttaaataaatgaagtgtagagtgaggtacatttcctttgggttggtcttgatacaggatgatattcagatcagaaatccccatgcttttggccacgtgtactgttgagtcaacaacatttttgttggtgccaagtcaatggcaggtgttatataggctacaaagagaagggattcaggaaccttcaagttgggtgagagggaaaggcattcactcatgcagcagtgagcgaataaaagaagggctagcccaggagtctagcatgtgacctttagagtataatgccttccattccaaagcctggcttttgcatttactagttgtatgaccttgaacaagctttttaaatacccaatatttccatttcttctttggtaaaataggaataagagtatcttcctcatagatttgatgattacacataaaataatgtatgtagagaggttaacaccacgcttttaagccttcagtagctgctatgtgtgcacgaatgcacgtgtgtatatactttgtgccaggtactctgctgggtacataaataactatgatgcaaggcagaatgaaagagagaaactgaagagcaagaataggacttgagaatgagccaaccatttcttgatatgtggggtgtgtgtgtgtgtgtgtgtgtgtgtgtttcttacctcagggccagaactaatttcagatgatgggaaattctgaccctataggtaaatgcaaaataaatttccttgttcaaggatgccgagagcaagaaaagtgccatccaagacatattacgtaaaaattaagtctcattctctgcattcctgtgcatgatttcctccttcccaaaacatgcaagcctgcctaggtaagatcaactctgagttataactcagtctatacagagattatcaccaagaaaaatcagcaagtataaaagatttttaataaattagaacctgtaaaactttatgagaagcaggtgtctgagtcccattttataaaccatgagcctaacagagttatatgaactactgtgaggttgttctgtctgtgagcaacgatgggaatgtaatcacatgccccacaaactggactatgataagcatccttttgttagggtaataccatttatacatttatttataattttatattcctccctttcatttcattctttgttgaaagcaaatgtattgcaactcattggcaggcaatttatttcagggcgaaaagtaatctaaatacaaaataataaaatatgtgaatgtgaaaaaaatcccaaagatataagcagatttattatacatagctggaaaatatctcgtatatgaagccattcataaagtgagttaacttctctgtgcagaagttctttgggaatatgcttgtacagagtaatttactttcagtgttagaaattacctggaaagaggtgaaaattactcattcaagtcaagaagtatttacatgccaccaaataactaaggtgaaataaaaccttataggagaaatagaagaacagaatgaaaaaaaagggaggggcagggtgagataaataaataaaaagctaaagaaaaagttaaaatccacccagtatttacacaatgattgaataataggacaacttttatcttgacttcatttaaatgttttcagtaggaaagcttgacaaaagtgacattcagtcattagtaatattgctaaaaaagtgaaattcagtcatcagtaatgactgaaagtggcattcagtcattagtaatatgtcattagtaatattgctgtataaactagaaattgttcttttgaatctttaaatggtgaaaacagtcaatagtgttttcttttttaaattgttgcttcttgatagaatcacagtttctcttttattgcatcatttaatctcaatgccaagttttgaaggtggtgccaaagttcactatctgtctgggtagcagatgaccaaaacgcccctccacagtaagggtgcgtgagtactctggttccagcgtatgctccacacatcccaccactgcagggcgcatccaggtgtgctgtcatggtcagtttgaatgcctttatcagtgactgtgccatgccacatatataaagatggaaagtcaagtccatgacctccaggaatacatattctgactttgcactgataacctcatttagtccacaaaacacagatatgacgtagttaatgttattattcctgtttcagaaacgaggaaactggctaaaatactttatgtgactttcagcagggtcacacacctaaaaagtgatggcactcgactcaaacattgcagtgatatatgtccacttggctaggttatatgtccacttggctaggttacagcctgcagttattcaatcaaacactaatctaggtattgacgtgaaggtattttgtaaatgttattaaaatccataatcacttgactttaaataaaggagattgtgctacataatctgggtggaaaggccttaaagcataactgaggcgtctctgaaaaagaataaattctgcctgtggacagcatcttcaaccttgcctgagagtttcaggatgcccttcctaatggtctcccctgcagatttcagatttacctagtcagccctcacaatcaaatcaggcttttgcttgcaagaagtctcttattatgtatctcctactggctctactttctggttgaactccgactgaggcaattactcctgtcctcttacgtggtaaagggttgtggttattctagtcagttcatcgggctctactcaagaaacacacagggtctggaagcaatataaaacttagcaccaactgggacttcctacaagctttctaacgaaaaacaattttaaaaattacaagacataaatatgtggatttttaataaagaccctcttagtcatctttacatacttaataggtgcttgacaaacgcctaacaagtgaatgaatgagggaatgaatgactaacttggtttggctggagtcctcttgtgctttatctctcagattcatcactgcaatgatcgggacgcacagcatagaaatatatacatatatatatttatttaattcctccaaactctatgagatgtcatgccagagattatcaattctgagatgcattcatttcctcattttaatatttctgaaatagagatgcattgtacaaaacatagaatatcataacttatttggcattggtttgcctttcttggtagttcataaaatgaaggtatactttatgattgacagcattttattttaattgaaatatagtattatcaccatgttcatttttcagatgagttcttcaggcacaaaggctaagtacctttcccaaggtcacaaaattagtaaatggcaagtcagggtttgaacccaggctgtctggcactaaagcaggagtttccgcaaattggcaccattaacattttggactagataactctttgttgtgggggctgtcccatgcagtgtagcatgtttaacaatatccctggtctctacccacgagatgccagtagcatccacccccaagttgtgacaactaaaaatgtttccagactctgccaaatgcctcctgggaggtcaaatctctcctaattgagaaccactattctagggtatgtttaatcactatgcaatatatatttttccctaaaaatggaaacacgcccagggtgacttctactgcagccagaagcaagttgggtccaccccagaaagcaggaatacttttccctgaagatggtccttttccccaatttcttccttgactcttactcttctcttactgccctctcctctttttcaactttgcacagttcttcaggcagtattctttccaactgcttgccaggtcccacatctgttcattttgttggcacttaatttgggactgctctggaggtgctgacagcattagtactcctgttcctccaactgctgaacaatcttaattgagctgtccctgtctccttggtgctgtcttgtaccagctccaccccatactccagaagacgggtgacaggcactatctacttgctccagctttgaccaaataaagaaaccaagaagagacttttcaaaagctagtagcacagtgaaactcaggaaactaatgaacatgatttgactgtaataggttcttattcaagaatacatctgttctcacgagcctgtaagttaagaggccatgtatgtggtggatgagtccatggcctctaaagccaaatggcctgggtttcaatcccagctctgcctgcttctcagtaactgtgtgagcttgagctactcaatttttctctgcctcagtttcctcctctgtcaagggggaaaatagcagctttatctaatgtagttggtgtgaggagtaagtttataatgcatttaagagggcctggcccacgtaaacaccagaagagtgtttgcaattattagtggctcaacttcaaaacaattgtggtgcacttttggcttaattcgataggctggatttgaatttttaggttcattttttaaaacggaatactcatgttgaaatactgaacctaaaactagcaaaaatatgtaagtcaattgcttacatatattcagaacaggatatcattttagatttagtttatacacacacatacatgcaaactagtaaattccagtgatggtaaaattattagtgttttaacaacaatcactcctgactatctgatatactatatgatggtacatattggttattataacatatagctatagatataaaacaatgatctcaaatcctgaagttctatctgaatcaacaaaattaaataataactaggatgttttaatattaatattaatatgcttgattagattttaatcctttgaaaattgagagaggcctatatgatatttgtggtgctacttgtggcctttctacctgatgtgtaacttccaggaaaaggacaatctgaaggggctcagtactgaagtaacctctgagcttttcctacacggcccctcctcacatttactacagcattctgtattagccaccaaaactgagcaaacctcattccgttagctagtctccaaagaaggtagcacctgttactaatccccctgctaatctccccagcacaccctggatcttcacttctgcccatcacatgagatgtgcagcctgggaggcttccctttgggtccctctagaattagaagtcattcccatttactataagccaggtgtgcatcatttcactgaaaactgtcaccaccatcctatgagccagatgctttcattatgtccattttacaaatggaaaaactgaggctgagagaaggtaaataaatttcccccaagtcagttagaaaatctgtgcaaataccctattgcctgtatctcaaccagccactgagattccttgtttacttctttgaaagtgtgctgcctgttgtccatacctcctaaggaagcaaaattgagttcactctcccattgcccattggagaatcaccaccccatagctttctatccaaagcattacaggagctttcatattctctgttgtgctgcttcaggcaggtggtattttcagtgtgttaattttttaaatcataagttaaatccattggttcgagggcaaaaagggttactctacagaggcagaagtgatgttaacagaccaaattatatatatgtacaggtcaccatgatcagtaaggaggagaaaagtcaatgaaacctattagttctgaaacaatagataagaagagagaattctacttcaaatcaagttaaccttacaatctcacagttttattgtcatatagttattaccataaatattcagaatattttgacttaacatacagatgtcttttcatttgctcaaaaccatgcttctgaaatgagattgactttgggagaggaagtactatttttatatcatggtgtattaaaacatagataaaaggccgggtgtggtggctcatgcctataatcccagtactttgggaggccgagacaggtggaatccttgagcccaggtgtttgagatcagcctggacaccaaggtgaaatcccacctatagaaaaaatacaaaaaatgagccaggtgtggtggtgcacagctgtagtcctaactacttcagaggctgaggtgggaggatcacctgagccagggaggttgacgctgcagtgagctatgatcatgccactgcactctagcctgggtgacaaagtgagaccttgtctcaaaaaatatatatatataaaataaaaaattattttggcttgtggcatggggaattagttccctgtaattcagcaagatgcatccaagagggctgttttctttaaaaaagacaacagagttagctggctagaaattatttggaaaatagattttttttttggacacagaaatgtatttcaaagacaataaatgaagattattttatttcatatattagtactcaatgtttgcccacatagttgaactaatttttgtcttcttgaccttaaatgtctggctagaccaagcactttttcatattttaacctatagtaatatttcatattttaacctgtagttttggtgatcaagagacactagagctcagaaacagatgtcttccaagctctgttgattcaccatatcagtctgaggactccagcatcctgaacctcagcttgcatccctgaaatggagtggtggtacaggttcattatcatcacaaagaaaggatgctagcctttaaggctacactttcttccatgttatttacaactcaaagggcctgtttcaagttccattttagctccctgtgtagtacactgccaagcacatgaattttcaatgaaaatgttggaatgaaatttcagcatttcttaacagagaagtaatcaccaagatacgagttaatgctttacggaggttatgtctggctccattctattacagaatgaatcaaggtgaaaaaaaaaacataaataatgaattgtgtcctatttgggtcatgtaggaagggaggttattggtagcaatcaacactgggtcagaaagacaaagccagaacctggagccagaagggcaggcagcaggtgtgaaattagagatgtgatgatggaaaaacttagaaacagcagacaaaagacacaaaaatctgaataagacaagtggtggggtgatttcatcatttaaggcaactcaagtgatcaagtctgagagctgtggtctgggactaagacaagagcagtctagagaaatttaaagagatgctgtgtcatcccctttgaaggaccaagtgcaaacttatatttgtccttaaacagagttctccaatcccagcctcacaaaaccggttcagctatagctactgaacggcatctgtgtgctggctttccatctctgctcttgagcacaaagaacaaagtttttcaaaaggaacttgcacagtccacttcataaatctcccttcagcttgctaccttccgcccacatctcagggttgtatgccagctagatctacagcagttatatttttaaaccagcaattatcctcattcctgctcactgacatgccatacagttaatctggtttaggtccaaggtaaaaaaagggaaaatatataaattcacataaacataattcacattggctcaaaattactcaaatggttttcaagcaactccaatctgaattacaggtcagtttcaaagtcaattttatatcaaacatgcatcaattacaaaatttttccaaaacaactgtaaaagaagtcaaagtccaagatcttaattaaaatatagtttactttagagaaggtaaagattatcatgggaaaactctatcacatcaagacaaatataatagcttgaattacatgtataaaattaacagactggaagggaaagctttatgacaagaagttccgagaagaacttagtgattctacatccaactttattcatctatatccaaatgttaacatataccttgatttttctctttgttaattaaatatgaatgcttaccccagctataataagaggaatctagtgaaagcaaatagcagacctaacataatccctttccctttagctatagtcaactcactctaagtgtttccaaggcaaggatatgtagattaggtaaattgattccttttttcctattatcagttgtcttcttcagttatcacaaaggttgaacattaagctaccaaatatataagacattgcctcaagaacaacttgggtaaaagatacccatgccacacagacaattataacatgattatcttgaattttttcttctattttaaatgctgccttgtaccatttataatagcaaaaattgctgtccaattaaaaagtgtttggaagagaagactccagtttaattatgaagggcatcattactataaagcaatgacagggtatgctcaggaatgaatccattatcacagaaggaccacttatgcgacaatgatgttttctcatctgcccccaatatctccatttcgtctagttcctcctacttatcctcaccacaaggtaaggtatctgaaagtgctgaacacaccgcctgatgtaaagcaggtatgcaatgatattcattcatttatttcaaatattcactcatcccatcatccctctggaaccaatccatttgctacccaggatagaatttaaggtactttaagtatctaatcgcaagtaagccttactgctgtccactctggtctgtgggccatgagtctgtatcctttaataaattcctgcttcacacagtaagaactgtgctttcctatcccaatctctgcctaatagcccaacctaaatgcgttccagcagccccagccccatgcctggcctccagtatttccaacactcaaggctcagcttatgcatcacagtccttcaacctgggtcttgtcaagatgtggctgtatcttcctaaaaatccctgcctagccaggagggtggcagcctgccaccaaataacctcactgtgaaaatctgcccaaatgccagtgttaatattgacaaaattggcctagactgatgctacttaagcatttttctgtattaatgatatatgcatgtactttgtatttcactgaatccagagaatttttatctgggtttagttagccttaaacagctacactaacttctctgtgtcttggttttctaacccgtgaaaggcaataatattaggatccaccacagaggttactgtgataatttttatatattagcaacttagagaactgtctggtagataacacatgcttatgtaaatgttattgtttgtatttgtgggggaaaaggaaagattaacaagaggaaagcatacacatttatttaacataagttttatgtgacatgagggcctttgaaaatgaaaacccaaagatacaagtagacttgtatttttttatgattaggtttgacgaagaatgaacagttgtgcagaagtatattgggggacaaaaaggtatgatctaatagtaataaacggggaaaacttagcaaggcctgtctgttcagattttctctgtgctccatgtcttcagagataaggaagttactttctgccaggtatggggggggcacctctcaaatgagggtctcatgacctgcctcagaggagaagtgtgagggaaagccagagagcaaccttcctatgtttgccattttctcaaatgccaaggtaccagatttgggggggtatcatgtactgaaccttgttatattattaatactattactattgacttcctctagtgagtaagctaccagatgcatgaagataaaaactgtctgtttcattcttaaaacccctcaaacctacatggtgatttgcacatctcaggctgtaagtgattgtcaaataaaattgaattactgagtactttaaaaagatatctggaaatatcatgataactatgatatagctgtagaaagtaagaccacagaaaccaaactgtcttcttaagaacagaaaatcactaaaagagccaggaatgcaagtcagtcataagcccatgctgctggttcatggacaatcttcatatgacaccattttcctggtgtgagaacagatgcatttattctgaccttacgtcatgcaaatttacttatccctgggcaaggacaggttacggggtagctttggcattgctcattcattcctgtatttatcaggtaaccctgcaccaggtcctgctttaggtgtcaggagactacagtaaatcaaacaaaccgcattggctcaaaaactgacatttgggagagctagacaaaacaaaatactagtttatattaaattatgataagtgtgaagcataatattgaggggctgctccatcagatcacctatcatgacagtatcagttcctggcacatttattggcacccctttctggaggcaatggactggaggtccccaccacttggtcaatgaagtgaaatgtatggatttgatgctgagaggggtttgacattgctattcttctatcaatcctggtgtaaaaaatatacactgtattccatagcccatctagggaagaatcctactaccaggcatggacagaaacttaagtggctcaagaagacccagcagctcaaaatgaggcagtacccctggatgggaaaggtatacctcctatccagccacaggtagagagacacccgcctataggtaaatggtcccaatcctgactccatcccaaatatcaccacaagataaacagagttaattacggtagggttaaatttcttttcgcagatagaagataggttacattagatgatgtgctctaaattcccagagattattttacaggaaaagaaaatttttacagctatcaacttcactttaaggttttcgagggcccttcaagattttatgtcctctcacaaatgccacaagcacaaataaatattgctctttaaaacaaattaatgtcaacctgagtataaatgagtcagacctatgagtctccaagcattatgtttcattaccctgccaaaaccaagcctttctagactagtcttaaggctctggttctgtgaataggcctgctgaagaaatatttcacctaataacatcaactgtcttaagattcactttggataaattgctttttcttatagcaactgaatgaaaaaaaaaactgaactaacaagagaaacacgaaaaaccacagaatcaatcaataatgcttccctgtccccaattattacattaaactgcattaagagcctggccagctattggtccatgcttcataatccttcatgtttcttccaaataatcacactcttcaaagtaagatattcctatataatcatgatgcttgatcaacttgccttatcaaatgacttgcaaaaaatatctatacctctgctctgggaaagcccctgtgagaaataacatattgaatagtttagattcaaatcactgccctgatttaagccctatggaaaaaataacactagagtaaataatattgagtgctacccacaaccccatatatcaaagactgtcaaggacatttagtattgaaggccattccagtactaagccccaggagatttacaagaggtcggggtgattaggtctccttaattagaatgtaaatttatttattgatttattgtatcagacagatcaattagtagctaccaatttttttaacatgttcattttctatttcaatgatagatatcaattaaatattaatcagaatctcccacctcacctgtagtttcaatgttctgagctcaagttaagcatgacagggacattctatgttccaattttattccatcctggcttcaaagttttggaaacagaatacctcacactacacgaataaaatttgcaacaaactgctaactgaggcaaaatagtattcatttgtgtgtaggtatatgtcacgcatgtaccctcaggccagctctgtaaccccacgaagacccaagtgatttctccttcatcccagagcaaagagggagaaagagctgcttagctgtgcacgttgaggaggtgatctggaaatctgcttgttcctctgaagactatgaaccattcgttcagagcttcctcaggcctccagctcctgagtctttctgctgttctgcagcacaaatgagcttccctcttgctgcattccttctctgtaggctttctgcttttatagtctgctaagtcagttactagtccatatcatttccagctttcaattttttgttgacatctattttcttctgtcatttctgcttcccttttgttcttgtgcatttataccttcgtcattgccttgctgtcacataaaacggtttcatgaaagagtagaggaaaatccatgtatttaatctgccctgcgtagccagaagcctctactatactatgtgataccactccactccaagctaaatctatctgagccaagatggctaagttccctggtgggacagactaatgtaaaacaaactgaatggcattgcttttcttctttcctgtttcttcattgccatggatcaggttacgtgcaaataataataataatcagcaatgctataaataaatcatattaaggcagggcttacagataaatcccaaagttcaaatgtaagtatcttgccaattgtttactaacttgtcaagatattaaaaatagaaaactaacactcaagacaacagaaatagttgagccatggtgccagggcataacccaagaactcggactagacagtacaagcatatcaaataaatatttagcttaggtatcagagcactgtcattaagagcacagggccaggaaccaggctgcctgggttcaaataccacctctgccactgacgagatgcataactttagacaagttacttaacctcgatgtgtctcagttactgtatctgaaaatgggagtgataataataagaaagcctcatatggtggtatgaggagtaaacaaattaaaacttgttaagtacttagaataccctctgacacatagtaactactacacaagtattgagaaaggtagttgaggaaatgaataagtgaaaataatatggattcttctggtcaagagagaaaaaaaagaccctaacctcaagccaccattttaaactagaacttaacctgtattacccttaaaaaaacgagggcaaaccaacacgtaaaaagaaaccaaaaaagcaagatcttcacttttgagcttccaggaaatcaggcctcaagatttataaacactgtgtcttaatgggaatttttcagctgcaccaggctttaccttaaatgcttgcctaggggaaaatccagtccacctgttagaggctggccctgcaagggtaagtgttgaaaccccaggttgcttggtgacatctgggcatccacgcctgtggtgctcccaacctaccctccacttggcaggtgtaggttgcgttttctggctcctctgagcagcctcattgcctgggagccaggctgtgctgcactctccctgcctgtcttaaggaagattcctgtgaagcccctaaatctgcactcatgctcatcctctccactattcctctttccttttctacccctatttcttaggtggaatctgcctgaaaagcccaaagcctgacctggagatcaaccaatcttctgggcatccattcagacaagggctagggttggcagcctgtgggctcaacgtcctacccatacactgagtccctgcttccctttaactccctggtactagtactgtctcctgtttgctaccagtataccataggacaggagtcaatcctaaccatctggacacacagatatctccaggatgctccccaaaagtttccttgacatcttgtctctttttcccctccccctaaatctacactattctggacatccattctgctcctgtctctccagcaaagccaccctcctcagaaccagctgctccctgcaacctccaatccctgggcagaggagacatatgctcttcatggggtgaggttggggtggcctggggagaactctcctgagatagtaaaagacagaaaaagccaaaggagactgatctcagggtatagccaccttgttaagtcttttttttatcaccatttttattaagaaatattttacacatataatatgaagatctatggagttgtaaaaaataataaaattatcacatgttcctacaagccagcttaagaaataggatacacaaataattaattaaaagatcctttcccaattgtatactcccctggctccctcgaagttgatcactgtccttgattagctcttattgagcccaacgtgaggaaaacagcatggcctctccagaaaatgtggtatgactattttctgattccagctattcatcctattttcctttacatcctgtccaccagaaaactcgtagtcaagtctccatcctaacagtttaacccttctaatatgcctgatttcttaccaccattcattctattaacccttatgtgcatgtatatccatgactgagttttcagtagaagagggaatcactcaaggaatcaaagccattcagaaatgctccctcaaagcctaaagcaaactcaggctactgaaaaatcaatgtccaaatgataaggtaggttgactctcatctggcacctactctaacccttgtctggtgcatctttaggatggcacaggctagaaaacataaagtacactttctatccattcttgaaactagagttctagatgtgacttagtttcctccaagcagtcattattgcataatacttgaattcaaaactgagttaagaggagatagaacaggtctcatgcagattgtttgggagtgagagagatgggcatgaacacagcggacactgtgcattcttgtagttagcgattctgaaaggagtttctagtctgtagagagtaagtaaatgatgcgatcctaaggtcagaagttgggacactggctccccaatttctcaccttccaggatgcggcagggggagacattcccttaatggtcagttctatatggtgttatttcaggattcattcctggaaaccaagtcaagaaccttctcctccagttcttccagtgattttgtaaacatttaactcctcatatcaaatcatctcctgctgaaaataaccaaagggtttactgctgttggcaatttaattctggctaatatgtggaatagagagagagaagttgacagagtaaagcttgataataaaaaaacaccagctcatgcttttatcaagaaaataaggcataaccagatatctatttttaaataaaattgcttacttttaattttatataatgcttttactgttattaataactttttttagcatggccatgttatcaattatcaataataataaaacataattatttgcagaacattgatgttgtatcaagcactacataagtattttatacacttagctcatttaagctttacaagtctatgagatacgtatttgtatccattctataggtgagaaaattagagttaagagaggttaattagtaattttccaaggtcaaacagctgataggtggtagagataaaatccgaaacctgtcagcctccaaaactcacctcttaaactctttattatactatctctgtaagcttatgaaattcacggcatgaagaatgaaaaaggagtctgccttgataatatccgactcttctttaagtatcctcttgtgtgatatccttggcccctcttacaaattcttcagattgttttgtgtagactctatttaacaatcttcaggaaatactttggaaacactaatggaattgaactgttaaaatataaaatctcattgcccctagcaagaattctctctaaaattagagccaggttttgcttataatttaacagtcttttccccatcatttgcatagtgatagagcttttatagttttaattctgaatttatattccagaaatgtcaatctggaggctgtaatcctactaacttttctgcatgcctatttttctgaatatgtataaatgtttattttctttaagcagcacatttcagaggtaaaatgtatttggaagactttaatctatgcacaagccatcattaaacttccctggcatatctttctcttacagttaaccaaattacatttgggtatttgaagcaaatgaggatataacaaagtgatttgggtggacaaaatgtatgaactgcatcctgtttatgcaacatttttacaattgtataagctgacagctatgcttagagaaacagtggaagaaacaaaatcgttcactcagtggtttataagaaaaagaaaaaaatgtcaattttcaagataaaagtgtggagtcaagaatgagttttattttttttaaaaattctcattacaaagtccttgaaagaatgtcaagaacaacacagtttatgactattgggaaagtggatctcctcttagaattggaagcctctatcctttctttctgcgtctctctatataaagatgtttctgtcagcttgggtgcattttcatcaaatttggagtatgcatttgggaagctaggactaaacatagagcagtgacatatgttgaatcaacttgggcagggagagctggggggactccgagtggctgatgctgaaacactgcagggaggcctctaaccagagaaaacatacagaggtcttcattgagggctccagaatcaatcattccaatggcagatactctaaactgctcttctgattttggactgagttgcttctcacctggaccacacaacataactcagatgcactgattttcaaccccagctgcatgttagaatcacttggagaacttttaaagactgtgggtgcccaggtcccagccagactagatcaactggaacctgggggtgggaggtgggaggaggacaggacaagtggccccaagacacctgcatttttaaaagctccccaggtgagtctaaggtatagccagagttgaaaaccactggttcagggtgaatagcagctggaatttatataatcatggttaatgattctcttatgagtaacatggaggaggccagctagtattatacaaagttaaaatgacattttgcttaggaataattggaaatattttttgtcaagtgtttatgtctgtgtctgacaacacacttacaagaaagcttagacactgaaaagttagaagcctatgggagctcagaagtgagatttgggttgtgcaccgtggctcatgcctataatcccatgttggagaggcagacatgggaggattgcctgagcccaggagtttgagaccaccctgggcaacaaagtgagacctgatttctaaattaaataataataataaatttttaacataataaaagaagtgggatttgctctcagcagagccaagctcagctatatccaagtcctctgcttatacaaagatatcctctagacataggtgttataatttctacttcctaagatgaactttttttctattcagcttttttctattcaagatctcattcctgtgtagctctggtttgaaaccaatagaaacttgagttttaaaatcctgatgtgaggtttctatcattttggctagcactgttcatttagagtaacttaacttcagtagaggaggataaattaggatctcccaaaaaactttaaagggacctgctctttttttaagagtttttcctaagcatcctgtatggatttccttcattctctttaagactgaatggaattttactgtatatatgatctagtgtcttccctcatacctcacacaggacagacaatcaatatttgttgacttaacaaattaaatatttaactattctcccaaatgatgggtaggggcatctggttgacaataacagacatattcaaggaaataatttgtagcaaagctgagtagaagattcctctgagctgacaagcatttcccatgtctcccatgcaatcagctttgaattccaacttcagggacagaaggcacttgcttgttgccttataggcatcatgactggcacaaataaatctcttccttgcagcattttagacaagtgtgatcaaccaatcaatgaaagctacaggcacctcgaaagagccttttctttccaatgtcatttcctccagcagctgctccttccttttgggaacccccgagtttatatataagcagggttcagaaggaagacaacgttttactcgatgcctctctcattcaagtaaatgggcactggcccatgctctgttctgctgctggaaccaactggagagtccaaagcatcacatttttcccagagggaaaactgatggaaaaaaaagatggaacttcaatgttcaatcaatcccaaccaatcaagaagctttcaatgctgcttcatttacataaaagtagagctaacagccaaaaagcagtctttaattcaggtatcaatgtataattctcaaatatatggctcaatctcaaatatatggctcaacctgccagagttatagaaatgacctggtagaaaatgtattcctatccttgaaggagctaaaagtagacatttctgtgtgtgtgtgtgtgtgtgtgtgtgtgtgtgtgtgtgtgtgtgtgtgtgtgcatgcgcatgagtgtgtgtgagagagagatgagagagacagattcatcactatcaagataagagctgaagaatttctttaaacagagcccccactgttaagtggactccaaaggataaaggtttctctcactgacttgaacctcattattaattatatttattattagttcctttccttgaatatgtctgttatcatcagccagatgcccctacccatcagtggggagaatagttaaatatttaatttgttaagtcaacaaatattgattgtctgtcatatgtgaggcactagggaagacagtggttcacacatacaataaagttccattcagtctttaaagagaatgaaggaaattgatacaggatgcttaggaaaaactcttaaaaaaaagaaaagatgtccaatgtgtatagtatcttgcatttgtgttttaaaaagtatttacatttatatttatatgttcacataattacatcgaaatcttttggtgctatacacaagaaaccactgacaaactctgaagactagggtgtctctagggtggaagggagacaatttgcatcataatgtttgccattttttacatgtacatttgttattttaataaaaaataaaatgtctaagtcatgagcagtattttctagagtagaaagattatttacactgagaatgaagagtgatttcaaagaatcatgaattttcctaattttccccaattttaaatcttaaaactatgaattttccaataaaattagtattcataaaataattaggggtttggcaaatatgcaagttgtgtctgtcagcatagtccactcaccccgatttccatgtatgcatatgtgcacactccatgtcccgtttttaatccctttctcttcctgcccaccccaacccagccccacacaatctcaaacagtctatgctgtaggacacaggtatacctgtgatcatacattacagtttgtaaacagaatattatgctttatattcacaatggatggataggatatattctatttaccctacacacgtctgtacatacacacacacacacacaattatacacacacgcatattgcctggtattcatgtatttttcaactgtgtgtcctgaaacgatttttctttttcagtgagtcattcattggcctgtgaaataaaatgttttcctactcagagatttgtaatgccaatgttcaaacctacatagtgtactgtcatgagaattaaataaactgaagcatgtgacagttcctcacccagatcctagcacaaagcagtcactcaataaatgtttgtggaatataagtgcattaaatatgtgttgaatgtgaacgcaaacctatgaatattttagcaaataacctctaacagatagaaccatgttagaaaactaccagttggatggccaaataggaacagctccggtctgcagctcccagcaagaccaaggcagaaggtgggtgattcctgcatttccagctgaggtacctggcttatctcaccgggactggttagacagcgggtgcagcccatagtgggccagcagaagcagggtggggcatcgcctcacctgggaaagtgcaaggagtcagggaactccctcctctagccaagggaagctgctagggactgtgctgtgagggactgtgctctccagcccagatgctatgcttttcccatggcttttgcaacggcagaccaggagattcctggtctcatgtgcctacaccaccaggaccctggatttcaagcacaaaactatgtggtcatttgggcagacaccaagctagctgcaggagtttttttgttttgttttgttttgttttgtaccccagtggcgcctagaacaccagcaagacagaaccgttcactcccctggaaagggggttgaagctagggagccaagtgttctcactcagtgggttccacttccatgaagcccagcaagctaagaaccagtggcttgaaattctcactgccagcacagcaatctgaagttgacctgggacgattgagcttggtgtggggaggtgcatctgccattactgagacctgagtaggtggttaaacccctcacagtgttaactctgactgtgtggaactcaccgcagtgtggcaaaggtcctggggctggactgcctctctaaatcctactcacttggcaggacatctctgaaagaaaggcggcagcctcagtcaggggcttatagataaaactcccatctccctgggacagagcacttgggggtaggggcagttgtgggtgcggcttttagtggacttaatgttcctgcctgccggctctgaagagagcagtggatttaccagcacagccctagagctctgctaagggacagactgcctcctcaagtgggtccctgacacccatgcctcctgactgggagatacctcccagcaggggtcaacagacacctcatacaggaaagctccagctggtatcagacaggtgtccctctgggacaaagcttccagaggaagaagcaggcagcaatctttgcttttctgcagcctccgctggtgatacccaggcaaacagggtctggagtggacctccagcaaactccagcagacctgcagaagagagtcctgttagaactaacaaacagaaagcaataacatcaacatccacaaaaaggacacccacagaaaaaccccatccaaaggccatcagcatcaaagatcaaaggtatataaatccacgaagatgaggaaaaaccagtgcaaaaatgctgaaaattccaaaaaccagaatacctcatctcctccaaatgattgcaattcctctccaacaagggcacacaactggatggagaatgagtttgacgaattaacagaagtaggcttcagaaggtgggtaataacaagctccactgagctaaaggagcatgttctaacccaatgcaaggaagctaagaaccttgataaaaggttacaggaactgctaactagaataaccagtttagggaagaacataaatgacctgatggagctgaaaaacacagcacgagaacttcatgaagcatacacaatatcaatggctgaattgatcaagcggaagaaaggatatcagagattgaatatcaacttaatgaaatgaagagtgaagacaagattagagaaaaaagaatgaaaaggaacaaataaagcctccaagaaatatgggactatgtgaaaagaccaaagctatgattgtacctgaaagtgacagggagaatggaaccaagttggaaaacacactttaggatgttatccaggagaatttccccaacctagcaagacagccaaacattcaacttcaggaaatacagagaacaccactaagatactccttaagaagagtaaccccaagaaacataaccatcagattctccaaggttgaaacaaaggaaaaaatgttaagggcagccagacagaaaggtcaggttacttacaaagggatgcccatctaactaacagtggatctctcagaagaaaccctacaacccagaagagagtgggggccaatattcaacattcttaaagaaaagaattttcaacccagaattttatatccagccaaaaactaagcttcataagcaaaggagaaataaaatcctttacagacaagcaaatgctaagggattttatcaccaccagcctgcctcacaagagctcctgaaggaagcactaaatatggaaaggaaaaactggtaccagccactgcaaaaacataccaaattataaagaccaatgacactatgaagaaactgcatcaactaatgtgcaaaatgatcagctagcatcatgatgacaggatcaaattcacacacaacaatattaaccttaaatgtaaatgggctaaataccccaattaagagacacagactggcaaattggataaagagtcaagacccattggtgtgctgtattcaggagacccatctcatgtgcaaagacacatataggctcaaaataaagggatggaggaatatttaccaagcaaatggaaagcaaaaaaaaaaagcaggggttgcaatcctagtctctgataaaacagactttaaaccaacaaggatcaaaaaagacaaaaaagggcattacataatggtaaagggatcaatgcaacaagaagagctaactatcctaaatatatatgcacctaatacaggagctcccagattcataaagcaagttcttagagacctacaaagagacttagactcccacacaataatagtgggagactttaacaccccactgtcaatatcagacagatcgatgagacagaaaattaacaaggatattcaggacttgaactcagctctggaccaagcagacctaatagacatctacaaaactctccaccacaaatcaacagaatatacattcttcttagcaccacatagcaattatcctaaaatcgaccatatatttggaagtaaaacactcctcagcaaatgcaaaagaatggaaaacataacagtctctcagacaacagtgcaatcaaattagaactcaggattaagaaactcactcaaaaccacacaactacatggaaatggaacaaacctgctcctgaataactactgagtaaataacgaaattaaggcagaaataaataagttctttgaaaccaatgagaaccaagacacaacgtatcagaatctctggcacacggctaaagcaatgtttagaggaaaatttatagcactaaatgcccacaacagaaagtgggaaagatttaatatcacaattaaaagaactagagaagcaagagcaaacaaattcaaaagctagcagaagacaaaaataactaagatcagagcagaactgaaggagacacagacatgaaaaactcttccaaaaatcaaggaatccaggagctgtttttttgaaaagattaacaaaatagaccactagccagactaataaagaagagagaagaatcaaatagacacaataaaaaatgataaaggggatatcaccactgatcccacagaaatacaaactaccattagagaatactataaacacctctacacaaatcaactagaaaaatctagaagaaatggataaattcctggacacatacaccctcccaggactaaaacaggaggaagtccctgaatagaccaataacaagttctgaaattgaggcagtaattaatagactaccaaccaaaaagaagtccaggaccagatgaattcacagccaaattccaccagaggtacaaagaggagctggtattattccttctgaaactattccaaacaatagaaaaagagggactcctccctaactcattttataaggccagcatcatcctgataccaaaacctggcagagacacaacaaaaaatgaaaatttcaggccaatatttctgatgaacattgatgcaaaaatcctcaataaaatactggcaaactgaaaccagcagcatatcaaaaagcttatccaggccaggcgtggtggctcacgcctgtaatcccagcaccttggaaggccaaggcaggcggatcacgaggtcaggagatcgagaccatcctggctaacacagtgaaacctcatctctactaaaaatacaaaataataataataatagccaggcatggtggtacacacctgtagtcccagctacttgggaggctgaggcaggagaatcacttgaacctgggaggcggaggctgtagtgagccgagatcatgccactgcagtccagcctgggcaacagagcaagactctgtctcaaaaaaaaaaaaaaaaaaaaaaaaaaaagcttatccaccactatcaagttggcttcatccctgggatggaaggcttgttcaacatatgaaaatcaataaacgtaatccatcacataaacagaaccaatgacaataaaccacatgattatctcaatagacgcagaaaaggccttcagtaaaattcaacatcccttcatgctaaaagcactcaacaaactaggtattgatggaatgtatctcaaaataataagagttatttatgacaaagccatagccgatatcatactgactgggtaaaagctggaagcattccctttgaaaactggcacaagacaaggatgccctctctcaccactccttttcaacatagtattggaaggtctggtcagggcaatcaagcaagagaaagaaagaaagtgtattcaaataggaagacagaaggtcaaattgtctctgtttgcagatgacatgattgtatatttagaaaactgcattgtctcagcccaaaaactccttaagctgataagccacttcagcaaagtctcaggaaacaacatcaatgtgcaaaaatcataagcaatcctatacaccaatagcagacaaacagagagccaaatcatgagtgaactcccattcacaattgctacaaagaaaataaaatacctaggaatacaacttacaaacgaagtgaaggacctcttcaaggagaactacaaaccactgttcaaggaaataagagagcacacaaacaaatggaaaaacattccatgctcatggataggaagaatcaatatcgtgaaaatggccatactgcccaaagtaatttatagattcaatgctattcccattaagctaacattgactttctccacagaaccaggaaaaaatactttaaatttcatatggaaccaaaagagagcccatatagccaagacaatccaaaggaaaatgaacaaacctgaaggcatcacactacctgacttcaaactatactacaaggctacagtaaccaaaacagatacatagaccaatggaacagaacggaggtctcacaaataacaccacacacctacaaccatctgatctttgagaaacctgacaaaaacaagctatggggaaaggattccctatttaataaatggtgctgggcaaactggctagtcatatgcagaaaactgaaactggaccccttcattacaccttatacaaaaattaactcaagatggattaaagactaaaatgtaaaacctaaaacaataaaaaccctagaagaaaacctaggcaataccattcaggacataggcatgggcaaagacttcatgactaaaacaacgaaagcaatggcaacagaagccaaaattgacaaataggatctaattaaactaaagagcttctgcacagcaaaagaaactatcatcagagtgaacagacaacctacagaatgggagaaaatttttgcaatctatccatctgacaaagatctaatatccagaatctacaaggaacttaaacaaatttacaagaaaaaagaaaacgaccccatcaaaaagtgggtgaaggatatgagcagacgtttctcaaaagaagacatttatgtggccaaaaaacatgaaaaaagctcaccatcagtggtcattagagaaatgaaaattaaaaccacaatgagataccatctcataccagttagaatggtgatcattaaaaagtcagcaaacaacagatgcgggtgaggatgtggagaaataggaatgcttttatactgttggtgggaatgtaaattagttcaaccagtgtggaagacagtgtggcaattcctcaaggatctagaatcagaaataccatttgatccagcaatcccattactgggtatatgcccaaaggattataagtcattctaccataaagacacatgcgcacatatgtttactgcagtgctattcacaatagcaaagacttggaaccaacctaaatgcccatcagtgatagactagataaagaaaatgtggcacatatacaccatggaatactatgcagccataaagaagaatgagttcatgttctttgcaaggacgtggatgaaactggaaaccatctttctcagcaaactaacacaggaacagaaaaccaaacaccacatgttcccactcataagtgggagttgaataatgagaatgaacgggcacagggaagggaacatcacacactgggatctgtcaggggttaaggggcaagcagagggaaagcattaggacaaatacctaatgcatacagggcttaaaacctagatgatgggttgatgggtgcagcaagccaccatggtacatgtatacctatgtaacaaacctgcatgttctgcacatgtaacccagaacttaaagtttaatttaaaaaaaaagaaaactactagatgtttttctctttaattagagaaaacaataaatatatcaatatgtcaatatagtattttcaattcattgcaacatgaccagggtaaacacctaagtatttatttctggaagtgatgctacagtaaacattgaaattgaagaataatgtctaatacaattttccagaatagaggagccttttgtttttcaacaccaattattgtattggaagaaactttctatttaaataacaggtttttacaccaaccacagctaatagggcccattgcataaacaagtgcattgtgtaacagttttaggatgacacttgatatacagtctggatactcgtccctgcccagctctcatgttgaattgtaatcctcagtattggaggtggggactggtgggaggtgtttgggtcatgggggcagataccttatgaatgacttgggccaaccccattggtgatagtgagctctcactctaagctcatgagagatctgttggtttaaaagtgtgtggcacctccccactgccttgctcatgcttctgccatgggacatgcaagctcccacttcttctgccttgaatgaaagttttctgaggcttcaccagaagctatgtttcccacacaacctgcagaaccatgagccaattaaacctcttttctttataaattacccagtctcaggtttttctttatagcaatgtgagaatggcctaatacacttaagaaaataataccctaaaaatgaatttcactttttcaaggcatttgaacatgcgctattccacttcatgcttttccacaattatatgaattcaagatggtatgaaaagaaacagggaattgtcttgaatagttaagtgcttcatccaagtctctgccaagagacttcatatccttgtaccttctggtggccacgattgctaagacaccatcaaatgaatgtaggactcctctcacttaagaatagcttttcagagtaagaaaagagatgctatatttgatgtacatctctgctctgataagtacactgattcaaaaaatgattcagttttttaaaatgtgcccactagaattcaaactttatgacatagctaaggttcttagccttagtttattaatgacatttttgttcataagtgtaattcagacaataacacgatattaatgtaatccttgtcattcattccagtggcaactttctctgtgtaacatgctttgcactgaaactagtttatgctcctggcacagcatctttaaagtagaaaatttattacataaacatttccagcaaattcaattagcaccaccaatacaaaaaaaaaaaaaatcacactagcttacgtgagttgatactggtctgatttatacggcaaaactgtctgactcttgcctcataatctaaaatttcatagtaggaacactgtaaagttatctgatttgtggtacgtttgaggaagggtaatctcctcttatgccatcattctcctaaatgcccagaaattttactcaaggtcagttggagcactgaatgctctgtgagtcactgatgctcaggcttgcctgccgttcttttataggatctctgtgggccagaaaatcatgaaaatatagttctacaaaaaaataaattcctccaacactgaattctctttccaatattacaatttcatggggagaaaatggaagaaaatgagtgattatgttccaatttcattttaaaactacagtgatagtgctacattgttaaactaatctcatttctagaacatacatgtaaggacaaaaatatcaagttaacaaattgtttttatcttataaccttccattatgacaaaagcaacaaaaactcgaatgccttctctagtaagagaacatggatagtgctagcgttgatacaggggtctatccattctaaaatgtcaagacacagaaatagtgaagagaaggcagcctgagtagatgaaaacgataaaaactttctcatattgacacaacattcctttgttcaactgaaatcagtgcttttgaaaacccacttggctgacagccctgagcctggggcattctccatttcctttacaaattaagtcagttatttcaactctgccccttgccccaggcctgcacttcccttttacagaacctccctcctattgacttcagggcacaagttcatccttctctaactcttgcttttcacactaaagttcatacacctgaaaggaaaacctataaataagctctcaggacaaataaaaatccatcaatgcgaaggtcagggagagctttcaatgatacaagcgcacattcattcaattattcattcattcatttgccagcacccactctgcagcaggcccaatgctaggcctggagacacgcataataataaaataagactcagtcccttgtctcagaggtgtttacaatccggtcagcgtaactaacataaattaaagttaggatgcatgtgctaagagtagtataaataaaatgctatgggggaccgaagaatgacccttgcactaaagtctctttgcctctgggtcctcttatttatcagggtctaacgtcaccaagcagcagctgaaaggaaaggaagacaatgctagcagtagcagcagcctcagcagtgctcctgacactgagtgggaactggggaggggtggagctcacaagacttattacccagcttcttacattttgataaagggaggaaacttccctccacttcccacaggggaacataggagggaatgccgtctgtaagatattcacagcaacctctatcaaagtttcagccatttcccacttttactccaaaagtgaccatattctgcaatccaaaaattgggacatgggatctgacaaataagtttttttccaatcaaaaagtatatttttataaagatctaaagacggaatcacacatggctatatactcaacatttgttgagtcattattaagcagggaatggtccataaaacctatcatgtgggttgggatagacagtaacatgtatccatgtctttgcttctaccacacccaaactgcattgatgctgatgctacaaaaagccaatggaaaggattgttttttcccaattcctgagaaaacaaactcaacaatatgcccttacaacacacacctgtggtattctaagctcattccttccagggagaagaaaaaaaaaaaaaactctaaaaagttataacacctcatttatcccaaacttacaggcatcagacacacatctatgagcaagcatgcgagcaggacgtgccaatagcatcccccactaaggacatgtactaaaccttatgaacatgatgatatcaaacaggacatttagaacttcaaggatcctattaattcttattttgcatacaagtgtagtcactttgcttttctggtttaatgactcatcacagattagaaaccaggaattttaaaggggtagagagaagaagtattgaagttaggcatacaaagagttctggcacactataaatatttgttctataaaccaaaaaggatctgaggcatgtctcaatcagtttagaggtttattttgccaaggttaagagccagcccacgacagagcctcaggaggtcctgagaatatgtgcacaaggtgtggttgagttacagcttgcttttatacattttagggagacagaagttacaggtaaagacatacgtcaacacacgtaagctatcactggtttgcccatctccaaatgggcaggttgggaggggtgcttccaggtcataggtaaattcaaagatttattgactggcaattgtagaaacagttgaagtcagcctgagttaagataggggggattgtggaagccaaggttcttgttatgtagacaaagcctccctgtagaaggcttcagagagaatagatggtgactgtctcttatcagaccttaaaagacatcagactctggaaaaaaactagtaatggaaggagagtctctatagaacgcaaattcccccgacaagaaacagctttgcaggaccatttcaaaatatgtcaaagaaatatattgtggggtaaaatacttttatttctttcaggacctgctgtgttatgtggtactataccagagtcaggttggaatttggtatcttactgctacaaaaagtctgttttgtcagtcataagagttctgttttcatgttaatgctgatcaattgtgtctaaactccaaagagaggagagtataaacaggcatgtcctggtgctcccttcccatcatggctggaactagttcttcaggtttctttgggatccctttggccaagaggaagatccattcttttggctaggggtgcctagaattttattttgggtttacagttccacgaatgaaggaatgagaaaacaagtcacatcaaatagacttgcaataaaaagacaatgttttaaagtctgttcaaaagacatccaggactattcattgcctttaaaattttctatacagatcagttatgcttactactatttgccaattctaatgatactcaccattaagaaactcacattttattcagcatattatgctgaaggagccataaacatgaaaactacacattcaaggtttttcactacaaaatagtttccacaaaaagcttctgaagtggcgagcttcagtttttgtaaaatttgttaacatgggcactccattcccaaacaatgcaagataaatagagtgtttactttgccttgaaaagtacattatttatagaggtatgttatactcatttaaaataaacccacttaagatgaagagaaagcccttgtctttaatcatccagactgagatctatactgattgagctttctgtataattactcacatgtacatttcacactgtgtagatacaatctagggcctactgtaggaattgcaagcaatttggggattttgcaataatgtcattttggaagatggatgcatttctgattcaacaatggttattaatctagtagcctaggaaaaaattaacaggcatctaaaaatttctaaaattggtttgcaaaggtctagaatatgcagtttcccaaaccattcacatatttgggtaattccaaataatttatctgcagcttttatcttgtaaagtatctcaaaagagagcaggcaaaccagataagctggaaggggtggggggctgggagggaggagtcagaccaaattgtttaaagtcatattcaatattattggtagaaagttctttttacctgatatttactcttagaatactttccttttaatcatgtatgcaatactataagtatctacctctattcaaaaacgataaaaacattgatcaaagtttactgtgaaactttacaaaaatttatgttgaatcatctttattcataatagctcctagcacataaaactattcaataattcacaaatttttgttgaatgaataactgaatgacacacagctcctagcacataaaactattcaataattcacaaatttttgttgaatgaataactgaatgacacatagctcctagcacataaaactactcaataattcacaaatttttgttgaatgaataactgacacttgcatgtctcaatgacacaatggcaaattgtatctttttaaccttaattatagctacagtgcactaatgacacagcatcattgtcaagagctcagcaccctcaccacctccagcaccaaagcacttttagctcccagtggcatgttctaggtattgcacaggacaattcagaagcataatccaagtccttcaggaagtccaaatttaaaaagctcaagcgctggcaaaaattttaatttaaaattattactctagcagtgcgaggacaaaactaggtggttggtctaatttgtattttttcaagtcagttgctatggttttaaaaattcatgtagaagaatctctctgttaaacacacagagagagagacagaagaagaagaaggaggaggaggaggagaaggaggagaaagaggaggagcagcaaaatcatttacatggttattcagttcagtgtaactgacttgggtgagcaatgaatagaccacaccgctgagtcttcaaggttgtatccaaatgctctcatttgacaagagttaaaaggaacacacgagtttaagataaaccctgcctttgtttttaatatttagtgatatgattttggttgaagtctgggagggtcactatatcatcagaaaacacagaagggatattgacaagcatcttatgagacaaataagaagttaatctgagagttgagaaaaatataaatgaaaacaaaggatttttaaggagaagaaattgataagagatgaggaatataaataaatattttaaaagcagcttcagaacatccaagaacagttctcactttacttgactcatcaagacctgcttaggaaagaagatagtcactaactcttctttaccaaaaagaccaatgaattatgatagaaactgatcaagataatacaaagaaaggaagggataaaactcaagagagcatgtaacaaaggtcaatacacaatgaagtcatctagaaagataaagaatattggcaactcccaaaaagcagtacagtcagggccaactgagagtcttagaaaaaggaggcatgtttggctgcccacagcctggagaaagagtgagtatccaccatcacagagagatgtgcagtgcagaatctgggaaactaggaaatctccccaaactagagcaaaatgtcagattaatggcatccagctctggctgcacattagaatcaccgggggaagtttttagaaatcgcaaatgctcaagccccacctggagagactgattcattttatttaggttggatctgggtttagaaactattttaaagtagtaattagcagagacagaatttgaactcatatctatctgactccaaatcccaggcttttcctattgtgccacaatgtctccttctagccctacccaaccaagcggtattggaggggtggagttgcctgtgctgtagtttctcctctgacatactctcaggtgctcaggcttagctgtctgagatgaaagcagaggcagtagctgtaaaagcagatggtcaagacttgagtctgttttctccctgaatgattttccagtttttctctgcaaggtagagttcatgattcatcctcttttaggctagaagaaaactacagaagcctgaagtccaaagaatggagccccagaatacaaacaggccagtgttgctggcccagggaagggaggaagatgcacagggcaggagaagtaaaagggacaaaggagtctggggacctcccagaacccatagggatgggtgccctgaggcatttagaagagtgattatgaggcagagcttccctgaagggcaacaagccccctgtgtctgaacagaaacccatctatgtgcagattggttcatcattggtcctcatgcactgataattaattctggtaaggaataatgaatggcaagatgaatgaaacccagccacgctctgtgagcaggtggatccagtttcactctgagcatcctgactgggcctcctccctccacacacacagacccttcaagtcattgccatccttgccccatctccaggtccctttgctctgcccacctcagcccttacaagaacagaccaagtgtacaccttccaactcacacctccacacacaaataggaaatctatcccagttaagcctcatttctgcacatgacagattaaaataaacaaaacaccagtcttctaagtggaaacatggatatttcaaaacaccaagcagctagctacctaagctgttcacccaaagcacaaggtaaatatcccacagtaaagcaaaagtgatctgagctctggctaccctaaagctttggaaacaaggtcctaacaaacacactctttgagcaaaacaccaaagacaataatggtgagcaagcagagatggcagcaagagggaagcccctgactggagggacctgttcaccaacactgtcttcaccctagggtcaagtccatcagccctagaaccagctaatcttcctgcagaagatataagcacaaactccaatggtgcgagaccctcagaagttgtactagatgatgacagaaatctttttgccaaagccacagaagtttctgtggacagtctagaaagggaacctaccctctccttgtaaccttctcctgcaatcaccctatcacccctactacagttattgctgccagaattgaatcaaagagtgtgtctgctcctgtgttctttgacagatccaggaagggggtacagaataatgtttgtactctaaattaatatggcaataacaagtatttagttatcctcccaacatccacttcccgttattcctaattgagtcctttcagacattttaggaactgaacattggactaaaggagtcagggaatctggcttctaattttatctctactgttctttaatccagtggcctgggcacatcccttaccttcttaagacaaagagtttgtcacttgtgatattatgacaagaatgtgagcccctcagggttcctatgctggtcaaacaagataacgtatgaaagtcttttgaaaactgttaatcctaacaaagtggcattttgagtcactttatttgattcaattatacaataaatactgtagggatatttttaagcaaaagatgcacaaaacaaaggataatacttctaacaacaccataaatgagatatcattctgtgaaacaggtacctactcacatgaatatatggaggaagggaggaaatctttctttctgggttttcttttttcattcgcctctaaagacagtcactaaatgtcttcctaagagcagcatggggaaacctcaggaataagggctgtgtgctccataagttccggagtttgtggaggccttgtttcaaagctcagggcagaaatcaaaagctgtatgaagtaccctgttttgtgtccatctgaatcatgaattcttctaaagctctccaggaaaagtatcagtttcagggtcactagctcccatattatgcccctaaactgccttttatcatcactcagctacttcatgctgcccttagttaccccaaagaagggtggattttaaaacttaggaccctcagtaatctatgaacctggcaggatgttgttgaagctatttgaattcccagaagaaatataccctagagatgacatgaatttaaactaatccaaggagtattaaaatggttgtgtgctgccctttgtctcacaggttataactgatgcagtacaagcaagtgggaatgaaaaacatgagaaaaatctaagacagtaactgcagaccattcttcttggaagttattcatttcaagaagcaggtgataattactttctagagacagtaataagaaaatatagtcttgtctggattaaatctatcttgatggttgattgctatccttgggacacgttccaatgagaaaagcaaacaaaatctgtattgtcttcatataaatttcatccagttgagccgattcacatatatgaaaacaagatttcttcattcactgagggaaatatttttctgctgataagtcaaagaatcttgtttctatcactaagatcctttttaaaaatagtaccacatgggctactagagaagcaggtgtcaataacacttaaaaatatagatggctatgactagtggagtgtgaatggctatagctgctgaggtgagcccagcccaggaccccaggagaaaggaaccctggaaattttctatgctggatagcatgcaaattccccatactaggggtacctcctggttaggccatcccccaaaaagaccttgtcctttggcagtttggaaacctttgagcttcagggtacaggttgcatgtgtaagagctataaatgcagaacaagtgccacaggattagttcatgtaaggtgataattaagagccatatgcctatcacataggaccaacttcaaaaggatatgtgaggtatagcccagggaggctcagaacacatgagattggcccttgtcctgcagtcactgctcaccagacacctgggggccactagcctggcatggccactccagagaattggttctactggaagttttgttcaataaaaagatatcctgattgttgatccatattctatttttttatgcaataatcaagcagatttattttgtattgcccatggtagtatacctagaggttttagagtcctcattttcttccaacctaacattgttactcaaagattaaggtggaagcaagttcaccaacagtagtcctataaatatcaatgaccaggagtataaacccatgaacaatgactaattcttcaaaggtatctaattcattctccccaaatttctgtatactaagggatcttcttttcagaggcatgtgagtgaggatctcctgccaaggaatctaaaactctgcattttattggattcagatcagaatttcagatactgggatcaaaaccaattagaggaatttgttgaatccccaccaatgaaaaaacggccagttcagaactatggcagaatctttaaaatataatttcttaaacatattaatagctagatgttaaaaaataaagaatctcatcaggcaaaaccaagtaagacaaaattcatatttgttgacgcccctagtcttcacaagtgacttcaatcccagtctaactgtaggcaagcagagctctccagcagaagctgccaacaccattctcagtacaattatctgccctcctggcccaagaccaacagcctcccctcgactaaaatgaactccttttcaccttgtcattaaaacttcacttagcccaaaccccacttttcaaatccccagcacaagacacaccctcgaccacacatgagttctttcagggtcgtcctcatcctactatgctctgtctggttttcctcccggttacattcgcactagagcactcacctgggccaagcttaataaatatactgcatgtggttgaacacccgcaatcctgagcacagaacagacattgtccaccattctggactcttcctcaaagagcctggatgatacttcaaggtccttctcccccaggctgccattcaaggcagctctcctgagggtgggcaggtgagagggatgatcggttagtaattggcccaccagtggatcttgcacctcacctaaccaacaactgccattctccacccttctctggcacaaaatgcaattcaacataagcctgatgggtgttctgttcccacatgggttaaatacaggccgacagccttataactttttgctcttacaaactgaaagaattttaaaacaccatatatccccttaaatttatgaagttgaaatctatattcttactttgcataagtttgaatagttttaagaacatatatttccagcatcttgtaaacatcgacaactaaaaattacatttttagtttaaccagtgaagtctaaataccacaatgtatccatgatatctaaaaaccgtaatgattaaataatcaccatcatctacttaaaaaatacaggaacaagctccttaacgtttttgaagaaacttttaattttagaataattttagatttacagaaaaattgcaaagaaaatacagagttctttcccctgctcttttcctgttgtttttcttccttgtctggttttaactagggattttatataatctcattttactttatcattttgattatacatctttttaaaaattttcgtggtgtccctagaatgtagtccatctaaattgaaatctatttcaaataacattccactcacatcacatgtgctccaaggaccttataacagagtattcccaataagctgctctcatcccataggacattgctgtcattcatttcacttattcatatgctatgataacccaaaacattgatatcattattgctttaaaaagttcttttgaatcaattaaaaaataagaaaaaaagattttattttatactcatttatttcttctctgatgttctttcttctttaaatagatctgagtctccaacctgtatcattgttctcctggcttttaacatctcttgaagaaaaagtcttctagaggtggattccctcagtttttctttgtctgaagaagcctttatttctccttcatttatgaaggataatttcactaaataaaaattctagatgggtaatttctttttctttcaatacttcaagtatttcattctactcttctcactcacatggcttctgaggagaagtctgatgtaattcttatccatgttcctctaagaggaagattgaatatgataagcctaaatggtggtggattttttggcatttatcctacttggcactctctgagcttcccagatctatagtttcatatatgtcattagttttaaaacgttctcagctattattacttcaaatatttcttctactccattctctttcctctccttcagaattccaatattgcttatgttacatcttttgaaatagtctcacagttctagggtgttttgttccatttttttccattctttttctttttcctttgcatttcagtttgagaagattctattgacccattttaagtttactgattctttccttggatagttgatttcactttgaactccaaagacattcttcatttctcttactgtattctttatttctagcatctccttttgattctttctcatttccatctctctgcttacattgcccatctattattgcatgttgtctactttttccactagagctcttcatatatcaatcatagttatttttttactccctatctgaagatcccaacatctgtgtaatatttgagtttgggtctaatgattgttttgtttctttatgttggggaaaagctgagttttgggaaaaaagctgaggcagggcttgcatctctgacataatgtaaaagagtcttggaacatgtcgggggtccagggtctgaaacccctcatggtctttggaacaacaagctctgtgccaaagggtggaaggctgccctgccacaccataatctaagcccagggcataaaacccctcgtggcttggatggaatccagggctcagggcataaaacccctcatggcctctggaatgtgtctagacttactggctccttgcttctagcattcccaggcttataaaatgattgtatcttaaactagaagaacatgttccccattatctcaagtaccagaatatgttccatatgcttcaaaggaaatgctaaaccatcacagctatagcttatgcacttgatgcaccacttcctttcaaccctcatatcctcaccacctgcttctttgttggattaccaataaatagcatgggctcccagagctcggagccttcacaacctccacactagtgttggccccctggtcccactttatgcactcttaaacttgtcttttctcattcttttgactccaccggactttgtcgcccccatggcctggtgttgggtccagctgccccaacatctctaaagtgtgtgtgtgatttttttccttgctatttggcatgtcctatcattttctgttgaaggcagaacacactgtatcaggcaggaggaactgaagtaaacgagccttcattgtgtgtgaggatttatattaatctggctaggagttgagctatataattgttgcgtagttacagatgccagaggtctgaaaattcctctggtggtctttgtttttgtctcacttcttgactttgggcttccttaagtatctcctcttcagacatggcctgtgtctttcagcaatttcagccataatccactgttataataatggagccgtgttggtgtgataataaggtgtgcaggaggtggagtattctatattctcccaatcaaagaatggattgggtacaaagactgaatatgagacccatctgtagcttggagagtaatccactttactcaaagtctactgacttaaatgttaatctcatctaaaaataccttcatggcaacatctaaataatgtttgaccaaatgtctgggtactctagcctagacaagtttacaaataaaattaaacatcatagcatgtgttcatgttatatttgactgagtcatgatttatctctataaaattaatacttaaaagccagcaggcctttggggccaagttaggctgggtcctttttatttccaaaggctggctatgcccttccaaagtcagccaggccttccctataggagcagcccccatcattcactgctgctaagcaaagaaccccaagtattattttacagagtagcatcgtgaacttcatgtatgtacagtcaccaacagcaaatattttcatagttcctgtaccaaagaagcttttacaaagttaattcagcagtcactcaaaatattgattgaacatctattggactcaagtcattgtaggagacacaaggtcataaatacctcaaggagcttaaaactagttgcagaaacaagatacagtgcatcagttcaacatagatttttaaggagaggagttcaagttctgatactaggcagatttacctagaaaagtccactctagctatattactaaagaaaatgcagtaagatgtgcaggtgatggtggtaaaatctgacagatggcaagagatttacctctatttttaggattacaacaaatttcgaaagactaaacccaattctaaccaggtcagccatgaggtcctgttagatggtgctggttattccccttgtacagcacctacaacactgctagtcctcgatcacagcttctctctggaacttttaagcaactctgctcaccaagcaacaacttgacatcttttcaaacactcacattataaaaatgcattccaatttctctagagatggccattacagtgactcatgtgagagttcttgccttagcaatagagttatgtgtactttggacttgactaacagaaactctcttatgtggtaaacatagatatcttagctggttggcaaccaggaaaaggagctgtaaatgataaattgcacaggtatatagttcagcttccctttaacacaacagtttacacattggctgaagaaagtattatctgaagcttaaaaaacagttattttatagttgaaattcattttattgatctcatttggaaatgattcacatttttatactcacttagcttcatgaaggttacgaatcagtagagtaccaagagaaggtattcaaaatgaccactttttgatatcttctccgggcccttttcttcctcccaactttcttaattgtccctgtcattgatgtttccatcttacttatctttttgcggagatgggagttgttttctagggggaaagatttttggtgttggttttgggtgttttttgttccatcatcctaatacctagtactctttccccattatcaagatgacagatgttttgttaaagtgatagattatagtttaacagtaatcacaaatctggcaaccaagatccacaacaagccccaaactggggcacagcaaaaagaaagctttctaaaggcagtgaactaaaagttgtgcagtttgctggaaagtccctaatcttacagtaatcctaactttatataacagactgatttaccactcctgagcatattagaaatggcaaactttaggggtgggggtgaggctgacacactgtctccagtgagagattatattggccaggggaaaatctacaatgagcaaacaaattttctccacaaatgatgcctggggtcttttagactgatgaaaatatgcaacacttttttagtccaatatgttatctagttggggctaaaaaaacatgactaccagctgggcacagtgtctcatgcctgtaatcccaacactttgggaggccaaggtgggcagatcacctgaggtcaggagttcaagatcagcctggctaacatggtgaaacctcatttctactaaaaatgcaaaaaattagccagacatggtggcacacacctgtaatcccagctgctcgggaggctgaggcaggagaatcacttgaacctgggaggtgaaggttgcagtgagccaagatcctgccattgcactccagtttgggcaacaagagtgaaactccgtctcacaaaaaaataaataaataaaaaaataaatgactgccacttttcctctgttcttagatatatgttttcactttttatttctaaaattgaagtcaatcagaattgatgtgttcctttcatgtaatagtgtgtcttaaggaaatcagtaatggtagattttataatcaaatagaagaaatgaagtaattaatatgcagaaatagattgaattagattcactgtcctctggattgagagcttttgaatgttttacataaaatttcacccaaaataaagcatttttatttatgagtttgacttaatagggtaatctggaaaattagttatgtagagtgctacattccctgaagatgcctgataaatgaactagatacttaggcagatggagctcccgaaaaaagaagccaactgttatcataaacagttgctagtttactttcttcgtagattttctttttttctgattagctggttttcttattttcctgcttcttcaaagacctgctacagtgaagtttagagactttagatacttgcaagtataatttttcagctttcacagaagaagtacatatccttctattcttacttaataaagaaaagttataggcttgagcagacagtgtttttggccatttctcttgctttattttggtaacagttaattagcatagtcctcaagctatccctccacaagttaaaaaattaaaactcccatttgaatatttatcaaaactctttacgtggcaggcactgtgctcagtgggcactgtgtgtaaagataaagaagatgcaagctctactcccaatgggcttatgagggtgttgacatgaaaagcagaagtcttaggaaggactcaccaacaagcaatataatcctgtgaaacacactcttacagcccaccccaatatcaaccaaatgagcacacctccaaagaccatctcgatttcaataaactgaagcatacatactctcatggcaccccaatttccaagacatcctcaaaagtatgcagagtaggacagaactaaaatagttactgccacaacgctaaccacttatcagatacaggatctctgacagaggttttcagtatgtgtgagtgtgagtttaagtgtatgttctttcttgactccacttcctttctcttagtcattatatgtctgaaggagagttacagcaataaacttgaatccactcattaatttaagtaaaccgttcacaatctttatttttttagtagtaaaaaatgacttgtgacatctcacaagaccaatccacagtgaacattacccagagaatttagcataaattctacatataaaatcaaactaagattttagcttgaaattctattagagaaggttaaattttcaatgtcttcattcactaggtacagcatatcctgagtgtacgatatgtttgtctgctggggctgccatgataaaataccatagactgggtggcttaaacaacagaactcaattttctcatagttctggaggcggaaagtccaacatcaaggcatttctgggttgagtttctcctgatgcctctcttcttggcttgtagatggccaccttctcacggtgtcctcaaatggccttttctcttgcgtgtacatatccattcccagtgtctcttcctcttcttaaaaagacaccagtcccattcgatgaggatcctactctcatgacctcatttaaccttaattacttatttaaaggccttatcttcaaacatagtcacattgggtgttagggcttcaacatgtaaattttgtccatatttttcatttcagtctctaatacacggtaacctccaggagtttatctattattcctttaaaatgagaatcatctgacccagaaattatctacaaatagactcaaagaagagtaggttccaaacctatcacggcatgcctggtagttcagccactggctcctggcttcggccctcagtgaagctgtcttcccctcatcaaggggatttcaaactatctacagtttgctgtcagcagttcttggtagctaagtaggtctgagcaatcaggcaaaagagagatggtgaagctagttcttgatttgcaacagtacaattgccaggttaacttcctggctgtgggcatcccttagtggtctgggatttctccctcagagacaaccacacattgtcaggggcttcctttatccggcattctctaatgcatcttctccatggcgaagactttttgttttacttaacataacactgatcccaaagacagctacatctcccctcagtcttgaaagtcacccctgggtaaacccggtgtgtgggagaactgggtttccccacttcctgaacacagaacctcagcctctgtccctctgcctgctggaaaggttggtgtggatttcaactcttacacccccttccctcttccacaaggagataccagcttacagttccacttgccccaccactgttatgaattccataacaaatttagaatattaaaataaaagctacaaatttgtgagtgcttactatgtaccaggaactgtactaagtactttccttacattacttcataaatcctctcaatatatgcctgtaattacagaggggaaaattgagactcagtaatgttaacattactcccccagtatcatacatgtagtaagtggcagggttaatattctaatttccaatgctcaagttttatctaatagtctattcccacttgcctaagtataaattccctacccttcttaaggtagaagaatgtacctatattagagaactaccttttttttttccttttgacagagtcttgctctgttatttgggctggcatgtagtggcgtaatctcgactcactgcaacctctgtctcctgggttcaagcaattctccttcctcagcctcccaagaagctaggattacaggcataagctaccatgcccagctaatttttgtatttttagtagagacaggatttcaccatgttgcccaggctggtctcgaactcctggcctcaagcaattcaccagcctcggcctcccaaagtactggtattacaggcgtgagccactgcacccagtgagagttacccatttttagcaaaacgttactctatgaggaggaagagaggttttggatgctgcttagtcctgaattgtgcacactaggtattcccagtgggctacagccatgcctctctctgcttcaagttccacatctggaaaatggactaatgatacctgcttgtcacattgcaagggccacaaaaatagaaatgagatgccgcatgtgaatggagcttgaggaaaatcaatacaaatataaataaacttatttatatgagtcatacttcaaaaaagaataccatcatactgtccttcatggtatcacccttaacaagacaatgccaaccatctaagttccctcgccccatcagactcctttaatacactacatctagtattgtttaattttctacatgcatccatctagaaacatggatgagcctgtaagtaccttgatttgggagattatgttcattattcttaatatttcctgtagtgccctgcatgcttttccacagtaggtgttcaaaaaatatcatgttgttgggttgataataattatatatggccagagagctggcattaactggtagccatttaaaataagagattaaagttatttcataattaactgaatgtttactaattgtatctttaaccaaactacttgaacgtgtttgggcctacaaggacacaggtttgcgacggtgctgattcaattagtaaccccagcaggttctacccataacttggcttaatggactccaccatttatatcctactcatgctccactctgaaggcagaggggaaatcttgggagagaggagggaggctttggattcttcaatctcaaagtaaatacaaaatatttgcctccctatgtaatttgtcatggacaaatcctcagcaaaattactgaaattacagggagccacaagtagaaattgataactgtcagggtgcttgacagctctatacaggaacaccttcgctaggaagactctgcttgctggatttcctctataaaatcagattttgttttcacttcaaatcattctctccagagaaaatatctattcatcccaccaggcactttgacacaggagccccattctgagagaaatgcatgttgacagcagaattgcagtagaagctgtctcataggatcccatcaaagaggctcttggcaagcctctgttttgagatccacattaactcaaggcctgttccatggtctcttacgtgaaaaagtaaaccagaaaaagaaaggaaaaaagacaataagtcttgtcctgagttagtaaaatattaagaaaaaaaaaccagtatgagtagagctggagaaatagagtatcttggttccttgatccataatattttgataggaataatttaaaccgtgatgattggaaactttgccatttgaaattaagcaccactctgctcctttcaccacatatatcctccaattcaatcttctgctgtaagtaagcaaaactcatgaatatgaggtccataaggctaaaaagatcctatttgtgtagccaagtggctaatgatctaccaaaggttcatgctccctcttccatagtggggacttgttgctgggaattggctgcccaaatgggggctacattcccaacccctttgcattgaggtgagggcatgggactaattcttgagtggaagtgatgtgtgtcacttcgggaccaagaaccttatctctctcttccatcccattccccggcagaaggcaggggcttcggaggctgtagcagaaggcagtgccacaaaacagaaagagcctgagtacccaaatcaccagctggaaggccacccaccaggaacatgagagcaagaagtaaacatcaataatgctaagccactggtgtctggtgtttgctaaggtagcttgcattaccctagctaacccaatttgctttcatggtttcctttccattttacagcttttaattttgatgtgctttttaatggatctattcctctataactaacaattaattatctgatctattcctggattttatgtactgtgaagattgccaaggatctgtccctctggcttactggaatagttatctatctattcttttctccacttatctgtaacagcttggtttatcacacaaaaccaccataggttggtgcaaaagtgattgcggtttttgccattactcttcatgcagaatagcagtagaggctgtctcatatgatgccaccaaaaaggtttttgctattaaaagtaatgacaaaaaccgcaatcatttttcaccaacctaatactatttgatggaagtgattagaatagagttgtagtgtagtacacagatgtaagtttgaatgttgattctgggtaactggacaagttacttgctttcgtcaaggctcggttttctcatttgtaaaaggacaataacattttacctctgctttgatgtttcactctctagtctcaaaatgtgaataaataacttttcgctcagtcccaaacaattttatatatgtctctctctttgtactttgaatcaccgccccaacagacctggcaataattccagtactacagatattattttgcatagaagataagcagttcatccagaagcagccacagtgtgatcggatgtagggctgtttatcttgacaatcctccctgcccccgcttggattacattatgcacaattcaatgtggcttctggtttgtcacgtatgattaatcacactgatatctactatgcccatttcattaaatccttcccactgaagcaggatgcccatatatacccaaagtgtgttttcctctgccttattctggcagatagggaaataaggttaaggttttaccttcattggtaaagttaccctcaaatcaaaacaaaatgctgaaaccatcagttaaatatgagctaatcttataaagaacttaaaaagtttagtcttcaggaggcaatttccagagagtaggttcaataataggaatttccttgtgcccaaaatggggtggggcagtataaagtatactgattaattgtcttaaaatttaaaaattccaactcctagtaactagttgcagcactccaggttgaacatttaactcatggaagtacctagagaatattgccaggtccagatagcatcctacccaactatctcatttgaaacgtaaaaaaattgagggtccgggaaattaaatgatttgctcaggtcactgaaggaatatactgatttaccatgtggctcccacaagagtcccgcctgccagtgctacgtcactctggtatccaaagttcactgtctaagctgctcttctcttctgtctgcactgtcttccttcagaggcaacacagcttatgcttaagagtgttagggacatgaagctctgatttgagctgaatgacctggaggttttcggtgaccctctctgaagttccatgtcctcacaagtaaaatgggattaacaacagcacctgagtcaaagggcgatggtgaggaccagcagagcttctgtcctggcacttcatgtggcctcagcaagggtctactttttctccccgcttttttttttgagacagagtcgcccaggctggagtgcagtggtgcgatctcggctcactgcaacttccgcctcccaggttcaagtgattctcctgcctcagcctcccaagtagctgggactacaggcgtgcaccaccacgcccagctaattttcgtatttttagtagagatggggtttcaccatgttggccaggatggtcttgatctcttgacctcgtgatctgcctgccagggcctcccaaagtgctgggattacaggtgtgagccactgcacccagcccctttttctccctttatggcatccaggcagacagtctgtaacagtggggcaagctccttctgactcatctatttctttgatcattattgttcgttttgtttttttttttaatgctacaactcagatatatctggaagcattcctaagcaaacaggcagacgagccctgttcacagtaagaaaaaagccttctttagataggttacacagaagcaaatttcaggacagcctgaaattatccatgtctcctgcagccaccaagggcaacaacaaaaacaaaaaaaaaaccagaatgagtcaatcagcaaaaactcaaattaaaatctagctcacttgttttccaaaaataaaatactcaacacaaactaaaattcctaacttttaccacaactgtaagtctttcaaagtattcatagacatagaattgaacacaaattggttaaaatcatgggcagagaaacaggaggaccaatttatatttgtacaggtctcagctacctgtttataaattgggatgcttccgtatgcagaagagatttttcatcttgagtatataaatattcttcctaataaggctgcctcatttctctacaaaaagactataatctaaacatatgcaaacaccaggggtgaaattgactgacaatgagcaataaaaataggaaaattcattaattactctttttaaagaggtaaaaataattgctctgtattaaaaccactgtggtattcaaacagaaatttaaaaatacatatgatttcctccagtcttacatttcatactagatagccaagtcaattaaactgatataaatgtaaagaaggtttatgcaaccccacgttgacatttcaagcataagaataatgcatcagttttccactggttcctcctactgtgggcattagccagcttgtagctatcaggcacaaatataaaccctttcgctgtaaccctggcatcacccaattccctcattcaacagtttccatgtagtccttgaaaacagctgcagatgagaccccagtagagtctggattatctatcacctgtagaggatggaacaaacctcctcaccctcactgatgccttgggttcttacagtcaaaatacacagcaagggacaataggaagtgactcagcatttgaaaactgtgtcatcactggcaaacttagtttgcttctctgtaggatataacaagataattctttcttttttttatatatcaacagtgtcattttttaaaaatgggaaacactgggccatattagcacagtttttgtgcagcattgcatacactggtgttctcttcctgagtagcttagcagaaatgcattttctcagcaatttctttccagatgtggcgttggtattgctgggtggaatggggtcgggagggtgttaaaagacaagcaggtagaaaatatcatctgttgtgaagccactaagtagcaaccaggatctgatttgctttatattttttaacaagttaccatccaaaggctaaatgaccctgaaaatcaactgggttttattcaaaacacagtttccagccacaaatctccagtatgacacatatggaatgttgaatgtaccagtgagcagttggttttccactcgctaggagttctaaaccttaaatatactgaagtgattaaatgaaatgcttcttctggcttaaaaattattttacagctaacattacataaaaaatgttttttcatccaaacatctgcagagtaaattacctttcattcatgctagtgccaagttaagtgacacagacagaaaggtttgacctcagtttccgcttccaagcatgtgccgttttccagggctcgtcaattgaccctaatgagcctccaaccaacacccataatggtcttctttaaagattacaatcatatttagacatgtttctgcctttataaacacttgcttcaagcacagaggtgcatctgacattatgtggtcaaaatattcctaagcaactctctgtaaactgattatttttgtaaattgagcaattcaaattgcagttgagagtactctatttacagacactctatgactaattcttttgcaaagctgccttttgcaatctgaatatccagccttgatttatctgtcttgtaatttccaatcttcacatatcaagcatacctaaaaactgcctaccacagtgcctgtcgaacagtagtcattcaataaatgttctggtttaatgatcttgctgcagtttcaggaaatctgcaaaataatttattatatatcatagtgcacccagacacaattcaaaaaactaggtgctatatacacatttattactttggaatgatttaggcatattagatgactttccaaggaattttggaattctagagaagtctctggattggttaatcagcaaagaaatcttcccctggatccccctcatatcctggagctctgaaaggatactctgaagtgtatactatacagataattgtaaggaatacatttccagaccttgacttctatacgtagattttctcagaactttctacagctttctactttctagagctgaggcttcctgacacttcttcctatcacccctttccccagtacaaaaatctcaggagtgatgaatgaaaaccaacagaaaataagagtccccaaagcctaatcaaagagccataatcatcatctccctccattttattatgagatgtattgctagttttatgatttatatgtaataattgtttacaaaaaaatataattcattcacataattttggtcaatttgttttttgttttttgttttgttgtttgtttgtttgtttgtttgttttttgagacacagtctcactctgttgcccaggctggaatgcagtggctcaatctcggctcactgcagcctctgcctctcaggttcaagtgattctcctgcctcagcccccaccaagtagctaggattataagtgtgcacaactacgcccagctaatttttgtagtttttagtagagaaaaggcttcactatgatggccaggctggtcttaaactcctggcctcaagtgatccaccctcttcgggctcccaaagtgctggaattacaggcgtgagccactgcatcagtcctaattttggtcaattggatgctaacaataattataaagataatccaatccagaagaaaagaaattaatactaagactatggtgacaggaaattgatagagtttgattaatattcatattgtttgaggatatcatgatagggtgatcaataagagattttcaaacatagactagaatgaaaataaagtttccaattgtttaaagaactctgtccctattatgcttcttaaggaggagaataggtgccaaatcaaataaaatattccattgcatacactttaaggaatgatgtaaaagttccattttaaattatcaatatgtagaatgcactagaaacaatgtaattttcgacttgctaattttttttttttgagacagagtctcactctgtcacccaggctggagtgcaatggcatgatcttggctcactgcaacctctgcctcccgggttcaagcaatgctcctgcctcagcctcctatatagctgggattacaagcgcccaccatcacgcacagctattttttttttgtattgttagtagagacaaaccccatctttgccatgttggccagcctggtcttgaatccttgacctcaggtgatccacccaccttgacctcccaaagtgctgggatgacaggtgtgagccaccgcgcccggcctcaacttgctaaaattaaaattgtgactttacaatgaagaaaactgaagcgcactattttaacccagtgatcaaagtgaaaagcccaacaacgggacaactgacatcctgtgcctccctgtgtgttagacagagaaagacacaacatcatttctgtgatgttcctgccaaagatgcagagtctgaatttaatcatgaggcaatttctgacaaaccaaagttgagggatattctacaaaataactagtcttgacccttcaaattaccaaggtcatgaaagcaaagaaaggtgaaaaggagaagggaggatactgtgtataaagacaagtggtggaattttaatacaaactgtaaagtagataacagtattttatcattgtacagtgattatgttaagaaatgcatattgaaatatttaagagtaagagagtactgcttatctcaaatggttcaggaaaaaatagataatgatgaagcaaaactggtaaaatatgaacgattaataaatctgggtgaagagtgtataggagttcttttttctactcttgcaattcttcatgagtttgcaatgatttcaaaataaaaagtaagtaaaataaataaaatctaaatgtctaataagatatgggagtgactacataattttccaaaatctaacaggtgtatcagtcaaaatgatgcaaattctggattgtttctcttattctctccaggatctttgtcagtcatgcagtttctactctcctgagtgcctcctgttcatgcatttcccagcagcaagatctgtgtgttcaatttcatcatctcctctctcaatttggcctaacaaattgacacgttctgtctgccaccctctaaagaaatagtaaagaaagtgtcactttctgtttgataagcatgaactgctttgcctggagaagcaatgaattaattaagtttaaagatgaatgagctacaattaatctagcttagtttatattgtcagcatatggagaaaaaagaaaaatcttccagtagaaaacaaacaaaatgtatctactattaaatcactcgtacatgtatatgtatatgtatatatatatatatatacacacacacaggctattatacattatatacagtatgcacacatatatttacacacatatatacatatacaagattgagttcagagtatattgataaagttattctgaatatatctggtaaaatatataaagtataattgaaatttctctttaaaaggaatgaagtgagtctaaatgcatatttcatatttattttatatgtagtatcagagtgtgtgagatacactctctcatttattcctactctgttcctctgaggaaaagaggaaatgatcccatttgacagataagaacactggggcaacatgagacacaggtaaggagacgggttgattagactgagaaattagcctgcccagttgcctgtctatagttccatactggatcatgctgggatctgctagaattttccccttcccccacacacttagatgtctacaaacatacatacgtatgtataacattccatactatacattgtgttacatgaacatacatacataaatatataaacacatatcatttcacccaaactaaggcaaaaaccaacaccaataaaaatatctccagaaaccattttctttatgtccttatcaatgagaggagttaatggattgaacagaggaaagttgttattagcaaaaataaatcctgactcagattgctgagatgatccttaagccagagagttcaaatttccagcctcaagacaaaacttatagctagtgatctctgtaaaatctagagtaaatggcaaaagaaaactgatggtatactgttatctatctataatgtccagagtttcataactaaaaataaaactctggcttctaaatattcaagaaacttccagtatcttttctccaatagtacaaaaatgaagaaatactttgttcccactgatctcttgggcctctttctgaaagcaaaccagtaccaatgagagaaacccagagagcatttcaaagtattgctactgttaagacctctttaccttagaagcacctaagtgctaacatcttccaaaacaagttcactatgactgttcagtgccagccctggagtctgcacagaaaagtgagtcctttagtgctacttgcaacagttaaaaaccagtttggtatatgtcagaccatcaggacagaaaacagagtctgcaatgaacatgcttatggcccacactttccagtcaaagagaagtgagtcatttctgcttcaactgctatccctacaggcctagaaaaatggaaggactgggcaggaggggtcagagaaaggatagaagaagcatagaattggaactaaaactgtgtagccttaaagtgctctggcctgaaaatctagagaaggcttcagcaggagaaagcaggagaggacatggttattttcagtaagtcatagaagggaagatggctaacagaaatgaaatggacacagaacatcaccaaagtagcatgaaggtatcagatcccctgagataggtcttagccaaataattccactcctgcacattagagtttgacatctaaggcccctccatcttttttccagtcaagacctacacaaatgggtgagggcttgctacatgagaagtaagcaggaacaatacgagaaccaagacaagctacaagcaggacatgaacacatcaaaaggcttctgaaaagacacgtctacctagcctgtgaccaggtcaactccctcattaagtttagcccctttaaaaaatatatcttgtttatggtgcctttggtttctcccttttccttctaattaaaagcaatttttgttaacttcttaatacaaaagcaatgctttagaaaaattagaaaatacacatttttttaaaagccagatggtcaacataaacatcattaataaaaataaaagaactgcctatatttattgaccaattatcatatgccaggcactctactaagtattttacatatattatcttattcaatcctcacagtaagtcttatttaaaaaaaaggtgggaaattcattgtacgatgtttaacaccaaacgttatgctgaaacactagattattttgctcagcaaatatctgcttgtttgtttatatacttaaacatttatttagggatgaaatgattttcatcttaaaaaatgaagtcttcccactcagaagcatggactatttcccagtttattcagtctttatgtcccacagtaaaggactacaatgttcttcatataacttctgtccatatcttgctgagttactcttagaactatatttgtgatgcaattatgactggtattctttttctcccaatcatattattgcttgtatatttattctgaatttcctgtaatttttgagagtaatctgttacattttagaagaaaaccaaaaaagattttcttataaggattaaaagttgagggtagagggaggaacaactagaagtgaatttgaattggtttccttgcaagagacagaaataaacacagagtgcagtaaacatcaatcagcacctacttattaactcagtctggcattgaattaggctagagagggttatgaaagaattttataaccactgaccttgacctgaaagagttttacaaaatggttgggaggctgggagtcaatgtatgaaaatctgttagcacttatggagttagtaaatactaaatcatgaagcatgactttatctgtgttaggtgttaagaaaaaagtggggtggaggcaaggtggccaaataggaacagctgggagctatctacagctcccagtgtgagcgataaagaagacgggtgatttctgcatttccaactgaggtagcgggttcatctcactggggagtgccagaaagtggggcaagacagtgggtgcagcgcaccgtgcgtgagccaaagcacggcaaagcatcacctcacccgggaagtgcaagtggtcaaggaattccctttcctagtcaaagaaagggatgacagatggcacctggaaaatggggtcactcccaccctaatactgcgcttttccaatgggcttaacaaacggcacaccaggagattataccccacacctggcttggagggtcctatgcccacggagcctcgctcactgctagcacagcaatctgagatcaaactgcaaggcagcagtgaggctgggggaggggcgcctgccattgctgaggcttgagtaggtaaacaaagcagctgggaagctcaaactgggtggagaccaccacagctcaaggaggcctgcctgcctctgtaggctccacctttgagggcagggcacagacaaacaaaaggcagaagtaacctctgcagacttgaatgtccctgtctgtcagctttgaagagagtagtggttctcccagcacgcagctggagatctgagaacgggcagactgcctcctcaagtggttccctgacccccgagtagcctaactgggaggcaaccccccaataggggtggactgacacctcaaacggccaggtactcctctgagacaaaacttctagaggaacgatcaggcagcagcatttacagttcaccaatatatgctgttccgcagccaccgttgctgatacccaggcaaacagggtctggagtggacctccggcaaactccaacagacctacagctgagggtcctgactgttagaaggaaaactaacaaacagaaaggacatccacaccaaaaacccatctgtacatcaccatcatcaaagaccaaaggtagataaaaccacaaagatggggaaaaaaacagagcagaaaaactggaaactctaaaaatcagagtgcctctcctcctccaaaggaacgcagctcctcaccagcaacggaacaatgctggacggagaatgactttgacgagttgagagaagaaggcttcagaagatcaaactactccgagctaaaggaggaagttcgaaccaatggcaaagaagttaaaaaccttgaaaaaaaattagatgaatggctaactagaataaccaatgcagagaagtccttaaaggacctgatggagctgaaaactatggcacgagaactatgtgacgaacgcacaagcctcagtagccgatgcgatcaactggaagaaagggtatcagtgatggaagacgaaatgaatgaaatgtagtgagaagagaagtttagagaaaaaagaacaaaaagaaacaaacaaagcctccaagaaatatgggactatgtgaaaagaccaaatctacatctgattggtgtacctgaaagtgactgggagaatggaaccaagttaggaaacactctgcaggatattatccaggagaacttccccaatctagcaaggcaggccaacatccaaattcaggaaatacagagaaggccacaaagatactcctcgagaagagcaattccaagacacataattgtcagattcaccaaagatgaaatgaaagaaaaaatgttaagggcagccagagagaaaggtcgggttacccacaaagggaagcccatcagactaacagctgatctcttggcataaactctacaagccagaagagagtgggggcaaatatgcaacattcttaaagaaaataatttccaacccagaatttcatatccagccaaactaagcttcataagtgaaggagaaataaaatactttacagacaagcaaatgctgagagatttggtcaccaccaggcctgccctaaaagagctcctgaaggaagcactaaacatggaaaggaacgaccagtaccagccactgcaaaaacatgccaaattgtaaagatcatcaaggctaggaagaaactgcatcaactaacgagcaaaatgaccagctaacatcataatgacaggatcaaattcacacgtaagaatactaaccttaaatgtaaatgggctaaatattccaattaaaaggcacagactggcaaactggataaagagtcaagacccatcagtgtgctgtattcaggaaacccatctcacgtgcagagacacacataggctcaaaataaagggatggaggaagatctaccaagcaaatggaaaacaaaaaaaggcaagggttgcaatcctagtctcagataaaacagactttaaaccaacaaagatcaaaagagacaaagaaggccattacataatggtaaagggatcaattcaacaagaagaactaactatcctaaatatatatgcacccaacacaggagcacccagattcataaagcaagtccttagtgacctacaaagagacttagactcccacacaataataatgggagactttaacaccccactgtcaacattagacagatcaatgagacagaacattaacaaggatacccaggaattgaactcagctctgcaccaagcagacctaatagacatctacagaactctctaccctaaatcaacagagtatacattcttttcagcatcacaacacacctattccaaaattgaccacatagttggaagtaaagcactcctcagcaaatgtgaaagaacagaaattataacagactgtctctcagaccacagtgcaatcaaactagaactcaggattaagaaacacactcaaaaccactcaactacatggaaactgaacaacctgctcctgaatgactactgggtacataatgaaatgaaggcagaaataaagatgttctttgaaaccaatgagaacaaagacacaacataccagaatctctgggacacattcaaagcagtgtgtagagggaaatttatagcactaaatgcccacaagagaaagcaggaacgatccaaaattgacaccctaacatcaaaattaaaagaactagagaagcaagagcaaacatattcaaaagctagcagaaggcaagaattaactaagatcagagcagaactgaaggaaatagagacacaaaaaacccttcaaaaaatcaatgaatccaggagctgcttttttgaaacgatcaacaaaattgatagaccgctagcaagactaataaagaagaaaagagagaagaatcaaacagacgcaataaaaagtgataaaggggatatcaccaccaatcccacagaaatacaaactactatcagagaataccataaacacctctacacaaataaactagaaaatctagaagaaatggataaattccttgacacatacactctcccaagactaaaccaggaagaagttgaatctctgaatagatcaataacaggagctgaaattgaggcaataattaatagctcaccaaccaaagaaagtccacgaccagatggattcacagccaaattctaccagaggtacaaggaggaactggtaccattccttctaaaactattccaatcaataaataaagagggaatcctccctaactctttttatgaggccagcatcatcctgataccaaagcctggcagagacacaacaaacaagagaattttagaccaatatccttgatgaacattgatgaaaattcctcaataaaacactggcaaaccaaatccagcagcacatcaaaaagcttatccaccatgatcaagtgggcttcatccctgggatgcaaggctggttcaacatacgcaaatcaataaacgtaatccagcatataaatagaaccaaagacaaaaaccacattattatctcaatagatgcagaaaaggcctttgacaaaattcaacaatgcttcatgctaaaaactctccataaattaggtattgatggcacgtatctcaaaataataagagctgtctatgacaaacccacagccaatatcatactgaatggacaaagactggaagcattccctttgaaaactggcacaagacagggatgccctctctcaccactcctattcaacatagtgttggaagttctggccagggcaatcaggcaggagaaggaaataaagggcattcaattaggaaaagaggaagtcaaattgtccctgtttgcagatgacatgactgtatatctagaaaaccccatcgtctcagcccaaaatctccttaagctaataagcaacttcagctaagtctcaggatacaaaatcaatgtgcaaaaatcacaagcattcttacacaccaataacagacaaacagagagccaaatcatgagtgaactcccattcacaactgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcagtatcatgaaaatggccatactgcccaaggtaatttatagattcaatgccatccccatcaagctaccaatgactttcttcacagaattggaaaaaactactttaaagttcatatggaaccaaaaaagagcccgcatcgccaggtcaatcctaagccaaaagaacaaagctggaggcatcatgctacctgacttcaaactatactacaaggctacagtaaccaaaacagcatggtactggtactgaaacagcatggtatggtaccaaaacagagatatagacaaatggaacagaacagagccctcagaaataatgctgcttatctacaactatctgatctttgacaaacctgacaaaaacaagcaatggggaaaggattccctatttaataaatcattctgggaaaactggccagccatatgtagaaagctgaaactggatcccttccttacaccttatacaaaaattaattcaagatggattgaagacttaaatgatagacctaaaaccataaaaaccttagaagaaaacctaggcaataccattcaggatataggcatgggcaaggattccaggtctaaaacaccaaaagcaatggcaacaaaagccaaagttgacaaatgggatctgattatactaaagagctttgctgtgcttctgcacagcaaaataaactaccatcagagtgaacaggcaacctacagaatgggagaaaatgtttgcaacctactcatctgacaaagggctaatatccagaatctacaatgaactcaaacaaatttacaagaaaaaaacaaacaaccctatcaaaaaatgggtgaaggatatgaacagacacttctcaaaagaagacatttatgtggccaaaaaacacatgaaaaaatgctcatcatcactggccatcagagaaatgcaaatcaaaaccacaacgagataccatcacacaccagttagaatggtgatcattaaaaagtcaggaaacaacaggtgctggagaggatgtggagaaataggaacatttttacactgttgggaggactgtaaactagttcaaccattgtggaagtcagtgtggcgattcctcagggatctggaactagaaataccatttgacccagccatcccattactggttatatacccaaaggattataaatcatgctgctataaagacacatgcacacatatgtttattgcagtgctgttctcaatagcaaagacttggaaccaacccaaatgcccatcaatgatagactggattaagaaaatgtggcacatatacaccatggaatactatgcagccataagaaatgatgagttcatgtcctttgtagggacatcgatgaagctggaaaccatcattctcagcaaactatcgcaaggacaaaaaaccaaacaccgcatgttctcactcataggtgggaattgaacaatgagaactcatggacacaggaaggggaacatcagattctggggactgttgtggggttgggggagtggggagggatagcattaggagatatacctaatgctaaatgacaagttaatgggtgcagcacaccaacatggcacaggtatacatatgtaacaaacctgcacgttgtgcacatgtaccctaaaactcaaagtataataataataaaatttttttaaaaaagaaaaaagtgtctagagaatggaagtggtggaaaaatatcccaccaaaacaaacgagctgacatatcattgagtcagtggacagtttgcagataagaagccaatataaacacagatgctttaatatgaaaccagaaggatatctttatgtcgagccccaatatctactaaattctaatactttaacttctcaaatagtgaaaacaaccaacaatacagaaaagtctcgggcggagggaggaaaagtgacaacacacctgtgaaatggcttctcaaagtttcaatagcatgtgtttctaagatatgggaaagccaaaaaacgcatgggcagccttcttcctttagaagtattcaattgttctagatagaaatctcctttctttggttaagaatttattgtagtttcacctttccttagaaatgaaaactgtgattgttgagtaaacaacttgtaaaactattttcactgacacttattaagtatcttggctccctgcattgaatttctatttagtcacttccctcaacatgtagatcaaactgatgcctcaattataatccttgaagaacatgggggaaagactgtttaaagcattccctctctgctaaggaggaaaatatcccagtcacatgagctgtgtagcataatgtttgttttccatgttgatctgcaaaagagagagatgacagaaagagtgttgggtgtggtggctcatgcctgtaatcccagcactttgggaagctgaggtgggaggatcacctgaagtcaggagtttgagaccagcctgaccaacatgatgaaaccctgtctctactaaaaatacaaaattagccaggtgtggtagcacatgcctgtaatcccagctactccaggggctgaggtaggagaatcgcttgaacctgggaagcagaggttgcagtgagccaagatcgcgctactgcactccagccctgggcaacaagagcaaaactctgtttcaatacataaaaaataaaaatagagaaagatgacagaaagcagaatcagaggaaatgtatcactgttgaacatttcctacatgtattgcactgagctcaacactttgcagggtctcccttacagtgaccttctgtggtaggtatattacccttattttataacttgaaaactgaggcttaggggtatatacacagacctgggaactgaaagctacagttccaataccaccagctttgctgcttgctagccatgtgatcttgagtgagttatttagtcatgctgcagctcagtttcctcatcaatcaaatgatgggagtctctgacgatcacgctagggatgatgcatataaagcgcttagtgcttggcttgtagcaagaatccaacagatgacagccctcactattacggcctacactgattcttcagtctgcatctacacccactgtgggtcatcctgccacctgccctgccctgctgtatgacctgaggcttcctcctaaagaggcattgccagagcttcctcataggcaggcttctgggtgaacccagtcattgggaagcactaacaacaagagatcagagctcaggaggagaggagctgaggtatttcttccccactcccttcttcctccaaggtatgttttctgacagtgactgtccctccgtgtctccagcttccaacaggagatccctctctcatagctcctttacccactggtttcctgtagtgctaattcctctccttgcacctccaggactaaggatggtaataaccgcccactgtaactagtcttgggtgtccaacaccctttggtaattgtgttacctgctcccatatttgtaagcagtcctttcatcaaaatctcttggaccatctgaattggagtctgcttcttgcctaaccctggctgatatccaaactcaaaaatcatacactcgtaaatgaaggacccagcaacctctatggtctatggccaatgctttacaaatcacttatttgccaatgataatttaaactgtactggtagtatacaaccacgtattattaaataaccattcttaaaagggaatagaacattgttaaaatatagtttgcaattgctgagaaatacatttggtgatttattcagatgatatctaaaatgttcaatatctcattccaaaggccgcaccccaattacacaggttgcaaaccctatcctgcaagtagcaccaactacagtcccactttctctctgagaaatgtcaacctgactttatcctgagaaaacagaagatcaaaactcttcatagaatcttagagaaagtctctaagcaagagccaaaatgtaaaatttgaggtaattcttattgtcattgtcatgtgcagaagtgcagctacaattctgagggctcggttccagaatattttagaaaaagtaatgagcttctctagttttggacaagacggcatagactcttttccctgctaagtatgaccccaaaccctggatataacacaacaaacaatcataagaacattctgaaaggtgaaagaagaacacagactggctggggacctcaaaagtcaaggagcagcacagcaacctaaaatctcctaaccacccatccggaggcagaagatgtcccaggtaggtgcttcttcccctgtaggaggcaccaggaaagactaagcagaagcacagccagcaccaggcagcccgaggaagcactctctgccccccatgagcctggcatcttctgcctccaaatttggtgatgccaggccaacccatagaagcacttttcaccctcacaggtagcacaagcaggaactgagtgacaaccccatcagcactgggcagcccaagccagagaaaatagtttctgctcctgcaggcttggcatctctcatcctctacccagtggtactagatataaagaagaaccaaatggaaattatgagacttaaaacttcaataactgaaataaataaaaaaattcactagaagggctcaataggcaaatatatgtgacagaggaaaaaaaataagtgaacttgaagatagaacaatagaaagagacacctgtggggcagaaacaaaagactcaacagtcatatcattggaatcttagatggagaaaagaaagagtagagctgaaaacatattcataaaaataactaaaaacttcccatatttgctaaaaaacaaacctgcagatttaagaagctacgagaataccaagtaagataaacccaaagaaagccacactaaaacacatcataagtaaaattctgaaaactgaagacaaaaataagaatggaattcatatgggaaaaagtcaaagtttgatgttatttttcactgagaaaactttgcataacaacagctctgacaagctgatatacaaatggatagaattataacacaatataatgtttataatgtgttagatacaagccctttgacaaatattaatattaaattcttaaaaaattcctatgaagtagttattattattcttattttacagttggacagagacccagagaggctaaataacaaactgagacccagaaaggctaaataacttgcccaaggtcacacagctagtaagtgacagaacccagaattcaaactcagacactctggttacggggtctacattcttgactatgatgcctggaagtggtctagtatagtagtatggaatcatgtacatatagtttagtagtatagaatcaacaaccaaaattgacaaggtccttataaactagataaagagacaaggaataatccaggatttagttccagatgtttttgtttatttttgttttattaagattttctttaaaatgtattagagctggacagtatggctcctgtaggcttggatattagtaactctcattgttcagaattaagcttatactaaagttgtacttggtgtgggcaatgtttttttctgccagaatcatatagtaaaagacatctgtgattgtttttttaaagttgaagttaagcagttagtctccttggcttactacttttattaaatatcaatgctgatgtcattttctccacaaaccaacatcctaaatgatttttatcaggacagataaactctcaaatacagaaagcaggtcttttcattatcctattgattaaaagcaaaatacaaaaaaattagctacatgatacaggcacacaacaaaaatctttgtcaaattttaacatggcacaggtttcaaaataaaattatcccttttagaactggcaggtcaatattatctttttgttctaatatgggaccatttgcagaaatgtggtttcctgtgaactaagagaaagctgaagtgttttgacacactaaactgtactaacaacacccactgaaatgatggcactgtctttgaatgacgtttaccctgagactggagggagccactgggacatactggtacaaactgagtgttgaacacatataaccttaatggataaaaggcagggagggagggagggctagccaagcctctggcctatgtcccttaagtctcttcacctcactcctagggttcttgaataaaatgtaaaactaaggccttaaaaaacctgtagtgtgggaattgactgcaaatggaaatcagagaactctgggggatgatggaaattttcgaaaactgctgtggtgatggttgtacaactctgtaaattaattttaaaaatacagaggtatacagttctcacagattaattttataatgtgtacagtacagctcaataaaactatttggaaaaatatcctgcaggttctccccattgccttctgaacaaaggccgagttcatgaaaacatacaaaatcctttatgatacagcccttgcttaactcacttcttgtctttttttgccacctgtgttcccccagccctctgatccaccactccacctatattctatttactgagcaaccagcagttttcagaaaatctaaagtggctgcatactacagtcctatgcctctcaccctgttctctctgccttctgcctagaagtcttcctccccacagcttcctgaccaacaccaaatggggggttcaagacacagctcaacctgactactatattctaggatgcttttctgactttctgggtagaattggccatttctttttgtgttcctccagagtacttagtcattcaatgtctataaatactttttccttacaggtgacaaaagcatctgcaattctatcaaaatgtccgtgtagcaccaatcccttcctctcagacctataaagataataagcaagagtgtattgagactaacaagaaggtgacacaccaaggatgggagtaacactgagggagtctctcacatggacaattctagcagctttataaccagtctccttacagcagtcagagtgaaccctttaaaacatatctaattttatatatatatatatgaaaaagaatgtaagttttagtcagagaaaccgacagagaatttaaagcctgctccaccacttactatatatatgactatacaagtcgccccaacagtgagcacataatttcctcatctgtaaagtggaggtataactaccttacagacttttgcaaagaatcttcaagattagccacgtaaagttgtgccacttagatatgatttcactttcacttccttacttaggttgttggttcgataattgatattactgaataccagacaggctaagaaccacatcactgatttacactctcctccacatttaaccgaaaagtgaccaatcaaaaagtatcacaactcaggttgatgtgcattcagtctatcccatggtatctttgtctcttttcaaatcacaatactgatgttccaataaatgatgtttattatcaggccatgagccatcaagaaaatactaaactctgcttagaacactgtttaagaaggttggaaaatatatatcaactatagacagttttcttagaaggaaaatcaacatgttagcacataacaaattaacatacaatctgggtaactgaataatatataacggcatgcttccataatagatgaagaattatggaatctctgtttgcaatccaatgtgggtaagaagaaatgtattcattcaacaactattcaaacatttgttgaacaaatgatatatgaaaggataaaagaaccagtctagaagaggaaacttgtgatcttcaggtgaaatgcatgttacaaagcataagaggactgttattgtgttcttaatttcagaaagttaacaaaagactcagggtcagggataattaaattcataagtatgtgaaagaatgactagttccaaaacaatctaagatgaacatctcttaactgatatatggtttctattaaataggtgacatgagttaagtcatcattaactagtactttttcctcttgctatatcaaaactatcaacaaacattggaaagcctacctccaaaatgcatgctgaatctgtgcagcccactgccaccactctggtctacaccactagtctctcatatggacaattccagcagctttatacccagtctccccacagcaatcagagtgagccctttaaaacatatatcgaattatatcatgtgccaaatcaacatgtttcaaaggtttcccattgtacttagaataaaaagcaaacgccatggaccccatgatgcttacaccctggcccttgtctgcccctttatcctcattatctgccactgaccaattcatatgctcaagccagtggttctcaaagggtggtcccaggacaagaagcatcattacctaggacctttttagaaatgcagactttcaggacccatcccagacctactgaatcagagagtctgggtttaaggctcaacaagctgtgttttaacaagcctttcaatgattcagaaacactaaatttaagaattattactctagatatctgctatagtttaaatctgtctcacaaacttcatatgttggaacaatcctcaaattcatatgttgatggcatttggaggtggggcctttgggaggtaattaggattgggtaaagtcattagggtggagtccccatgaagggactaagaagaggaagagagacctgagctgacatgccctctcagcatttgatgccctccaacatatgatgatgcagcaagaaggtcctcgccagatgccagtgtcatggccttggacttcccagcctccagaatcgtgagctaaataaacttcttttctttatagattacccattctgtgtaattctgttatagcaatagaaaacagactaagacaatacattaggcttctttatatagctagaaaataccaagctcttttccatctcagcacctttgaatttactatagttctgcctagaatgtatccctcacctccaccccatgtcaccaccttgattgccccttctccatcaactgtaaaaattctacctgacccaaattactttgtatcatgctacactaatcactactatcataacacttagtacaacctgattttatttacttgtgtgttcatcttgtttgtacactaaaacatgtgctcctttagaacaaggatcttatctttatcaaccacccagtgagttacaaacagtagttgctcaacaactattaaataaattaatgaataagcccagtataaatccatttaacataaggttagaataacaaagttagaatagtgaaaaaagccaccactgacttataataaaagtatccaaattgcctgcttactatgggccagtccttgggctaaatcttttcttgtgtttttctctttaaattctccctagaactcaatgaggtagaactacaatcatcctcactttaagatgaagacgctaagatataaataagtgaaataaattacttgaggctaccaagctgatcattcgcagagccagggttcaaatccaggctgtccaactccaaagttcatacactgcacccccacccactactacctcttctgaaaaaggtatctgaccagatattttcaacatagatttcggcagactacagggataacctggtgaggaagtagtctctccaattcagatctcctacagataaaaccttggcaaaggggtactcaattctgtcaactgagtctcacaaaattataatgttaactgatgggtgtttagaggatgtacattttagaagactcttaaattgagtacagatgtttagaaaatcagtgtcaaattagaaagcattaagcagacattaaggcagaccaaattggtcttttcagaaagctgggtcaggatgggagaaatgtgtgcttgctaagtaggccaggttactcagaagtgggtcttctaactcagaaattagtgaaggcagcccagctttgccagagaatcagacagagtaagaagcctaaacatggagctgaaggattgacctacaggttttcaggtggagtggaaggaagcagattctcttgccaagaccttcacagcaacctgtagatgcagcactggaacccaggactctggcgtgttttttaaccattaacctgatgccagggatgttggaactgtcttggaactccacttttcaacagaaatttctggaagagattaaggagatcctatgccttaaaagaggaccaggacatgttcacatcatccatctgcgggtttctggaggtggggggagccaatggtctcagacttttggaaccactttattttcatttcatagtttcatcacattcggaaaggtttggtatatttcctcatcataaaaatctcattctcaaaattcctcttgaaatatatgtgttggtctccaaatgatgccacacttgtttataggactagatgacaaacactcaggtaaaggcattttactgtgtgcagcaaaatatacagaacattcactttcacaactcaagcatttatggctgatatcattaataaaacatagccttagaatccctcttaatccatcaatcagaatcaccactcaaacattatgtgcctcccatatcatgggtaattgtatggaaataaagaagtatatgaggcagtatagattgacaattaagagtttcaccctggagttacacagacacaagttcttatcttggtgttgttacttaccaaccatgagaattggaccagttatccatgccatggtttctatctctaaaatggaataaaaatcacccgtaactcattatatggaggttataagaattaaataattcaagtaaatacatagtcattattttactaaaatgtgctacgtactactctaggtgtttttcacatattaattcatctcaccctcaaacaatcttatgagatagaaaatatcattatgccccttttgaggaaacagccacagggaggggtaaaggaacttgcccaaggtcacacagccagtaaatggcagagccaggattcaaacccacgcagtctggctccagagcccacatatgtaagcactatactattaagaagacaacaattcctatacttactagcttcatgaaagtaaaaacatttgcaggttttgctttgaaagatccaagtgaatgctactagaaaaatacaaagaataatgtactttttttatcttaagcactagccaaggaaacaaagaaggagcagaattcactgtacccaagtactgtgtggttattttgatacaagtcaacaactacagcagatgctggtatccatcttcctgacaggtgacaggtagtaccaacactcttcagatcatgagacctcaaaatactcattttatcctgacagcaggggtgagaaataacatgtaaatcatcatggggagatggaggcctaagtaaatattccaggaaaagggctcctttagcataaagtagcctttttcacacttgtgcagactccagaaaggaggtgccccatggctgtcagctctggtgtgctctgcagatgactggtcttccagccaaactgttggctggcttttttctagcaattcaatctagcattctgctagtacataccccagcacaaagcgggccaggtccactttattacaaggttacaggcaagccatagataaaaagtgagtccttaaatatcagggattaataattcaggaagtaattatttttagaataatatttaatttcaggaaatatggaagttaaagctttatcctgtgcagaatgatttaaattccagcttaatttccatctactaacataattgtggtgactaattttgataaaagtactttggatttgcctaacacctctgagtgttgaattccaagggcttcagtaaatcctgggtcacaagattgctattttttccacatttcataagactttttggttaatactctaggaaatgatcacaagcaggttctcactctcctgatcaaagacatagttccacctgtgaccaacttgcttcctgactatgtcagtttcctgttgctgccttaacaaataccacaccttagtggcttaaaacaacacaaatttcttctcttagttctggaggtcagaagtctaaaatgggtctcacagggctacaatcaagatgtctacagggcagcattccttctggaggctctaggagagaatcagtttccttgccttttcaatcttctggagaccacccaccttcctgggcttgtggccccttcttccattctaaagccagtcagtagggcatcttcaaatctctcttggtctctggctctcctgcctctcacttataagcagccctgcgatgatggtgggcccacccagatgatccaggatgaccttcctatctcaagacccttaactcaatcacacatgcaaagtcccttctgccacatcaggcagcatttatagatttcagggattaggatgtggacaactgtggagagccatcatttcacttaccatattgactcttaaggctatgactcttaaagtcttttctcctaatctataaacccatcaagaatatttaagttattcttgtaactacacactaccttgttaactcaatcttattataataagctatgtcaggctatagtcaagaatattaccattataatattacctatataaatctggggatgtgaagcatagaaaagaatttttaaatctcaagttttgcatttgtgtacttatatacctaccaatttatagagtttgaaattttatagaatttgaggtttggtagataaggtcgtaaataaagtttgacgatttatatcacatcttcacttaacatatcacttcatatattttaattattaaaatgtgtgttaatgaaatttcaactgtaattaatctcctttctactgaaatggttcaatagatccatgagcctaaacaaatctccctggattttcatcattaatatttttactctttaagaataaagaatttatgaattatgatctacagtttatcccactatttcaaatgacaaaatcttgtcactgctttagctttaaaagtatgtcttcccacttttaaagcactttttctagacagccatacctactttcttcacttaagtagttgacacttatataacactacacacatatagttgtatgtgtcaacacacatgaaagaggaaataacagagaaagtgttaatctgcctatatctttgaatattatcaaagcaatttagaaagctttataactgaaagttaaatatgagaaagaaaaaagacagtttcatatcttacagacgaagttaaatagaacattctctgagcatggtttacatgtgagactttgttctaggtgctgtatgccaacactattcccaaatatatattttttcagtgccttcaaaagaggctgttatgctaccttagataaccccccttctaatctgcatgatgcaattcactgctatctgcatgatattccacttgaagtgcacagtagagcactgtgctttccatcagcaaatatctagagttatgtgggcatgaaatgtctcctccaaggagtcaacagcgacccaggaatcgttctcaactgcacccctgagctggcagccatccagtcgaggttccctagacaggcagtgttgtcactgatgttacaccaaggggcctgtgtttcagatgtttctctttctcaacaagcacatcggtgtgaactcgaaagaatgaaaaatagttccatgtgatattcatccagttgttttgttctgtaagtagcaatggttaagttacaaaccatgaatttaatgccaaactcctgtgctcaggtaggcatgacagtaaactctcaatagcctataaaaaggaagatgaaaggataaaggtaaatccaatttacacaagaatcaatactgtcatcaacaacactaatagggaaggttctatgatttttttaatttcctctttttttttagcataaaaacagaagttaatgggtccctctcagtttgggaaaatctgagtgacaagccaaaaccaataggttttgaaaggggcctgtgaataaaacgcaaaaagtgcctaattggagtcaagaaccaactcactataacaattgtagaatctagatggcaagtgtaggtgttcattatactaatcttttgaacttgcccacatgtttgaaaaaaaatcaaaatcaaaagttggaaataaaaaagtaaaatagaaaaagaaacaattcataagatattgttgaaccccatgggctttgagaaatttgcataaacttgaggcatattcaggctgaccagttagctcctctctccatatacagctccatgccaaaaaaattatataaaatctactatctgagaaaatgggaatccacattgcttcatagctcttctgaatgaacaaaatgcaactggtacagacttaaaatcgttagggaaatttccttttgcagatcatgtcatactgacatgtactagaatagcaattaaaatattctaaacccatccccctctccatgtaactatccttgtcatactctcttgaagtcagagtacaaattgctccagggctaagtgatgacagaaacatctcccaattactcctggttacacagactcaaagatgggaacaatgaagttctaatgcctacacactccttagtgaactcaaatttcctaagacaatgaatgatcaaagtagagtcttatgaaagcttctacataaaagacaggaaatgagacccaaatcaggagagttggggaagctcaggaggagggagatacatatccagccctcatttaagatcaattcatggatgactccctaaaacaccacagaaaatctgacacaatagcaaatgcactgaatgatgcatgccattcactatcacaactgagaactccaaacatttcgttgatattagaaagtgaaacaaatgttcctgcaaaagtcaaatgagaatcaaaagcaccatgtttgcactgcagcctgggtgacagagcaagaccctgcctctaaaaaaaataataattttttttaaaaaatcaccatggtttacagggaaggatactgccgtggctgcacagacctttagtgtctcaaagcattgtgcaaatacctgtgtatttctttcatgcaacatgagcattaacttgcaaattttaaaaccctctgatttatcattccaccacttcacttatttgtaaaaccaactaaaaaagtattaagaatttcaagacggcaacatgagagcatcagatcacatgcaggggctcttctgagctcgggctgttgaatccaggcctgaccatatgaactggcagagtgaaggagagatgtggggtggagtaggtcaaagatgctgcaggctgcccaaatgaaggaatgtgggaggagaaagggagcaaaagggctggaaaataaaggggtgtgaggcacgttcaaaagagcaggaggaggaagagtacctgaaggcggtatgatagaggtggagaggaaagggctagatcaggggtccgcaaacccaaggccacagactggtagcagtcaatggcctgttaggaaccagacagcaggaggtgagcagctggcaagcgagcaagacagcctgtgctctggctcctgtcagatcaactgaggcattagattctcatagtagcacgaaccctactgtgaattgtgcacatgagggatctagattgcacactccttatgagattctaatgcctgatgatctgaggtaggacagtttcatcctaaaaccatccccctgccatccgtggcaaaattgtcttccacaaaatgggtccctggtgccaaaaagttggagactgctgggctagatcatctggatgcagttcaccacccacagtgcctcaaagtcgctccttgttttctctttccctgggatcctctcaccacacgcccaacaaaggtatcactctttcatgcttgaagggccatggtcccctttttatgttttttgaacaaggagacccaaattttcactgcgtgcacactgggctctgcaaattacataagtggttttgcctagaagatttagaagatcaccagtctagatagagaattctagaaaataattcctgaggaaggtcccctttgatggagtaatcttttaaaaatttattctgtttgcagattgtctgttacctcagttaacaaaaacattgactgttaaattaaatgttgacacaaatgatcttgccatgtggaaccataacctccttttcctctgtaagaattccagcaaactaacaaattggaatctgaaagccccaggttggaaatctaggaagatgacagaaaacatcgtccttcagagtagcaattcctgaaacctcctaccctaggtccatgccttagctactctgaaggaaacacgacctttcctcaaagtaaaagagagcaaaatgtaaggaaataattataaaaattgacgcctaaagaacaaaccctgggaatctgctatccagacaccatcaagccatgagtgagtgcataccatgaaaggtttatcagcgcacggacaagggccaagagtagactagtaagcagtaccatagcagtcatgaaataagaccagatcatcatagggaaggcatggagttttcttacaattctttgctcagagctctataaaagcactaaaggggtctacatttttttaaatagtagggctatttatataatctgttaaattatatttatgattggcccccaaaaagtggctttccaggaaccttgagaaatctttttatctccaagaaaaaagagaattgaactttaatacgttttttattatttatttattttgttattatactttaagttctagggaacatgtgcacaacatgcaggtttgatacatagctatacatgtgccatgttggtttcctgcacccatcaactcgtcatttacattaggtatttctcctaatgctatccctcccccaacccccagcccccgacaggtcccagtgtgtgatgttccccgccctgtgtctaagtgttcttattgttcagttcccacctatgagtgagaacatgtggtggttggttttctgtccttgtgatagtttgccgagaatgatggtttccagcttcatctatgtccctgcaaaggacatgaattcatcttttttatggctgcatagtattccatggtgtatgtgtgtcacattttcttaatccagtctatcattgatggacatttgggttggttccaagtctttgctattgtgaatagtgccacaataatgttttttaaaagtgaaatcagtttcctgctctgccccttcccctagcaccttgctcctcatttgcataacaggtagaatgacattggccaactcccctcacagttagggtgaagtggattgactagtataccaccaaaattcacatctacctggaaaacttaagagtgattgaattattttctcaggactgccataacaaattaacacaaatttagtggtttacaacaacagaaatttattcttgcacagttctgggaactagacgtccaaaatcaaggtgtttatgggacaccttctctgaaggctgttgagaagaatccttccttgcctcctcctagcttctggtggtttctgacaattcttcatgttccatgccttgtagctgtctgactccaatttcttcctcctacttcacatggctttcttctccctatggcctcttccgatcttgtaaagacaccagtcattggatttgggacccactctaatccaggatgacctcatgttgactagttatatctgcaaagactgtattcccaaataaagtcacattctgaggttctgggttgatatgaattttggtggggacatttttttaacccagtacagtgaccttatttggaagctggatttttgcatatataattaattaaggatccagatgagctcatattggattaggatgccctaaatccaataactgatatcctaataagaagtggggagggcacagagagaaggccatgtgaagcaggaggaagagacctgagtgatgagaccagaagccaaggaatatcaagattgccaggagccaccagatgctgggaagaggcaaggaaggttcttccccagggtcgatggaaggagcatggtcccactaacccccttgattttggacttctggcctccagaactgtgagggaaaaaatttgttttaagccacctggtttgtgataatttgctgcaacaacattaggaaactaaccaggagaggggaaggtttttagctgaaaatagtctataacacttatagagttttcattgaacacgaacacacacacacacacacacacacacatacacacacaaaactaggaagaaacgcttctgttttaagacaaactccaaacatatggtcaatgctgattaaattaaatgagcatgagtcagaactacttgaattctattgaatctatgcctttagtcagctgtgtggaagaaaacatgtttgcatggactaggattaacctactagatatttcctttatttattcattgctgtatttgtttatttagtggagcggtgtttttaaaaaagaaggctctttacattgtttattcaggaaatctttgctaaagaaacaaccagctctcgacaaacaaacgattcttgaggaaattaagaaatgtaaacagagagatgcaaatgtgatgtgcaatttaaaggatttactcccagcagtgcttaggaatcaggacaggatgagggcccacccagctgagctcatcatcctgcctcagcctccattttccagaaagtctggtcacctcaggagcagtggagacccagaacttctaaaatggcttataaaggaaaccacccacaagcctaaagagaaaagaatgaacttagaaagtaagaaaaagtctccagctgcagtctcctcacagagctttgttctctgagtcctagctctgaaaagcacccaggtgaaatgaaaggccagggtcttggataataaaatatccccttccctaataaaaccaacttatttagcatcactatgtgttttttgtttttcttagagaacagtgttatatcgttagaagcacacaaagtaggacttaaaagaagttatttctggtactgtcagtaataaaatccctctgaatgatatccaatacagagctgtcttttgctgaattctctggtgcggaaaactgtaatgaactttcagtataaggctggaattggtagaaagtgctatgtgtctgtgttggttattctcagctaccctggatctgttctccacccttctctgtgcctgggggtgactgtggatgggccatcgctggctctctggccctctggcttcctgttgagtttctgttggaggcatcagcagatcagaaagtagaaagggaaggaagttagggtagatgaggcacttgtggaccataggaagctcacactggggctgacagtgacaggtgggatggcttgtctcataagcaatatcttgcctccagccctgcccgtcccactgtggcttcaccctctgccctgctgggtcaggccccccagtggtggcaacaaccccctgctgttgccagtctctgggggccttacaaggctttggattctgtccactctgcccagacgcctacagtaaagagcaccttcatcaatagccctaagttaaacccttgggcctgccttggtttccagccagagccatgaccaaaggtaataatgccaacatgtataagtcacttttaaaggtttctatgttatttacaaatcctaaccactcaaaagatgactttaccttacctgcctcctctattccacctttacctgttgaaattctgccttatccttcaagaatcatctttaacatatttttaactgcatatagtttctcaaacatttgggcctctataattttttttaatttgattattttggaccttactgcctggtgtagtggcatgtgcctgtagtccagctacttgggagactgaagcaagagaatcaggcttgagcccaggagttccagttcagcctggggacaacagagtgagaccctgtctcttataaaaacaaataaatacaggcttggcacagtggcttacgcctgtaatcccagcacttggggagggtgagacgggcggatcatgaggtcaggagattgagaccatcctggcgcacatggtgaaaccctgtctctactaaaaatacaaaaattagctgggcgtagtggcacatgcctgtaatcccagctactcgggaggctgaggcaggagaatcacttgaacccaggaagcagaggttgtggtgagctaagattaaaccattgcactccagcctgggcaacaagagtgaaacttcttctcaaaaaaaaaaaaaaaaaaaaaaagagagagagagaaagagagaaaggaaagaaagagaaaaaatagagaagaaagaaagagagagagaaagaaacaaagaaagaaagaaagagaaagagaaagaaagaggaaaagaaaagaaagaagacaaacacaaataaataatacaaaataataatgatattttggactttacttatatttccctcactttgctttattttcatttgtgttaaggtcatatcctccttctctggctaaagtctccttaagatcaatgacagaatggctctaatttctgtatctcctcccagcccagtaagtagttcagtcccagtatacatactcagtaaatgtctgctgttactgccagctacttgttttcaatgatttttccaccatcaaacccagaacatttccataaatatgcatatcaggttttatacattacatacatacatgatatattatatatctacatacacaccctaacctgaaacttttatctaatttttcttcttccatttggcgtatatatatgcacaacaatgaggtttttgccttcagtcaagtggtttctcaaacactttctacattcttacacttgggtgtctctgctaacccagaaagaattcagtgtcttccttgttctcttttcccttttatgagaccccataacgtcactcattagagctatagttagcctccgattggttaactgtcttttgctctccctggctacgataactgcggtgactagctgtgtctatgtctcagctttctcctgggcaggcactttatcttgcctgtgttgtcatttactacttacacaatcataagcaagttacctatcttatccaaaactcacatttcatccctcaactagaaaaacaagggaataacttagccattcaccaattcaattattcattaactacttattgaggactaggcactgtgccgggcacagggaagggagtgaatccaaagcagtccttccctcctgaaaggaacttgcagtccagtgggggatgtggatgaacagaaaagcagctacagtcacatgtgctatgggagacatgggcattagtgcagggcccctggggagcaaacaggaaggcccctaaactggtgggttgatgggtgatatggttggctctgtatccccatccaaatctcactttgaattgtaataattctgatgtgtcatgggagggacctggtgggaggtaattgaatcatggggacgggtctttcccatgctgttcttgtggtagtgaataagtcttatgagatctgatggttttataaatgggagttcccccacataagctttctttcctgctgccatgtaagacatgacttcgctcttcattcgccttccgccatgattgttaggcctccccagccatgtggaactgtgagtccattaaacctctttttctttataaattacccagttttgggtatgtctttatgagcagcatgagactagactaatacaataggaatgggctaggttagacttcccagaagaaggatggctaacccacactctcaattctaagctggggttcgatttaaaaaaacaaaaaaacataaaaacctcaatatttgtttgattttgagaatcattaaaataatgtcagtcacagttgcaacagcagagagatacttttcacaaccaaaattaatacaaatttgcttgaattctgctctatgtaaagagaaattatctgctttggtaagggttactatgaaacttaattcagcttcaagattaaattatcctctgctggagattcacatagagcagcaagatacaggaaaaaaatgaatttaaattataattgtacttaaaaattcaatagatcattgtgatcttacaatatttatttcatgcttaaactaccacattttttcctcacacagaggaacttttaccagcaactccaagctggatagcaaatgtggatagcaaataaggtttctagctcctcagtcctcttacttgactaataaagacaggaacactaatggaaacatttttatttttaataaatttaactattttaatgctataaatatccaacttacaaattttcaaaggttattacatatatgtcatatgcatttgaatgtgttacatactcaatttgtaagccacttaattggaatgtgacatatatcttcctatagaaatgagagttaatagtgcctacattctcaggctagccctcaaaagcctattaaacatctctttgaggaaacactgggcaatggtcaaattcagagctctggttctgatgatgtaaaacgaggttaggccctctgaggcaaagattggaaatgaggtggtagggacagagtcaagcaatgtctctgaggctctcgtgctatacaaaggaaagagctagggctttgaactcaaacagactagggtcatgtcagatttaccagttactagctctgcagtcatcaagaaattatgttctctttgccttcacatagttacctgcagaaggggaatggcttgggagcactgtgaggatgaagtaaaacagcatatgcaatgcacctccgtaaagcctgggaccgagcaggtgctcagtaaataatggctcccttccattcctccattggctttctgcacctgttacctatcttggcctatggaaaaaatgacctctgttgtagggttgaagaattaaataaagtatgtgtatgtctgtgtatatgcgtatgtgtgtggtatgtataaagccagtaagtagtaaatacatggcctagtgaataggaagaactcaataaacagtggtttgttttatttttctactagtagcatacttaacaacctgcttccttttccctggacacagcctgcaaaaattctggcacaccaattctgcagtgtgaatcattgtgtttatcctaacagacgcaaagctattgtttttagctggtaatatgttagcgggttcctattggttccagacctatctgggttaatctggaaaagggagagggaggcttctgtttccgtgagctgatcagcatggcctgaaaaaggacttggttgcagggatgagcataaagagaatgacttgttccccagtgggatcccatgcaccaggcccaagcccagtagggagaagagcagtactgaggctgtggtttcacaaggatatcctgggtatgagcaagcataggagtgaaacacttcctgtgtgtgcacaaaacacacatggctccagctcagtgacacccaagggaccacaccaggagtccatatctagccaaggaagcaatgttcctaaagaggataccagccatggtggcaacaatgaaggaggcaccagtacctggtgtttccaagtgccttggacatcagggaaaggtgggttcaaagaggaaaactatgatttgtgatcacatatgagacactcctgggacttcccaaacaaatgaggaaaggctttgttggagggcagggatgtgatgctgagacctcagtgggatgtaagccagggaaatgtgaattcccttgatgtggttcatgttgcatccataggctggtgaggtctgaaggagggtacatatgggagggtacctccaacaaataagtacagcaaccctaagtcaagcaaatgcagtcattgggcagagctcagtttcaatggcttgatagcagaacagaataaatggttacattatagctgcataataatatagtttccaaatattatgctatcaatattaataagcatgactcttttttaaacaaacacatgctgaacccttattgttcattgccacacagagaacataatgatagcttactagcacttgtcaggatcttgggtggaagacactgcataaatatcaatatagttagttgaagtgttattgttttccattctgcactggcattttatatggaacataatgaagtttttatctctaatcctcatatcaaacgatcggcacctacttggggtattgtctagaataattatattctgattagtttacagtagttgctctaaaaacatttcttatggatgcttttcatagtcaataattacttttgtgatgtctttcttccaatacatcccaacatgtactgttaagatttaagtggtttcacactaagataatataaaccaatgttgtgaatatatctcagctttctctcagagaatagctgtgactttcctccctatttgatcataacgctaccattcctgatcattcagtatgaatgtttagctcaatagataattgctgttttctggctaacatttgagtaggttggcttaaagatgtttggaacaaagcattctgggataagcaaaggatcaaagtccaagcttgactggaataaggagggcagacagggagcctagaagggtatggctgcagttacagggaattgtaagttagaagggaacaagaaagagaggcacagagatggagggcatatcacaagtctcctaagtgatcaattagaaagcaagcggatggatgaatagcctctataagtctaatttttcttattgcaaaatataaaagttatagatataaaaggcttgggtgtggaaaattaaggaaagaaattttgaactggggagtctcataaaatcttgcagaagcacagaaaacattagtaaaaaacaaatagcttgaattccaacataaacaaaagattaaatacagtaaaaaatgaatgaaacaaaatcagaaggcctaagctctgctaaaacttatcctcactttgtgatattgacacgtcttttaatctttctcagtttcttcctcatcagtaaaaagaaaatgatgaactaaagtgatcccttaacaacaacaaaagtttttataactggcgatatgcaatagccctgggttttccctttttcggcagtatgtgctttaaaaagcaaacaacccatatgtcttcccaatttccctgtgtagaagatagaataaataacctccaatgaagggcaactagaaagtggaaattccatgttgctactgaatcagtgttggagtctaatatataagtcccattttcctgtatttcctgagagtcaccaaagcagtagcaagtgcaccaagcccaaggagagctgcatacagaggcaaagcaacaatcacaatgtgtggtagaaagggtcaccaattccctgatatgctatatctaattttattttatggtcttgagtaagcccccaaatttccttatgtcttagttttctcacctggatgtgtaattcatattctcaaaactacctttttgtaaaaagataccaaaacttttttaaatactaaaaattgaggcatttcaaaataaaaagtaccaattttaagaggtcatgtgcttcatgggaatagcattgaacttggaataagaaataaaactgggtttaaaagtaggtttgctatctatgagccggatgaccctatgacctctcagttttcttatttgataagtgcaagattttaaatatgccctgcccaccccaagattgccaaatttaagtgagattatagaaggcatggctttccttgaactatatatagcaggctatgcaaagtgagttcttcgtagcctcaccataatcataattgcaaggaacctaattactttccactctccctcagtcattaagtttcacaggcccaaaaactgtgaatcaggaaccttcacaagttccccggaaggtgaaaaaaatatctgcaaaagaagtgaatccagcccaagtttcataaccttaggcaaatccaggaagagtgacggcacaattacaaagagtaactgcatagaatatctgttcagttaccactcttacctggcttgtaaaacaacagcagaaggtgttaacaaatgcttgtttaccaataagtccatactgcagcaaaattcctggccctactgaaaatgtagtaaaagcctttctacaacaacttgggtccttaaccatggaacaaaaaaaacccatgtggtcaggactgaccatgataatactaattagaaatgttttcagtcttgtataccaaacaggtctgtcctggagacaagcatctttgctagtttcataaaaatgtttgtttccagatgctattttggacatttcttctcttccatatttttattcagaaaggcagttttttgtttcccctgagtacttcctgtattccctttaactataggtgtagctactgcccaaagggttcctaaaattacagtgagaagagaagaggaagggagagagccactgcagcccctcttggtcagaggtctattttgtgaactgcttgatggacaagagagtccattacgcaatttttgttttgaagacccaaaacacaaacttgcacgcctacctgcaatgattcatcctccaccaaacctgctatgcccagaagccctgttttacagcagagaatatttcttcaacatttttccaactctacatctaaatccatttaacactaaaccatttttaaaattatgtttaaaattacaacataattatcatattatgttcctatttttgcatcaagttttttattgttgtgctttgtttgttttagtctcattgcctctagattttggctttggcaaaatttattgaattgctagttcctcgtgggcaagaatagattttctactcaactttgaaattccccaaagaacctagaagagttttacagctacacagagtgaatgctgctgagagctgacgggccaactggtctcctagcaaagggcaccaaatcttaggtccaaaacaaacaaaaagcatcaattctgaacttttatcaccattcaggccaaaaaaatgcctttgtatttgttgatggtttctggctggcccacattccctccatctacttgaagttcaggctgcctatttagagagtagaacgacccttggcaatgggtgcaggagccaaaaagcataggtttcttgggcagcctgcattactccgagagggacatctgtttagcaggaagcttccactctgtgccagccttcagaaccatctgtctctttacgcttccggacacacacacacacacacacacacacacacacacacacacttccatgcattcactgggtgtaaaaaccaagttgagagagagagaagctggcaacataggtctcccttgcaacagagcttggaggggcacacgaggaagaaacatcgtgattactctatggactttgcatccctggatggagcaaagttttcccaccccgcccatacccctccagcccagccccaagctagaacagtaacttacaggcctgaaagacttaataaagatcacccacaatgatcttcaaaactaaatttcaaggcagcagctctgatataaagtctttacacactcagaaaaatgcctctcttaaaactgctttcataagaggaaactagagaggcaaaagggaaagtgtcttttggatgggtgacctattaattacaaggattggttggtctgatgaggcgattatagaataaagtcagtgagactaaggtcacacaagacagacacatggaagccatgggctgggagcctcaaggggcttgtcctactaatgtctgtgtgtgtgcacatgtaagtgtctgtacacacctgtgaatggaaggacaggacatagaaactattgcttaaatggatccaacatctctctgctgctgcacattgtaaaactgacatccaacatgaaaaatctgtttaactgtttgaaaaatgttatagtgattttataatttataccttattttaagaaatatttgaaaactcaagaagtagtttaaaaaagagaaaagacagcaataagaaattctaaaaagaaagagggaggtgatagtaccagatatcagagatgagaattactgcaattgagcactcaatctggctctgcagtcaagcaaaaagagaataatgagaagtgacatagtcctcaccatcaaagaaaaaggaacattatcagtgcacagaaagataggtctctctggactgaattttaggaaaaatttattgcatagaaatatacagatagactaataggtgggcaaatattgacaaaacattaaataacaacaaacagtgcttcatgaagcaagttagtacagaagttttggatatgggctttttagtagacaggactgggttcagattaggaactacaacattggacaaattacttaagcacctcaagcttttaatttcttacctctaaaatggaggtgatggtacacacctctcaaggttatcatgaggattaaatgagatggcacaggtaaaggatcttacacagtatctggctagtagatgcttaagaaatgttggttccactcccatccctcacccccactcacaatggttggattcaggtctttttgtggacagaacaaaaatcagagccctaatgcccttgaagcatttccacagaaagcgtagatactacaatggtctgaataaattgccagttagaggcaacaatagagcttggagaacctggggggatggtagctggcctgtctcttatactgacaatggtgtcaacacaatgagggagttgctgaaggggtgtcaagactcagctatctggtaagtacctaaaaggtagatgctgtctgttgctcatcaaagataacttgatatttgagacacccattgtcaagcagtgggattaccattatttgagtgtttcacccagatagtggaccatcccacctacacagagagggttggctgaaggcatgattgtagataaagccatttctttgtctcaaagaaaacgtacatgtgaccctctcaaatgcttagacaacgatgaattgggattccaaaactctgcatcatagagcacgggagcataatttgaacttggaatatatgagaataaatgtcccttactttaaaaactaccaaaaagtaaaatgcctctatgtggctgttagaaacatcttatttttattttattttattttatttttatttatttatttatttatttttttgagacggagtctcactctgttgcccaggctggaatgcagtggcgcaatcttggctcactgcaatctctgcctcctgtgttcacaccattctcctgtctcagcctcccgagtagctgggactacaggtgcctgccactatgcccagctaattttttgtatttttagtagagacagggtttcaccatgttagccaggatggtctcgatctcctgacctcgtgattctcccgccttggcctcccaaagtgctgggattacaagtgtgagccaccacacccagccagaaacgtcttatttttaatagcattgtcaccagatggaaaaatgaatgcatgcattattggatgcattagtaaatacataccaatcttttaccatatgtatgactctatggtaggcctctgtgcatttattatgtcaattaattcctgcaaaggaaaccaaaggtaatataccgaatgatcattgtcaactatacttgtacacatctaggtacaactataagtttatattagtgatccataaaagaactgttaaactaaataatccttcataatcaggtatatggtctataacacagttaaagggacagaagcagaaaatgaccattagaagaaaaattatggtaatttagtcatcatatacatcatgatttgaacataactaacaatttcattaacacaaaaattctaatactaaaagttctttagctaaataattaaccaaaatttatttccacagccaaatcccagcccctggcaagttttataatatctgcacattttctcaaatgatgaaagcaaatcaacagcattaagccaaatcaacagtttaattacagctactctctatgcaaaatccactgcaaccaagcaggtcacagctgaggttgctgtgtcacctcctaaagactgggctgccagaaaaacctcagatcatttgcaagtactgaaacatgaaggaaatttggggctcagtaacagaagaactgatatacttggaacattttcagaaactctttcctatgccgacccttactcatcttcctgaagacacaaccactcattcattcagtacttctggcttgctcactgtgtaccgggcactgtgctaggcatgtggggaggggacagttgggggcagagtcatatcagacacaggcacagcccctctagaactcacagacattctcagacctaagcataaattcagggcacagtcctatggaagtaaagggcttagaatcaaaatgcagatacattaatatgcaaatgtgcttttcataagaacatatcacaggttgcacacgctcaaattacacttgggaaaatgatccaacataactgacacacactattacaactccgttcaaacacctatcccagggtcccacagccagggtaagggcaggggaactgtgcaaaaccatgctcagtagagcccaacagagcctggaaaaagcaccaggaatctgcaagacccagctctctgaccctgaagccacttcacactcagcttcaagataagcctcatatgacattgataaattattaaatctgttgattgcatggcagatcaggagccatagagtaaaaggcactctacatggatataaaaacacctttaggcaagagacagatgaactcaaggtgagatatcaacattaacacaccacatgtttttacactttaccatatacaatttcaaaacatttacaatgagacatgccttaaagttttggtaattaaggaaccctcacacacagagcagtcatgagagagattaatcattcagcaattatttactgagttcaacagctgagcatggctgttgctgggggagaaaaggagaccccaggagtggtgggaagaacaggcacaagtgctcctaatacagatttccatgcagaggcagggagttagggggagagttgagagaatcagattacaaaaacagttctgccactacctatggcacaaatttggcaagctgctcagcccctctgagctcccatgttctcatctgtgaaaagggagatacccacacctacctcacggtcactgtgaggattaaatgacagcagttatggtgacgtccggcagtataactagactgtactaatgtaaactgggcttcaccgctcaggaaaggggggagcctttctgtgcctcagatttcctcatctgtaaaatggtgataacagtctcttaaaaggtggggtaaggattaaatgagtaaattcatgcaacgagctcagaatggttggtggcatctggcgcatagtgagaactcaagacaagtaggctcctatcactgctatattcctgatgctataagagggaaacaagatggttgggggaaggtttggaaagaagaacaggatttcaccaggaaaggctggtggggtagaaggcataggcgtggagcaaagggagaaatcacagaagaggcaggagagtggtatgggagacctgagcccatgatggcagccacacccctcattatctgtttctgcttcactcagttcctgagctactcacaaacatcgcagaaccctctcaccagctcaaacacagccagaggagtggaaatcggagctttcatcatggggcaggtgcccaagatgagccctggacacgctcatgtcccatgggactcttcatatccccagccttgcccattaccacctccagcctccattctctgccggggatgtctggtaccctggaaccagagcccttttctgatgccatttagttcaagctccaatacagcccccacaccatttcatatggaatatatttacttttttgaatatatttttgcttttacagaatattttcacaggacataattttttaaactcatccctgaaaaggactactatttgctatcaaaaataaaaaggtcgagattgatctctccacgtttgtatacatgtgcctgtgtgtgtatacgtgtgtgtgtgtgtgtgtgtgtgtatgtatggggagggtggagacagcaaaaacaccaagtgaaaaaacaaggcatagaattgtacataatacaatcacactctgtaaaagaatggataggcatatatgccagcatgtgaataagcattcttaaagaatacagaagaaaatgtttatggtgatttttctttggagaataggactgagaaatctacagtggaaaaaataccaacttttcacttactgcacttttgtatgccttaagtttttactatgcatgtatactattttaaaagctgttttttaagtgagttttaaaaataaacaaaagatcccatatcaggagttgattctgatgcctaaataaaagtacgtatttctgatacatagcaagctactgataagtggcagctgcctatggctcctgttattatttgtattattatcatgtattacggttatttatgtgcatgagatcttccctgtgaggctgtgagctccatgagcacaactcccatcagggctggccctggagtaacagcgtacacaccagctcccataaaggagttcatcactgcagacttactaaaccaacacccacaggaatgaatgacctgaccagcgaccccatcattgagggagtaaatgcatccttatctccattttgcagatgacgaaaaaggtgtcatgtaaaaaagtaaaaaaaaaattaggggaggagctcaatcaaaatcaaaatcccaaggctccaaggcagaacttcccatcagcaagcattaaaacacaataggtctggctgggcacacctgtaatcccagcactttgggaggccaaggcaggtggattgcttgaggtcaggagtttgagaccagtctggccaacacagcaaaaccccacctctactaaaatacaaaaattagctgagcgttgtggcaggttcctgtaatcccagctactcaggaagctgaggcaggagaatcacttgaacccaggaggtggaggttgcagtgagctgagatcgtgccactacactccagcctgggtgacagagcaagactctgtctcaaaacaacaaaaaaccgcaatagatctgacttagtgctgaagactaagagagaccccagtaaaaactgcagtgggaactactaagatgtgagctttctaaaacaggtcaacaacactatttcattgtacacatatgtatgtaagtttctcccctgacactaatgaagtcaccctagaggcacacacacatgttcatggattacaaacatgaagcgagtaaaaaaaagaaacacattcataaatatctacagggagcacacgcaggagagtcctgctacccagccaaagcaggaggcaccatggagctggcgggctgatggctgacaagatatcacctagttgaaggtagtctcctccacatgaccttgggcaagttattgatcctctttgagcctcagtttcctcatctgtgaaaatggggtgatccaggtacctgtgatccacagagtccacttcggggattaaatgagagtataggtgaaaaagtaattagaacagcgcctgacataaaaagcacttaacaaatgttagttgtgtggtttttgtttccagtattattaaacaaaaaccatagccagagaataaacacaacacacacacaccacccccatcccaataagaattatgtgccacctcttatgaaattttgcacagatttctatcatactatttataatatatattaaaatcactggtgtacagatctgtccctcttcctttgaactgggtatttcctgaaaccaaaacaggttcttagtacctggaaagtgctcatatgtgtttgtttaaaatgtcaacatggaatgaaaaagtttaaatcatttggactaacagagtgataactacaagcaatattctgaaaattgaaattcagtttctttttcttgatatccttttagatagttcaccacaaaagtagtatctataaataaagctaacttatgctctgaggtctactaatatactaaaccatcagcactatagcttctcttgatggtcattcaatttcatttctgcaaagtttaagcctgcacatttgagtaaatgaattcaattcatcaaggagcccagcctacgacagagctactcagagatccaatcaacagcttctctctggaataaggaaatgtagactccctttaatgagttcacttgctggaatcagttctttttctcacagattagggcaatggagcacccataaaggaattgacaagggaaactctagctcatttccaggaactatgatagaattctgtgagtgaagtaactactacttcaatatctctgcgaatagatggtgagattgtgagctccaagagtgcattaatcacaaaccttattctgtttctgtatagtgcaatcacatttgtcctcagatgcaactgtgtggttcaagataaaacactgtatagtacaatgcttattgtctttaaatataagttccatccatcatggaagccagactcattcctcacctaaagccagtaatatgtcttttggataaagtacaaacttagggagttaattacttcattacattgcatggcccatccattataacaacatagctatgactggattcagctatggtagtcattcaatccaacctcatttacaaaacacagtttgtacctactgcctctacagagactgtagaaaaatggttttagaagccattcattcatgttctaggaactgtgtaatgagtgcctaccatatgtcacacactgtttcagatgctgtggctactgaaggaaagaagatagaaaaacatttttactcttatggggtttaatactcatatggagttagtgagagtagacaaaaaacaaataaacaactaatttcagataacaatgttttattaagaagagtgaggaagacctttctaacaaggtgaaatgtgaatgatgagaaaggggcatctgtgaagacttcccactgtatggaatgtaacgtggctgctctgtacgtgttcatgtggagctctgtggaagccatattgatcagtttgccacaaagccacagccaagacaggtaatgaggactcgaactcagttcctggcacccaaatccctgcatcccaagatcactagaaagatcttgtcagacttttgggtgcagtttagatacctggggaaaacctctgttgttttactgcctatgaacacaaaatggcccccaaaaaacctgaaaaaaaaaccaatataacaaattagactatttggacctctcgtgatcttattaaaaataatatcacttctctaaattttacctgaggaggagtgagctacaaaggcctggaaaaggtaaccaaggggtccatagatggagtggactcttactgcatacaggccacctggcgtccactcctcctttcctctggcagtagaatactcttcaggaactgttaagggataagcatctgtcccaagctccgctagtccaagtgagtcctgggggttgtgcaagagttactagagactttttttcctgctggatttgaacctggggtcttgtgaggcctagctgcaacagataagcctggcagagagcagagcctctttagagcagggatgtaggaagatggagtaagacacctggtctctatgccttcatctgagctcccagatcaacccaaacctaaatccaatatgctctcagattctccaattcctttgttaataaattgtgcttttatttcttataataatttaagatggattttctatcacataccacagaaatagttcaagtacacatattaggtacattttccttaatactaaattattgagaacagaatacactttttaacatatttgaagagccacttgtgaagaaatctagattgttagagaaaactgaggtctcttctgatttccatgaggtaatttatttgatacatattatgtgttcatattggtgctagctcctatggaggatgaaatggataaaacattgcctccttggactcaaagtgcatatcctacaacctagcaccgtcaccaatgttttactgatccatagcactttattggttatagagcacctttaaaacattgaacttcaggtccgtagaattagactgaattgatcaaaacccctggccatgaactctcatcattactccatgaatggcccctttttatcaagtgcccactcacatcatctcatttcacattcacaactggataaaaatattgagattctggccgggtgcggtggttcatgccagtaatcccagcattttgggaggccgaggcaggcagatcatgatgtcaggagatcgagaccatcctggctaacacggtgaaatcctgtctctactaaaaatacaaaaaattagctgggtgttgtggtgggtgcctgtagtcccagctactcaggaggctgaggcaggagaatggtgtgaacccaggaggcggagcttgcagtgagccgagatcgcaccactgcactccagcctgggcgacagagcgagactccatttcaaaaaaaaaaaaaaaaaaaaaaaaaagaattgtgatctgagaaatcacacaaacctcaccagatccagaattttaactgtgtaaaagaaggggtgtatgagtgtatattagtataaaagaaggggttcctccaatcacactagaaggaaccacacccaaatggctggtgtgtttgaagagtagaactagaatagacacttcaacactaagcatacatccacagtcctgggggttgtttctggtctactgctaatttggcatttttggatgtgcgcattttaaacaggttttgtacagattcagaatctgcatttgctaccttttttttctgcacgtactgttacttacagacacacttacatgttcaagccagacttaaatcaaatttttccagtactataaaagatatcttaaagtattcatgaaaaatatttttttcaagagtcacttctttaaaatgtcattattgcctttctttaggggccttttctttttgcagatcaataataagtctattgttcctttcttggttccattagttctgactgaaaagtcaaacaggtaagaaaagacacaggagttttatttgtttaatctggaaataaaatcacctaaaataaataccgttgaaattttttcaggtaattgatttctacttctttgcctgaaacagctctcctcttgtttttttggcatgttaatttggtggagtagtttcactttataggaacaatgctctccaaaagaattaatgttctctggcattggctgatcaatttgaaaaaaaattgtcttatttatcttaaaatagaaaatcctcccccacactatacaatacaggggtagaggatataagatgtctttttacaggaacgaaatgtttctacagtggtgaatgttcacaggggaaataagccatggtttgggtgtcagatccttcagacaccaccagtagaactgggtcagaggccctgtgtccaaggagggctccattgccaggcccatcacttacagctggtactagcagtacaagatgcagtgatgccatttcccttagaaggataagagctcaatgttggaatgtttttcttctactcataggcacagcaggaaacaaaaccgtgatgaaattccataaacaggcaagctgggtatggaagaaacgtggttgatgctggcaaagagctgcacttatggccaacaaaggtgaaaaacagagagaaattgtggcccatgaagccaccaaagacagtaaaaaagaagagtgccatgatgcaaagtgctccatctatggagtcacccaaggcaggtctaaatcttggctctgccaccctccagctacagtgctcttaagcaagacaaaagtaccaaaagcccagcatctggcatatcaatacttcagtggtagaggactccctacctcccccgttacattcactttctgtgatgctctttggtgtaatcatagtcctatgtcttccaagatttatcttaatttttatgacatttaagtacatgcaccatgactaaataagtgagtatgaaatttggaattccatcagcaacctattttttatcaaattagtttaactaactctattaggacccaaatagatcttaaagacaaatttatctggctgtgtcagagtccattgcttgccattttctgttcagtaccactgtctgtacataggccatgtgtcctaaaaaataagctggaccctcaaaaatgtcgcactaactcttttcccccaaagagccacctcagcacgtctaccacactggcctcctagctctactttttttctagcaaagcttcagcccactgacttttaagatattgtaaatcagatcagttttacaatcctgctcttgtggctgggatcaggaatatgagcaaaggaggccacgagaaggaatcacatgtgtaaaaggtggcttgaattattattttttaaaatatcatggaggcttattatgagacaaatcatcaagatagctgacaatagatataatgttcagccacttcaggtctttgccttttctgtccacactatatttatttgcacacaaataccaccaatgccactaccactgtcactagtcccaattagccttattgttctccatagcattgagcacaactagtcattccacgtattttacctttttattttctttatcttatgcctcattctaccagcatggaaactcaaataaatcattgatttgtttatttttcatttgtgcaccctcaatacctaaaacagtacgtggcacagggcagggattcaaaaagtgtttgttgactgaatggtcagatctattattttttgagacattctctctagaaagactatcatggggagtagaagctaatataataggaattttagaacaaagcatttcagagaacttttaagataagtggtaaaaatgtttatctacaaacaaaatatccagatatcaattcaagcatggtttttggtattgttttccaccattccttcaatgaatacttacagcaaaaactcctatacagctgtcttctataaccctgtggctattcagacccaatctacccatgagctacatgccagatataaaagcagctatggatgatctagtggcatttgcatcaagccccatgccactacctcactggcttagcttccaaaccactggtattttattccatgtccacctagtttctgcctcttgactgcctcccattttcatcacagcttgcatcctctgaatttgttgacttgatgctacttctaggcttgaccttcactgttcatcaaggtttctaggttaggcacgttccattaaggatcctttccacacatgtcttccttgggtagacaaaggaactcgaggtccagtctctgatgaactacactcgagtacaagtgcacctgccaggtccaccttggtccctactactgggttcagggatttaaaccacaacactatttcataggtcaccaacttgaagacacatgaaaatctggttcaaattaaccatgaactgaaggacacctccagtcaatatgtcacacataaaaatcctataggctagtgatttccagcctgggctgcaagaacatctggggaacctcagcgattattgcaaaggagtttgtgaattcatacgcacatctgcactgttagtgaactgaaaaaaaaagacatgactatataacaacatatgctttgccatgtttcagcatcaaatagatgctaccatgttttatcaaatacaagcatattgaaatgtattgattaagttacaaaagtttgtttaccttacgtgtaaatcaatagatattaaaggtccaaatgaagggttcaaaaatattttgatatcataagacaaaaaaaaggctatagattcctccaagttagataatgatgactagactcttaaccaagatacagaataatgcaagattatgggggaaaatatggcagattctgcccaaaatgaagaatcagtgactagatttatcctcccataagaaacaatctaaaaacatacaaatacataaaacaatggctttcaaaacactggacatcaggccacaaggaacaggcaatgaaggtttgcattggagatatgcgaaacaaagacagggagccctgtggttgccatagcttactgccttgggaaggtttccagggctcagtccaacacaagtaacccaggtggagcccagtgaactctctgagtcaggagatggagttggggttccaggaagaccaaggaagttagaattcacaggacagcataccagagaaaaaaagagctacataaagagagctaaatagagagatctgcaaagaatcccacttgagtatccagctaagtaaggatgaacgcatgcatatgagaaagacatggctgcttttgtactacaacatctgagtgagtagttataatggagaccctgtggtcctcaagccaaaaatttactaccttgtacttttcagagaaaaggtgccaacctgatcaacatcatacttaaaggtaaaagactgaatgctttccttataagatcagcaatgagacaaggatgtctcctcttactgctaatattcaacattattatgaaggttgcatccagtgcattaaggcaatgaaaagaaagaaaacgtatgcagactggaaaagaagaagtaaaactgtctttatttacaaacaacatgacattttatgtagaaaacctcatggaatctgccaaaaagctattagaactgatcaatcagtttaataagcctttaggatatgagatcattatataaaactcaactatatttctggatactataaatgaacaatcagaagttgaaatttaaaaataccatctatagtcatataaaaaatctgaaatgctaataaatctaacaagagattgtcaagacctgtataatgaaaactacaaaacatcgctgaaactaaacaacatctaaaataatgttgagatacacctatgtttataggtcagaagacgtgatattgttaagatattatctcctcaaatctatctatgattcagtacaatccagctataacaactgacaaactgattctaaaattcatatggaaatgccaaaggcctaaaatagccaaatcaatttttaaaaagaacaaaggggaactaaaacaatctgatatgaagtcttattataaagctaaagtaaagaaggcagattggtattagcatcaagatagacaaataggtcaatggagcagaatagagggtcttgaaacatacacacatgaatagaaaactaatttttaacagaggtaaaatagcaattcaatggagaaagataatcttttcaacaaatgaggctgaaactaccggatttccatgtgtaaatttccatattgagtttcaaaccatacttgccaccacataaaaaaatcaactcaaaatgaatcatagacctaaatggaaatcctaaaactataaaagttccaaaagaaaatgtaggagaaaatctctgtgacactacattagtgtgcaatgtctgccatagaaaagtatcacaaaccaggtcactataaaatcagaaatttattgtcttacaattatggaggctagaagtccaaaatcaaggtgtcagcaaggttagttccttctgagggcagtgaaggaaggacgtgttccaggcctctctccttggcttggagatggctctcttttccctgggtcttcacatcagtcttccctctgcacttgtgtctaaattcctcctttttataaggacaccagtcatattggattagagcccatcataatgacttcattttaatttggttacctctgtaaagactccatcttcaaataaggttacattctgcagaacaaggggttaggatgccaacatcttttttaggtggacacaattaacccataacagacatcaaaagcacaatccatacaaaaaaagaaactaataagctggactttattaaaattaagaatgttatactcttcaaaagacagggttaagaaaataagaaacaagccacagaccacaagaaaatattttcaaatcacaaatctgataaaggacttgtatctgaaatatacaaagacttaaaattcagttttaaataaattaacaattttttttttttttgagaagaagtctcgctctgttgcccaggctggagtgcagtggtgcaatctcagttcactgcaagttccacctcccgggttcacgccattctcctgcctcagcctcccaagtagctgggactacaggtgcccaccactatgcctggctaattttttgtatttttagtagagacagggttttgccgtgttagccaggatggtctcgatctcctgacctcgtgatccacccacctcagcctcccaaagtgctgggattacaggcatgagccaccacacccagccaaattaacaaattttaaatgagcaaaggatttaaacagatatttgaccaaagaagataaaaaggtaataagtaagcacatggaaataccctcaacatcattagatgttgcagaaatacaattattaagtcacaatgagaaacttttctctattagaatggctaaaattaaaaaggctgattgtgccaagtgttgacaaggatatggagcgactagaactctcatatcctgctgatgggaatgtaaaatggtacaactttggaaaaaagtttgacagtttcttaaaccattaaacatgcagctactatatgatgtagccattccacttttaggtatctcttctagagaagagaaagcctatatccatacaaaatcttgcatatgaatgttcttagcaactatattcataacagccccaaactgaaaacaacccaaatgccagccaacagtgaataaattagaatattgtgatatataagccatataatgaactagtattccacaatataaggaatgaaccattgatatatgcaacaacatggatgactgtcaaagtagtcaaactaagtgaaagaagtaagctgcaaaagagcacactatatgaatgttaatttcacataactataaagaaatacctgaggctaggtaattcctaaagaaaagaggtttagctggctcatggttctgcaggctgtacaggaagcatgacaccaacactggcttggcctctagtgagggcctctagtgaggaagtttacaatcatggcagaaggtgaaggaagaagtcattgtatcacgtggtggcaagagtgggagccagagtcaggggtggagataccagactgttttaaacaacccaatcatatgtgaactcactgagtgagaactcactcatcaccaagtggatgtaggaactaggccattcatgagggatccaccctcatgacccaaccacctcccaccaggccccacctccaacactagggattacatttcaacatgagatttggaagggacaaacatccaaacccatatcagaatctgtgtatgtaaaattctagaaaatgcaaaataattgacagtgctggaaagcagataattcgttgcctggggataggcatatgggggagagggaggcattaaaaagggtcatgaggaaaattttggaagtgatggatatgatctttatcctgaatatagtgattgctttggtgtatgcatatgtcaaaacttattatacactttaaatatgtgctatttattgtatatgtaatcaataaagctgattttaaaatatgcattccacagtcaaatgacctactatttcaagtcctggctctacctctaactttgttatcttaagcaagttatctttgagcctctcattttccagctgtaaaatgatcattcataacatacatttcacaggattattgtggatatcaactgataactaattcaatccctgaaaataaaagataatcaactgtagctattaatcataacaacaataaagtcccttgttcttagtttctaatgtcctgtaaaagcaaatttgaaagccaagatgtacaactcatatttttagaacctgaaaagctgagtcttccccactttctcattcagtgtttcagatagtgttaatatacacgagctctgataaggtaaagagtgcactggaagaaactcaaaagtaagttttttaattatctaaaatcaaattttcaaatatgagtcatgatctcccctactagaaacacaaacagtttagacaataatgaagtaccagcaaaataacactccttatgcacgtgtgtttgaaatgcttgttccctggtgccataaagaaatagtacttgaacataaattttctcagcaaggccatttttactttctgcagaaaggtacacttgccagcagttttgccacaagaatacactgaagaaaggagacagggttatttataacttgacacatccaccctactgctgtgtctggtttccattggctggaatgggacctcacattctgtatttgtcctgattggctagcaacttagaactttttaaaagaggcaaaggcagaggagaataaaggaaggacgaagtaacttgtggaatgctgagaaaggtaaaaacatctccaaataaggaaaggaacaggctatgacctaatgcttgcttggactggtataagcacgccagggcaaatattttggctaaattgtgggagctaaggacacaaagtacattgatttatttattgtggctagcagatacctaagaatgttagcacaggtctttgaatacattttgcttctaagagaagttattatttattcttaattagatgggaggaaagtctctttgaagaggaacctctactttactttttacatgtgggccttcctcagctgcagttggtaaaactgcatttccagttttaaaaaatacacacacctctcaaaagaatttcaacttaaagctcttttacatatgtgctgcttagcttagaccctcaagaaagaagacaaagaaagccctaatgagttatccctgtcccatagaccacgtgggtggccctgtggggttatgcaaagagactggtcgggatagcaccttcacaatatgtagctgaaagaccagacccagaaaaaagtgcaatgcactgcaataattggtaaacaggcaagacacacaagtattttcctgagactctggaaaacgaaataaggaaaactcacatgccaaaggtattaaatgtcaagtcagtaagaagatagtctgaaaacatttaaaagctataacgtcaaaaaaaaaaattctggtacaatgtgattcaaaagatcaccctatcacagcagtagtttctgaaaaagtaacattgttttaacgcccacaaatctagtttgtgtagaagcatacactctcaagaacttttatttactgtgtcttgaagaaatatatgtctttttttttatttattttaagttctgggatacatgtgcagaacatgcaggtttgttacacaggtatacatgtgccatggtggtttgccgcacctatcaacctgtcatctaggttttcagccccgcatgcattaggggctctccctccccttgccctccaccttccgacaggccccagtatgtgttgttcccctccctgtgtccatgtgttctcattgttcaactcccacttatgagtgagaacatgcagtgtttggttttctgttcctgtgtcagttggctgagaatgatggcttccagtttcatccatgtctttttaacgctaattggataatgtgtgatttttctaaccaatggtgctacaaaagtccctatgatctcatacacattaagtcatttgtatgtgatatggttaggctttgtgcccccacccaaatctcatcttgatttataatcccattatccccataatcttcacgtgtcaagggagagaccaggtggaggtaattgaatcatgggggcagtttcccccatgctgttctcatgttctcagttctcacaagatctgatggtttcacaaagggctcttcccactttgtttggcacttctccttcctgctgccctgccttcctgccttgccctccttcctgccttacttccctgtcaccttccaccatgattgtaagtttcctgaagcctctccagtcatgctgaactgtcagtcaattaaacctcttccctttataaattacccagtctcaggaagttctttacagcagtatgaaaatggactaatatatcatgtattcatgctaggagcaaattcaaatgagtttaaaaaaaaaaaaccacagggaggaaaatattgctgaaaaccatacaactgggaggagacactaattctccaccccaggtggcctcactactgacattgttaacgccaaatggttaagctgatgctttatttccctgtcagttaagggactacaagtaatcaatgtttaagataaaacatgcagcggaaataaaaaggacaatttatatgattcctcatatttctgcctgccccccaccccacccaccaccaacgtctagctcatggaagacaagagctagaaacaattttttgacctttgattttcaaacacaaagatgccataaagaaaaagatgtatattttttgctgataaattttgccacttggaaatttaaatcttctatacatcaaaaaattcccaaaaattttaaagaaaaatgacaaactagaggaaaacaccaaaaaaaagatacatggttaatattttagtatacaaggagctttttcatggaaatatgggtaaaaatatgaataggtaattcacacaagaaagattataataatcattgatacatgttcaatctcactgagaatcaatgagattcacactaaagtgataagaggcaggactagactccagaggcagggctcagacactggaccaaattgaggactagctaaaatagggacaaggcggaaacggctttccataagacacccatcagtatgccatgtcagtttactattgttatggcaacacccagaagttaccaccctttctctaggaatttctgcagactgctccttaatttgtatatagttaaaggtgggaataaatatgactacagaactgtcctgagctgctacttctcagcatactccctatggggtagccctgctctgcaggagaagtcacggagccataacactgctggacctataacactgccagacctataacactgccgctttaataaagctgttttctttattagagaaggaaagaattcaaaggctcacccttgaattttttccttggcaaagccaagaaccttcccagctaagccccagtgggagcttgcctaccctgaatcagtatcagagtaacctatcaattataaaacattaattgtaaataagtagaaacttcctagagaacaatttttcaaaatgcattaaaaactttaaatgtttttccatactctttacatttcttctagaggaattttttcttatcttaaagaaaacaatggaaagaatataaatagaagtatgtgcaaagatacatacatcagaacattgtttataaatgaaaaactcagaagcaacctgactgcccaataacagtggaatggttaaatcagtaatggtgcagacatgaggtagaatattatgtagccattaagaataatgctttagatatagaaggaaggaaagttagtaatgatacatcaataaagtgaataaaatcaagaatgtatatgtagtctaatcccattattataacattttttgtacagaacaaagtttggaaagctatacatgaaaattttgacaatacttctctggataacagaatttgggctgttttaaaattttcctcctcctataaacaagacacagtcaggcacagcatgatgtctaaaaacagagattctatagtcaggttgcctgagttcgaagcctgcgtccaacatttactacctgtatgacctttgccaagttaatctttccatgcctcttcatccttaagagaaaaatgaggataatagcagtacttatttcatagttactgggaatgctaaatggagatcttctagaatggtgcctaacacctaactgagactcaataaagctaatcattatttgttaacctgtgttactcatatggcaaacaataattatgagaataattatgacaaaaatgccttgacattgacaagagtgccaagataattcaatgagaaaataatggtcttttcaagaaatggtactggctgggacaagcgaacatctgtacacaaaagaatgaagctggatcacaactttacatcatatgcaaaaataaactcaaaatggatcatagatctaaatgtaagagttaaaactataaaactcttagaagaaagcataagaataaatctacatgaccttagattaggcattagtttcttagatatgacaccaaaagcacaagccacaaaagaaaaacttgataaacgggtctatatcaaaattaaaacattttgtgctttaaatgataccatcaagaaagtaaaaagaaaaagcacacagaatgggagataacatttgcaatccctatatttaatgagggactagtatctagaatacataaagaactcctaaaaattattaaaacgacaaacaacccaaataaaaaatgaataaaggatctgaatagacattccttcaaggaaaatacacaaatggttaataagcatgtgaaaagatgctcaacatcattacccctgaaggaaatacaaatcaaaaccacaatgagaccaggcatggtagctcacacctgtaatcccagcactttgggaggctgaggatggtggattgcttgagtccaagagtttgaaaccagcctgggcaacatggtgaaaccctgtctctacaaaaaataagaaaaattagctgggtatggtggtgcatgcctgtggtccctgctacttgggaggctgaggtaggaggattgcttgagcccgggaagtggaggttgcagtaaaccaagattccaccactgcattccagattccaccctgggtgacaaagtgagaccctgtctaaaaaaaaaagaaaaacacaatgagatacaacttcacatcatctaggatggcaataatccaaaaacagataataacaagcgttggtgattatgctgagaaattggaaccctcatacactattgatgggaatgtaatatgtatggtgcagctgctttgaaaaatgacttggcagcacctcaaaatgttaaacagagttaccacatgacccagtaatttcacacttaaggatatactcaagagaaatgaaaactaaaaacatacgtctacccaaaaacttacataagaatgttcacagcaacattattcataataaccaaaatatggaaacaaccacaatgtccatcaattgataaatgggtaaagtctggcaaactcacagaatggaatattatttggtggtaaaaaggagtaaagaactgatatgtactacaacatggatgaatcttgaaatctttctaagtgaaagaagccaaacgcaaaagatcagaaattgtattgtcccatttatatgaaatgtccagaataggtgaatctacacagacagacagtagattagtggttgtgtagagttatgggagagtaggaggggaaaatagggaatgagtactaataagtacaggatttctcttttgagtgataaaaatattttaaacttaaactttgagaatggttgcacaattctgaatatatgaaacactgaactgtatgctttaaatgggtgacttttatagtattgaattgtatctcattaagatgcttaaaaaatgtttttctaatcccttgacaactctgagctttatttcctaagaatgccctttgaagagccagcagtttatagtggtagtagaacaacagcttgaaaagatctcctactgtaccatggaggatacagtcatgttgctatattcacacccccaccccatgccctgactgatacattaactccttattcagtacctatgataaaccaggcatagtgctaggtaaggggcccaaaggtaatcaaaccctagtcaagtttatccttgagtagaggggcaccacaagacacattatgttgttttaaaaaaaaaaaaaaaaaaaaagcaaacatgacaaagtccaaggtccctggaagcacaaggctgcgtggtaagagaaacatcctggaagcagcaatgtgtaagtaaagaactaaaacatgattagagttagtgagaaaatgtgctgaaagaaggaatcaattgtgttctgggcagaaggaatgtgcaagggactggaggtgcacatattgtttgagaagttaaaacacatacaatatggttggtgcacacagtgttcactgtggtgaggaaaggcaagtgagtttccttataaaggccaggcataccatgctagcgagctcagactttagtttgaaaacaatgcagaaccattaaactgaaaaattacctgataacattcatgttttagaaagattattctggcttcagtacagctacatatgacttgaaggaaatacaaatggaagcaaatacctaaattaagaggccactgggaaagaaatgatagtttgaaccatgctattaatggtgtgggtgtagggaggcagctagattcaagaactattttacatgttgaacggacacaactttgtgattgactgtatataggatagggaaacaaggggagggaagggtgactcccgggtttgtggcattagcaactggatgatggtgcccttcactgaagtagggaacatacaagagcagcaaacctggaataaaaagttttaaatacattccatttggatttactaaattgaagtgtctatgaaacttctaagggtggatatataggtctgaagttcagggaaaagagcaagctggaggatgtagctttgagaattaagagtctgcagagatgagatgaagctctgagggtagctgaggtgtcagagaagggaataaagaggaacagggcagaccctatggaacatgggaaactcaggccatggagagcccatgccgggatccctcaggctctcaagtggtctctcttctaccttcagtggtcagcttggtgggccccaggataaacactgaagaaagtggtttttcattcttggcctcaggacatcctaacccttttgtgcaccttcaataagcatttgttccaagaatattgaggaaaggctatatgtcaaggactttcctgggcactgggatatgaagaagtcaacaaatcccctgccctaaaaaactctggttggtcaagggaccaaaaatagacatatagaaattcttcatattttttctcctttttggtgagaaaaaaaaatttttttaagggaaattaattttataaattctaaatttatttttttctgaaataataagcacacaaagcgacacaaggacctgaaaaataccaaagtttcataatgttctttcaaagttggccacttaaaccaaatttcatacataagaaacacagctacttgacaatcaaaacagaaagaaaacacagatacttatttttagggagtaaaaacatttagtgtaaaattgcagttacatttttctgaaaagcacactagagcctcaaatcctggtaagttgcacaatgagataaactgtattcaaacaaggcccaaaagagttcagtcagtgtcaaaaaaattttacacaaatctaaattttactctggggagcaaatcaaaatcttcccaacaacatgaggatcatatagtatttgttttcattgtgattgccaggaacatgaaattcaaagccatgttttgcattgcagaaatttctagaccctcagtctggtaacactcttttgacctgtgacatagttggggcagccatatttctctgctgccagatgctttgctacagaaacaaacaagacacaggagagaaatgccacagtgctagcatatgaggtagctacataagtgacttttagaaagagctccccaggtcactcgtctgtctcctttctaatttgagtgtgatccagccgtactggggccatccatagaactggtttgcccctcctgatagtggttctatccccagtgaagctggccactaaagactgccgagctcctgtgatctctgagccctttctgcctggattttcccacatccatagttgcagatgccttgatgtttcccaaagattttgttgtgtggaaatgaactcttgcagactctacatttattccctaaaatccagggcattgaacttctgacagctttgtaaacttttatctacaaaccccacttcactgacccctctctaaacaaattacacttagtggatgttcctagctttgagtatgttctttccacaataactttctgagaagagagaaaggtagagaagagttagaggatggcattcttgtttatcatttatcaaactcctcagtcatagaacaatttacaaaattagatacccacacaggaagtaaaaacaaacgaaatacttattctgtagttccacttgccttttaaaatagtttttttataattcagagctgtattccttggctgaagaattttgtgtaccaataaaaattatttcaatacattatttgaattccagtcacatctccctctagcattttcagtttatatcatcagctgacatctagttgatgtctatccacaggtagacaataattttccttggaacacaataattttccttaggttcacagaatcctggatctgaaactgaagtgagtcctattgccatttaggaactctacatttacatgctcctctctcaagaaaaaaaatagttgcctttcacttaaaatttctctaaaatttttgtaaaattcctctaaaagaggaatatccaataccttctgtcttaggatgttcttagtatctcaatctaacaatcaggaattttttttaattcctcatgtttaacttaagtacataattaggttgccttaggaacctacaatggctcttaattctttctactcaaagcccctattacagtgtttggtatatagtaggtgttcagcatatatttaatgagagaaaaaaatgaacagagggaggaaaggaagaaagtgagaggaaggaaaaaagaaaagaagggagggaaggagagaacaaataaacactaaaaggaatcaaacatgaatccactactaaggaaattaacaacagagtagcaagaatgttaaatggacataaataactacaatataaagtagaaagtattaaagggccacagacacaatgttggaggaaatccgaagagaggtatgaaatttctagctaggagaaatcagaagcaagtcaacagaggaggtaagacttgaggtgggatttgaagaacaggtagatttcagacaagtgatcagaggggataagtgtcccaaggagaagtcatgaatgtggaaaatcatggggtgatggggaatgaagtggtttaaggggagcacagaaggtggtatcgggcccctttagtatctaggcttataagcagaaatattaataattattcagaatatcatttgaatgaatgaataaatgaacaaacaaatgaataaacaaacaaattaacttaggcctggaactttaaagataaagcagaatatgaatgttgtttctataattattcctattgcaaattacacctctatctctgaaaaggacctcctgggaaagccttctgccatcaaattagatctacttgaaaaaaaaaattaacgacagaattttaattatttcacagtgtttgcatgtcactttattttaatcccagggatatgggaaatcaatataaaatagtttgttactttcctattaccaacacaataatccatccagtgtaattttgctttctttaccttctatttcttttttttttttttaacatttaaaagcaaaccggaagaggctttgctcccactcttcctctttcctatttgctcccaacgatttaatgcacatacacaagactggccaaccaatttgtcagtgaagtactctcctgctggcttttatggctgagttattgcctttaaagaactaagaaataggacatactgctacacaactggtcctggcagaaacgttaactctagaataagacggatagaacaaaatcagtataaaagccagtgggattagtgaaggctttaacatacagcttgcaatggttgaaatctcttatgacccatgatgttggttaaagatcatacttgctgaaaaacaaccttagccactgttactaagttctaattgggttttctctctatagctgtcaaactccctctacaatctgatgactttttttcatacttaagcgcaaatgaattttaagacatacatcacgagaacttaatctctttttaacacaggaacttgtacacaaatgttcatagcagccttattaacagcctcaaattggaaactccccaaacatccttcagggcatgaatcgtaagacaaaattttggcacatccgtaccgtggatgactatttagcattaaaaaggatcagaatactggtatctacagtttatgctgcgtgagaaaaaaaaaagccagtctttaaagaatacatgccatatgattccatttaaaaaacatctgtgaaattacaaaattatagagataaagaacagagtaacagttgtcaaggcttagggatggaggagaggggatgggtgtggccataaaatagaagtgttaccatgatggcacagtagagaggctgttgattgtggaggtaattacacagggctacacatgtgacaaaattgtcacaaatgcaaatgatgtgtgcacaactggggaaatctgaaaaagctctatggataatatcaatgttaattccttggttttgagattgtaccataatcaagtaagatgtgaaccctgagggagctggaaggtgaatacatggcatttccccatacatttctttgtgagcctctatgcatctatcattatttcaaaataaaaactttaaaatatatgtagtcaatttatatcaggatgtgtcatgaggtttctctctcctgagttgaacaatatctaacataaagctgagtgatagtaaggtccaaaataaacactgtccaaagaaaagaagggaggaaacagggaggaaggtgtataaccatccctggtcaatctaaaattgatgaaaacctgatttggggggaaatttataaaatgtctgaagttttcaatatacctttttacaataaggacattaaaatcaacattataaggcaattgtgaaaattaaaggtatatacagatatgtagatttctcaatatacatatgtgtgtgtgtgtgtgtgtgtatgtataagagagctcattttagtaagagcctgggactcaagaagtattcattctcttccaataagcaaaaaaaaaagaaaaaagaaaaataaaatcatcattatattcttaattcctcactctcttactctttcttattgcataacctcacatcttggtgaaattattttctcctccttcaacaactaagagagagcaaagattaaacacaaaatcagagctcttttcatctaggcccatctgcctaggtaggcctaagttgaatcactgaaccactgacacacagttctgtgagctctcggaagctcagaatcccacatacagtttggccacagggctgaaatgttgtagcattttatcaacaaccatgttttgaacaatttaacacccaagctctctcattcctgtctccttcccaaggcaactgcagattcctcttccctcagggaatataaccccactacctttcctcattttagggaactgtaatgacctggacagatggtaaaagaacactggaaaagtgatgtcttcaagtaccagcccaatgagggtatctactcggggggcttaaaatggaacactcaagcacgccaatgaccagcaaagcaggaaatggtcccagaatcactgacagaagaggcaaatttcccagaatacaatcccttcatgccgacccccagggtcaaagcacacagagcagaatctgggccacaagcttggaatcatcctcatgtagagttatcctcttttcagaagatgcttccccatctcaaactgggcttttatggctgagtaaaatttaccttgtgtatataatttacattaatttgtttggcaggctccaaaaaggcagtacaagcgagaggtccaacagagaggtcagacacaagtaacagcttgaaacccaaggccagggtccagatgggtgtagagacgagctggagtgggagttgagggtagggggattagcagaaaccagtggggcatgcagactataattaggagcatgtatgtatttggggcttgaagacattgctaaacagctgaaggacactgctcaggaacatgagaagctgatcccagcaaggctggttgacgtttccaagactggacagaaaacctgaggaggctgggaggagtgggcagtgccagaaaaagtgagagcagcagctctgagcaagcaagtcctaccagcatcataaatgagacgaagagctaggtttgccatggtcaggattttgccacagcagggagaggatgttaagatcagttactggctggctcaaactgacatgcccataattacttactgagcgtccatgtcatgaatggagtgctctatctgtacatacagccagaggtcatacagtgaagatagtgtccctgctccacttctctgttcacaggggagcatcttctctctttgatcataaggaagaggagcagagcacctacctagctgtgccttttcaggccaaccacgtgctggcagcgtctgttccttgtaagaccttcccaggaatctgctctgctaatgaggcccctctacctgacagctggttacacaagctgctatcagaaaacaaaagctgcctgttgaggtaaccaatatttccacacctcacacacaagcgtgtgcatgcacacacatacacacatacacacacacgcgtgcactctccccagtaaaattcagaaaccatgctcggaatgaatcaaccaccaaatggaacaaaggctgcctccaagataattagagtttggactgaactgaattttttctggcttagactcagcattcccacttctttggttgccagccccacagcctacacaataggcacatggggcaaagctggctgcagcttatagttttagatgaaatgctggtaatccatcctctggtctgccatcttctcttatccctcagtagcaaccacagaagacattcactgtcgatctcagaacatcaagaacatacctcggtccattctgctgagacaagagaattccaactgaaccactgatttggccatattaagacagtcttcaccattgcacacctattacaacggccaaaatacaaaaccctggcaacaccaaatgctgtagaggatgtggagcaataggaactctccctcattgctggtaggaatgcaaaatggtacagccactttaaaagacagtttggcagattccttcaaaactaaacacactcttaacatcagatctgggaatcatatattccttggaatttactcagataaaatgaaaactcaggtccacaaaaaatggcagctttattcataattgccaaaacttggaagcaaccaagatgtccttttataggtgaatggttaaacaaactgtggtacatctagacagtggaaaataatccagcactaaaaattaaaaaaaagagaacatcaagctatgaaaagacatagagaaaacatgaatacatattgctgagtggaagaaccaaatctgaaaaggctatatgctgtatgattccaactatatgacattctggaaagtataacactatggagacagtaaaaggattagtaattgccaggggtttggaggaggaaaagttgaataggcagagcacagagagttttcagggcagtgaaattgctttgtataacacaacgataatagatacatttcattataaatttttccaaacctgtagaatgtacatgacccaaagtgaatcataatacatactctgaacttcgggcgagaatgatctgtcaatgtaggttcattgattgtaacaaatgctccaccctggtgggcgatgctgacagtgggggaagctgcacatgtggggatgggggttattatggaaaaatatctgtaccttcctctcacttttgctgtaaacctaaaactgctctacaaaataaagcctattgattaaaacaaaaatcttcagagactgacaaaagtcaaatcaaaaatatgttgacatgcaaacttaatggtgtattgtgtgggtttctgtttgtttgtgcttatatgtgtgtttaaatagataccaagttatagcattctagaagaatgctaaatttaccaacatggaaaaacataagattccaaattcaccacaaatggaatgccactgcttcaattttctttgcaaaggcagaaaaaaaaaaaactatcaaaaatggtaaaaaaaaaaaaaaaaaaaaaaaaaaaaaaaaaaaaaagactaatgggaagaaatttttatcaatcaaaaatcaccactctgatcctctaccaagatgagcctgactgttatgagctgcgttacaaatgactgcaaaaaaaaaaacttttaaaaaaatctgctgtctattaggctaatctagtgattgccattttcctcaaattcttcatttgatgtttccaaagcaacaacaacaaaaaaatctgatgtagcaagccttacactgaaatcatattaaatcttcaaaaaccaatcagaaaaaaagcataggcaagtcttcttgggattcagacttaatcacctttaggtactaaaggtgggattagaacttaagtatgtctctaataaacaggatgatgcaaaatcaatcctggctcactgccagtcttcctcctgattgacagctagagcagggctgtccaacagcaagacaccctgaattgcagacataatttaaaattttctaagtagtcatgttttataaaataaacaactgaaattaagagcatattgtatttaactaatagactcaattatttatcattttaacatgtgaccatggtagccacattccaagggctcaagagccacatgtggctagtggttaccatattgaacagcagatctagacttccagtgtaaatctaacaggtcccaagcttctccctttcaaatatgtatttattcattcaaacacacaaagtctcttcatatgcttcattattcctactactggaggttcaccagagtcagcagtaacagtgcttgagtcacaccttcaatctatgcaaaccataagaaagattaagctctatgccaatgtgaaaaccagctcaacttcagtttcttattgttattattattattactaatttatttccagtatatatccttcccatttctttatcttaatttttattacatattgactatttgtaattatatatatttatggggtacaaagtgatgttataatttatgaaaacaatgtggaataattaaatcaagctagttaacatatccatcaccttaaatacttaattttttttgtggtaagaacgttagaaatttaccctcttagcaattttgaaatgtacaatattattaactatattcactacactgtgcaatcgatttcaaaaaaattcctcctgtgtaactgagattttgtaacctctaaccatcaattccccattccttcccttccccccagcctctgtagccaccattctattatctgcttctatgagcttcgttgttttagattccacatctaagtggaaacaattaacaaggtacggagacaatctacagacttggagaaaacatttgcaagccatacatcagataaggtattaatatccaaaatatataaggagctcaaacaattcaatagcaaaaaaacaaaaagcctaatttaaaaatgggcaagggacctaaatagatatttctccaatgaagacatacaagtgaccaacaaatacatgcaaaaacaaattcacattgttaattattagggaaatgcaaaataaaaccacaatgagatatcatctcagatggagaaaaaaggaaatccttatacattgttggcaggaatgtaaattagtacagtacagccattatggaaaactatacagaggttcctcaaaaaactaaaaatacaactaccatatgatccagcaatcctacttcctagtatttatccaaaggatttgaaatcatcttgtcaaagaaatacctgcactcccatgttcaatgcagctctattcacaatagccaagttacggaatcaaccttttcacactgtttggaaaaacaaagaatttctcaactaaagtttatctttgtgatagaataaatcaagaaataataggtgcaaagccatctagggtctgcaacaagagtggaggtaagtgtagtgaggggtgggaggagaggaaagaaggcagagaggaaagaaagaagggaggggaaaatatcacagcaggtcatagaaattacctcaaggcatcgagtttaagagcaggattcccacattcaatgactttcacccaaacaggtaatgcaacctaggtttaaaaaattgtgtaaatgttgtaaaagggattttcaaggcaatgaacattgattacatgcaccaatacatctgaaagagatagaaagcagagtttagccaatacatttgtgcattttaaagactgtcccttaataaacacaataatgagccttcttatattgctgcaacattatttatcacagtaaagaactcgaaacaacttaagtgcctatcattaagagaacatcccaattaaccgtgatttagccatactgtaaactttttaaaaagaggtacatttctatgagctgacatagaaaaatatccaagctacgggtgagtgaaaaagcaagttgctgaaaaatgcatattataacacacacacacacacacacacacacacacacacacacacacacacaaagtgacaatagctataatctctcaggaggaacctgggataagttggttgtggggatagaggaggaatcaaagaagactggacactttggtcttctcagtagtatttttttaataaagaaaatgtattcagattttacttagagaaaaagaatgattttaaaacaatagtacacaccctcaaatgtgtttatcccaaatcaaaatttaatatattgaaacccaccaaactcatgcttatgcttacctaagaatggagtttctctcaccatgtctatgaatatatttgaacacgtggatatatccttgaatacagagaaagtgttttcttgaattggttattttttaaaaaattagatcgctgaaaatcttctcatgaaaaactgaagacatcagtaggcttctacgtacatgttgatggggtttcagacacattaccgccaaaataagttacctgggcatattgaatattttaagctgaaggaattgagaaacagcatgtacaggaaggactttctgatcttcccctgaagcagggcataaaacttaggaaggactttctggtcaacttcataataaacctatttagaaacttataataaacctgattaaaaatttataaactaaatgcaaactgtggtagatgctattactatctgtgaataaagacctccttctctcctcaaggaaggactatgctcctccactccattttggacttcaccaggagatttgccttgatatatacaaccaccaagaaaaatatttaaaggtgaccaagtggtctaagtttctcttgtcactgtcctctgcaacaagaggcatatcccatagagcctttgatctattttacaactacatgaattgtggataactgataacaacatgaaacaattcctgtccactgacatgcaaatattactttctgtctcgtgaagattcagtgagcttcccttctccactatggaatgtgttttgtccttcatttgcacattccaatctatgaatgtggctattctttggattgtcatttgaacatcattggtagtcataacatcctaccagttccctcattaataatgagttaaataaaatctctaacacatgttcattttatatccaaaagagagtataattttacctttctttgaaaattatcctgggtgcttaaaatgttagataattttactatacactgattccccctaacaaccctatcttttactaatgagaaaaaggagccccagaaagattaagtaacttgcttaaagccacacactgattagtagcagagctggaatctaaactccaggtctagatgacacctctacactgcttcaagggcaacccttcagagaaaggagagaatagggtggaatcagggtattgtgaaatcacagaagtgttaacagccagttccttttttgatcatatgagggaatgaaggcacaaaagtataaagatcttggccacgttgcatagcttattataggcagggatcagaacccaaggttccttacaaccagcctgatgatcttgcgttcaaggaggaagtcaaattagactagggccttgatggataaatagaatcaacagactggcaagatgcaggaaacagaggctggacacatgtgaatgtgaggtatggaaagtaggagaggcccctctaccacaagggttctaggaaatttacacagtggggagcctggaagtgggaagagatggggcaaggagactgtgtccagacgttgtcagagggggccacaggtttgtaccgcaggagaagtactgcttgggggagaaattcctggaggctgtaaaatgagttatttgctttcccagtagtcagagactagatgcttggccacctgactttgtgcacaaccctttgccatctgagcttctgcttcacctgaggctgaaaaagatgacatccaagattccttctagggccaaaaactacaataaagtcaaaagagtagacatacttcctcataagttgatcatggtggcatactctgttataatcacatgtgttctagaaacccaggatgccacatggggcagaaaagccagaaaagcccacatggggtcctggagagaagaggctgcctcaaaggttattttggaggaggaggtggagacctcatgttctaaagaggaaaacaaacctacttgcccttgcctgactgtcaggctgtgtcccagaccagcagggacttcacagcaaggccaggcttcctattctgtgagttcctcacacccgtagagtgtccccatctctctgccactggggcataccctgctcctcacaactccgaggcaagaatcaagttcacagggcatctgttcactgctacgagtgtgtggagacagccactgacaggaacactgattcccaaaaggcacatgtaaatacaagatgaatgcaaagagaaaagtgactggactagagagaaaatatcagctctaccaagaaggaatcgtgattcctgcttctattattatagataaaaacctaccatcttatggtcacatgccgggtcttatgaaaatgagggctgtgcacacagacagtgccctctccacacctatgcaccaacctgtggagcctccctccccaaagaatggccaagaaccagggcatcagtaaccgttagacatgcagaatctcaggccccatcccagctctgcgggatcagaatccacgttttaaaaacatccccagatgatcacattaaactttttgagaagtgctgtttgtaaggttcctgtgagtaatgcagcagcaaagctcgggtacacaaggaaagactaacaagtgagcagagagctggagatggggaaagaccagaccatgaactggagatcacaagctctcttaccaacacaataattcagaaggtgacttctcaaaactaatcttcagctgagatcagctgacggagtaagaccttcccaggatgaaaggagggctgaatccccaggcagggcaaggcagaagggaaggggcagactctctcttgatggcatcctagcagaatcaattgttagttcccaaagctgtcctagaggcgtgatgctctgtggtgcatttgctatctctttgtgactcatccacagatgaatgggctcaaagaaaagggagaagcgagccatgaaatatagtaaattacagcttaatcttcctcaccctggaattcattcagtagttttaatgaacttacagtctggaaagcatgttgaagaatgtatatggaatatatttcatgccactctgagcatcaaaggagcgcaattccctttgttattaaggggataaatgtccttccttcagtcagtaccttggcaaaaaaacaaaaaacaaaaaaacctgttttccattattgctgttatctactgcaaaactctaaagaatacagattttcaagaagtggttcccgagcacagtcagcttcctgaccttgtatcttcaccctgaaccactgagacaaataggggaccctgaactgtcaccttgaaactccaccaggttctctctctgttggctacctcctttgacttgacccacagacccaagagagaaattgtcatggcttgcttctaattcaggttggaggaaaacccaaagacccctggaaggatattgagttatctccagaaaacaaaaacagtaccctgatttattaacgtacttatatgcattaatatatgtccagattagacctggacatttaaattcatccccaaaaggatatagcttatgctctgatactctactcccaccaaccattatcagtaattttcaaattatggactgctctctatcagtagataataaaatcagcttactgggttatagccaacaattttatgttaataaaatagaataggaaaattagacttaatcagtggtagtaagatgagagactgtgtgtgtgtgtgtgtgtgtgtgtgtgtgtttgcacgcataatgtaaagtgtatttttttactgtgtgtcacagtcaaaccagcatacagcacctggatatcaaccccttactggaaagagcagagagacaacatgagcaaagaactggaaaaacaggtttccttcatgaacttctaaaagcaaaatgaggaagaaattaagccctcttgtggcccaacagatgggctggagcttctggttaccctctcccctactcacatcccccactccccctacccattatggctcaatcagaagccacatcccataaatctcacaagaatgaagaaaagctgatttgtgctgcacagatttgtgcctcggacaaagatgccaatctggtggatggattccccttagcagtgaaaaaagaggctgagcgatttggagatcctattccttggcacagttttcactgaggtccccattctctacaaaaattattttccttttctccccaaggtgtgttcatggtagctcccagtcatgcttggcttcaaatgcacaaaaaatctaaacaggaattaaccaaacctccaaacagtactgatgtgaactttaatgtaaacactaagtcataatcccacctttgtcactatatcccaatacctccaaagttaaatacagaggcaaggtagcataagagttaagagattggggccaaaagtcaaattgacctcaattgaaccaagccccatcatttcctgaccttggaaagttacttatgattatctaagactcagttttctcacccataaaatggaggcaataatattatagcacctatcccagaggagttaataaaaattaaataagtgtgtaaagcatttatctcagtgccaaggacatgattatcatgcatcttcaagtaatattatggctatttttattattacaatcatactctattatttaaaggcaaagtttagtttctcctcagcctagtgacagagcaggagcattgccctcttggaaaagcaccaacattttaaagttccccttgatcaaaagccaccgaaatccaacccaaaggacatcagcctaatggctaatgtcagcatgaccataaactacaaatgacatctccaaccagaagcattccaaccctaagacaaacgcctccacaaccagagacatgcctgccccaagataaactcccctacaaccagagacattccaaccccacaataaacttctcctccacacagaaacattccgagcctgtgataaactctctcactctgaacccctaaatactcttagtctgtaagagagagtgctcctgaccaaattggccagaagcccctctcaggtttattctccaaaataaacctgtctttgactattgagctgcttttcacgtttctttcctctttctttaactcttacacctagcttgtttgtttggttgttgtttgttttgcaatcaataccaatggtataaatttaaaaggaagagaataaagaaattatattttctgatcaacgtttgttgtaaatgatttatacagtgatgggtcccaaactaaatttcccagggaattccctatttccttgcgggggtaaagagcatccgaattatttgctcattaaatgagttgccaaaagccagaaaatctatgcatctgagagttttcatctcaagagacccaggagctcgaaatcctagcagtatgaatcatctctgtccaagtgtatagagtctattagcagagggcagctcttgcttctgatggcaatggatgccagctgctgctgagaaaacaggaaaggtaatcccatgtttcagctttaacgtgcctggtcaattgtgaaaactgacttgaagggagagaaatttcatcttgacccccttggataatgaacaagaaggacagcctggcctgtgaaggaaacaccagagtggggcaagctcagagaaaattcagccaacatagcagtggaatcatgctctttaagtgtcaggccagcctcacaggtaccacactttttctaaacacaggtttctccattcacaaattgtttacttcagaaatgactttttctcctataaatggaattcctttgtctgagaaccacatacgcaagaaacaaggatgaaggaagagccatctaaactaccaggtcagctacattcattcattcattcacctgccccagcatatccatcctacgggtttactaggtaacaataggggtatggatgaggcaacagggatgtacagagaaagaaagtgcttagagtgagttgtatagcttaaatgctcatattagaaaagatggaaggtttaaaatcaatgccctacgtttcaccttaagaagttagaaaatgaagagcaaattaaacccaaagtaagtagaagaaaggaaataataaacaaaaagcagagcacaataaaacataacacaatcaacagaaaaagttaacaaggacagaagatttttaaaaacattaataaaagtaataaacaagtagcaagcttgatcaagaaataagagaaggcacaaattactaatgtcccgaatgaaaaagagatattgcagatcttacagatattaaaaagatggcaagcaacattatgtcaatgagtttcactacttagatgaaatgaacaaattccttgaaaaaccacaacttaaccaagaatgactcaacaagaaatagaaactctgaatatccctatacctattaaggcagaggttatccacatgtagctccagcagaaaggcagcatcagcaacacctgcaaactttttgaaatgtaaatccacagctctcactcggacctaccaaatcagaactttagagtgggtggggtgggggtcacagcaatttgtgttttaacagaccttgctggtaattctgataccatttgagaactgtttcaatactatcttcctacaaagacagacagatctagatggtttcactgatgcattctatcaattacgtaagaaagaaatcataccagccttacaaaagctgagaaaatttaaaaaggggggatcacatctcatcatttactgtcaatctctactcttttatggaagttgtaggagtctttattttccctgattcttattttaaagtgattcctggtttctttgaaatgggccattctgacagacaagtggtccacatagcccaaatggccacactgcatgttctcaagtagagaaaggtctttattaggtgttttctgtcttttgcttgcagcccttaggggagtgataatctagttcacgataaggtaattaaggcagggagttgcccctcacccacaaggatacccacagcatagcaatccttcccttctcttgcatacaaacctcactcaagccagagcagggactgggactcagataacaaaagcggtgataaaaatgaactatctgctcatagtattccttctaaataaaacacccataccacctttccacatctggctgtttttcttactcatccttaagcctcaggtgtcatctacagaaagacttttctgaacccccaaactaagcagatgtaactaaatctttacatctttatccaagaacttaatattgaaattctctatgactttgtacctttgtcaaataacttatattgaaattacctgtctgggtcctatatctctccaattatgtcattagctccttgagggcagaaaccacatttcattttttgttttggttttggtttaatgtctcacagtgcttgactactaattgcatagttccactcagtaaacctgtagtgaaatgaagagtctgagagtggagtcaggtcaaaatttacctccataaataaaatacactcaactcaaaacattcagtatgacttatttttaaaataagtactttcaatttgttcaatctctcagtagtattattaatgcaaaccacatggactgactttcattttgcaaatctcacctaccctttttaaatatatggtggaaacataaggtccctgcccacagatctatgcattgcagagcctactagaagataaatacagggatcaaaagaataacagtagtaggtgacacctagaatcttaggataaaagggttggatttcttcttttagcctctttatgcagacctgcaagttttgccttcacagccttgaggatcatcctgaagcatgagacacagattctcccacctccgcctattgcagaccccattccaacaaatcctccaataaatgagatcctgaagaattaatctcccgcacaagcagaataagtgcctgagggaggccaagttttgcagagagttaattatgatgaaggaagacattctgtggccattaatttttattgggagggcaggcattatattaacagctagtatatatatctagaattgggccatatagcatacacgcattgtctcatttacttatcacaaccctttgaattaggtaccattagtaagccccaccctgagaataagcttaactggccgaaaaatcacaaagtttaagtggtggaaaatggatttaaatttacatctctcagaccccaaaatccatgctctgaatgctagtgatatattgcctttttacagtcttctggtataattatgctcctacaatgttccacccaagccagtggcaaaagtaagtcactgatatcaaagaggggggatcatctaccctatgaatctgaagacaaaaagcaccctttaaacatgattcatcttcgacacaagagactaatttaagaaacatttctttctattcaaaataatgatgctaaatgggaagcgatttaagctttacaatggcttcatcagaatctcatctgtcagatctcaaaatcatgctcccagaacatgtttctcaatagaatgaatcagcaggaaagaaaagcagatgtaaagcaaacaggtgaaagtatgaagttagcaataactgtgctcatgggccaccaccaccatcagcaccaccatcatcatcctcatcaccagtattatattgttattattaagtaccttcattcccaaatagtagcattatgtcctctgaaggaatggggcttctgtttacccagcaaacaggcactgtttgcattaccttaagggttaacctactttcttgataatgggtcatgagtgagtaggggtgatcagtaaagatagtactattacaaacaacagagcacacttgtagttactaaaattatccaaaaaatcatggcaaaattatcaaagatgtaggattatgaatttggtatgacagcagaaggatgattgcacatctcacagtccatattgctcacatcgggttctcacatgctttaattgcagtgctaattctgagaattcttgattatgatctaatggtggaacacatctgaaagattaaagaactgattgtagaaaagtcaacacaaagtcctccatttatgtacataccagagtgcaggacaacggggacgaccctgtcccctggtggcagagctccgcgattcagaacctcgcagcaggaaggaacttgcctgtgactccacattcagccatgctttcagaagcactggacttttatcaatttctagggatatttgtgttgtcagggtatactaagtaggaatctattcccatttatattgtgatttgctttgtacctactaattttcactgaaatcactattataatttactgtctctacccccacaagtaagggatggaacttcatttcccagtaaatatattttgttttattgcctcctaggtaacaatgtgcaacaataccaaagtgtttcatttaagacctgtgattttgtgcttttcaggactagtaaaatacaatagcatgtggaacttatgatttctaatttgtttcagaacgtagtatactgtgtttatataagccacacaatattaacccttcaagacaactttaaaatctctttcaaagcatgattaaaagtacgtctaaaaattttccttgtgaaatgtaaatgtatctaatacacctataaaatcttgtcagctacatttatgaaacataagtcataaatttactacataaacaacaataagtcaaaatagtaacattgataacaattgctaaaatgttctttacacttactaaaagccaggatatacacttaacacttttaatctttatctcttttaacccttacaacaaacccacaaggtaagtatgttattctctttttaaagaagaaggtacagcttagaactatgtacctcaacattggcactctaacattttggataatcctttgttgtggtggaaatgttccatgtactataggctatttagcagtatccatggtctctattcacttgataccagtaatataccccatatccagaagtgacaaccaaaaactgtctgtagacattgccaaataccctcgtagggccaaatcagccaaatcacccccagtcgagaaccactggcttagagaaataaagtaacttactaaaggtcatatgcttagaatataattgaacagaagccaggcattctgacacaagaatgtatactctcaatcaatgaaatacagtgttgtttactctgtgatagtttaaagaacataaattttcctcaaaatagaaaactaaaaatgaagacaaactgtaaatgccttcccgtagaaagatattctatggccacaagagactgtgcccttccaaaattttcctttcctaattaaggtccatgtcccaatgcctattgcccttacgtagcttgatctcctgccccacctaccccaatcttctttaagtcctattccatgtgccccaaaagacagtcaccaatcccttgttaaggctgattccatgctttagtaaataagatccagactctgcctcacagagcccctgaagaacaagacctgtctgcttcctacctgttcccttagatgacccaagacttccacctgtatcatctcaaagtgtaagccttctgcatagtggtcactgaattccggtactgaagtcccaagacttcagtgactaaggactttccacacaccaaagtcttcctatgtgcctcacatagactatttcattccaggctcacaagaaccctaggaagcaaatactatttccatttaccaaaagaaacagattccagtaggcaggggaaacccacacaagcatttcaccaggttcacgacaggactcagattttaacccaagtatggacaactccaaacccctgctctgtattccaaccctatactcttccaatttcatggcagggcaaagactacagacacacccttccaaagcatgttctcatcttgccatactccctccagcttgcttagaagttcatcattccagccccctctcctcgacatcccaaatttatgagaataaacaaagcagagctgagtgtgacttcacttgtggaatagaaaagggaaaaattcaggcagtgacctcacgaactttgaaaaggcagtatcgtattaaatcagaggatagaaaaatacagaacatgttttctcttatccgattctatttttgttatttactttttttatgcataaagagttatgtattcatgtatgactgatcacatcgcttcaaagcactttagctgttaagtacgaaaatagacaattttgaaaaaagaacctggtggtggaggtgaggatttttccctttcaatcacattacttaaatatagcttgttgtttttttgttaagtcttcattaaactttcctgagagcttcaacttttaggttaaggccaaatacgaaaactttcaaacataaaatgtctgaagagaaaagaacaattggcagagtagagaaatgaactaccaaaggcagatctttttgacgttgatttattcagctttaagctgcttcatttggggaagaaaaaaaaaggaggggctccacagctgtaaaaatctataaagccaggctgagcacagtggctcatgcctatgatcccagcactttgaaaggccaaggcgggtggatcacttgaggtcaggagtttgagaccagcctggccaacatagtaaaaccccgtctctattaaaaatacaagaagtagctgggcatgatggcatgcacctgtaatctcagctactcaggaagctgagacaggagaatcgcttgaactggggaggcagaggttgcagtgagctgagatcttgcctctgcactccagcctgggcaatggagaaagactccattaaaaacaaaaacaaaaacagaaaacagacaaaaaaaactataaagccaaagggatagaaagaactcaagaaactttcagtgtctgaaaggcctgcctttaaaccctggcccgaccatttgtctgctcatttgagttacctcagatgagttacctcttttccatgacttccttttctgtaaaacaggatcattgtgaagatcaaatgagaaaatgcatgtaaagcacctggcacactgtagacacacaatagatttcaatcagtagggggccctctggacatacctatgtgcttgccaaagtttgtgctttagcaatacttttaatgtcccatgattacttctcattaattaagtgaatttagaagtattgtaaaccaaggataatctggctaggggctaaaggacaatatatatggggtacagactatgtcacctgcccagtgatctctgtgctaactggcagctttgttcttttctggtgattcagttaaacagcagagagtgcccaccatcactgcagatgttgttcagtgacctagacttcctcctggaaggacctcagtaactggaaccagagaatactgtttttgagccaaagaccacattcgttctcagattgaatctcatctctttacagacaaggacactgaaccagagaggagcaattcggcacagctaaatgtgacagaacacaaacacgattcttaatcttacctctttaccagtggttctcaactagaggtgattttgacatacacgggacatttttggttgccacagctaggggaagatgagatgttactggcatctagtgggcagaggccagggatactgccaaacatcctacaatgcacaggacagcccctacagcaaaagcatcaatagtgccatggttaagaaatgctcacctactccattggaccagtgtctccagggagtctgaaatctgcctttaaagctgctgctgctggaagttgaacttggccccagcatggcggccctcactaatgactgattcaaccctgtcaattgtgcctcttagcattgaaagccaccaggtttgggaaggatttagagatttgcctcctcaggtaacttaaagtctggacataacttttgaagcaccctgatatgcctgggcataagtgctattgacagtcctgaaaatgcacttcggtcttattaggcaatctaagaaacttactctcaaaaccattttggcaaaacaccgccaaacagccaaatgatgcacaaccacacagatacctgaatatcaaatattcagaatgatccaccctgagcaaatacatctgatactgtactaagcacctccaggattaatggcttgagtagaggaaacacagagattgaagcactgattaaagctaaaatactctcagtgtttccacccaaagcttgagttccatgttgcagggactaaaaaaagaaaagaaaggcagagtcaatgatttaagcaattatgtacttactgattcttgccatgcatgccatctgtcttgctgacctcacaggcctctacaccggccagtgtgagggtcaaatgagagtctacgtgtgggagtatgcagtgaactgcaaagccatttgaaagtatgagtcacaatccaaacttatttacccagagttccacctagtaactatgacgttagttctgacccatgatagaaatatatgaaggatcccaatctgatttattcataaaatcaatgcacatttaataaagatctgtcatgcccaatgcttttggggagcatattccccacttaaaaaaatcagtgatgccacaaggaatgacatgcaccccactaactcttatacagaattagagaagcaggaactcttttaggtggaaatacctaagaagtttccattgaaagggatggtctttgaattggatcttgaagaaaagatgggatttcaacagataaaaatgagaacatttagagtactggaaagaatatgaaagaagaaaggatcataaaaaaatcaggcaaatatgacagtcagtaaggagttcagcttgactggaacttagggtgaatggaacaaggtaacagacaaagcagcaaagtttaggtggaagcaagtgtaggcagccttaaaatccaagacaagaagataggcatttaatggccaacaggaagccaatggagatttgttgctatttttcaaacatagaaggcacaatcagaggagctgtggagaaagtaatcagacataggtatgcagcatggagaagatgaagaaaccagagtaatgaaagagattaaagaggccacccaatactctaagagacaggtgatgagactggaccaagatcatgggagggaaagtaatgtgaaggaaaagcccacaatccgttagggacccattgatcatgggcaaagaggaagaataaaaagttaaagttgaaggaacacccaacagaagatcatacaaaggggctcagaagttttgatcctggataaatggaagaatggtagtaattatcagacataaggaagatggaagagaaaagacgaatgaattgtgcctagatgatcctcttgactcagaaaatgacagctcaatgccaaggtcactcctgctactggtgtctagatacactacccagacgaagtgcctgagctattatacttactacatctcagcaccctctcatcccatgcctagttcccaggtgaaagcctctaaatagcctttctgggcctagatccctacacctgtgccctgcccccctcccaccccctcccttccccccaccgactcctgctgatacattagcaagggtaagtgagtgaatgactaagtagtgaatgagtgatggctgcctgtactctgaactctgatcaaaactatatagactctccatcactccccttcccccacccccagccatgttttacctgaaattgtagtgctttttggccctttctcacattaactgccccaggacttgcacttgcaggctaagtctcagcatccatctgtgactggggctctaaccagaccactgtggctgctataaaggcaccctgattcaggtggcaatcttggaatgtaaactggacacattctcatggctgatgcacttgttcttactactttgagactgtattattagtcatcacaaatgtaggaaaatatttgtaaagggatttatctcttggaagatcctcttgtccctgatgttaccacttaggctctgaaaatcaatactactaagtaagcagtagaatgcaggattggttgtgcattaagtttgcaaaaatgtatgatttgatttatccagtgtcacccctgttaattttcccaacaagttacttagctgccacttttaattgcaaaggtaggggacaacagtctaccaattctatttcaaaggtgctgaaagaacttcggaattaaccaatgggccttaatatatcctgggaaggaaacgggcagagttcagcagaagatgtaccacatcccatcctaggatacaactgcttagcaggcagcctcccacagggtgataaccactcgccttccctcccttcacatgtgacaatctattattaccagcaaaggtggctgttgatgatgacttattagctatgtcaattcatgaaggctgaacatgggcaggcctgactaagggaatcatttgctggatttaatcaattactgggttcatcaagtgtgattactgagccacgtcaaaatccaagtgaaataacacattagacattcatggaaaaacataactccttgctttgccttgccacagatagaggccacactattatctatatgtacaatatccaggttatcaattatctgcacatgtctgtatcctgggctgtcttcttcctaatgtctagaatatttttgagccatttgccttttttttaaaaaaaaaaaagaaagcctaaaaatcagcaaaacatacatttttaaaataactgaaaacatgaagaaaacaagaaggaaagattctgggctatcctattagacttcagtatgcccatactttcaagcaccacgaataataaacaatactggaggctcactttataatctagcgagagaagagtatatgataatgtaagtatcctcccaacagatctgattgttcccaatgaccttcaatacttatatctattatagcacttaccacattttattataatccctttgttcacctgtatctcacctacaagcctctgtacctattaacagaggcaattgtacatatcttgttatttccagtatttactgaactatatagcaatatactatagtaagtattaaataaacttttgttaaatggaagatttttgtaaagtactgtgcatgtgactatcagtataatatgattatcaaaaacatgagggacacctttgtctaaagttaattactcacagaaatatgtctagatttagaaaatgaataaatcagacacagtaagagctagaacttctacctaaactatctaaacagtgctatgattaataacaaataaacaaaaatgttcatgctaatgaggttgttcattacctggtatggcttttttaagccacaactccaactcctaaacattctgaccaaagtatttccataatccagacacatgaaaattgaacgtgtgtctgtagaactccctcaggtttgtggataggtctttaatttgtgcctctatttcttaatcccctatcatactgaaataggggtgtgtgtgtgtgtgtgtgtgcgagacagagtgtgtgtgtgtgtgtgtgtgtgtgtgtgttggaagcacctctatcatagattcagcttgcaacatcagctctgatagcaattcctttcttcaagggcagctcataagtatttggttatttctaagtatttctcaaaggtataaacttctgcaagccagacctgataacttgaaggtgaaactctattaaaagaaaccggatgagacatttatgagtaagcaggtttacagcgtaatcctctctagccgtcaaattaccatttcaccacttctgcaaatctcttggaatgattgaccctcatgaacaagattcattcacaagcaaaaggatagttccccttaaatatgtggatttaaaacccaatccaataaggttttctgtgcaaggagaggcttacctactacctattgattcccttgctaacccgataaagaggacttatgaaatcactctttctactgaaatttggtcttggaagagattagtatactctccttaatgctaggagtgagactcagtaaaatcactatcatcaaaacattcccttgggctaccaaaatatgcctcgtacttggtgaaatacttaaagaaagataactgcctcaattgtgttgtagtaggatgacaattactttgaaagctgtgggttttttttttctttaacaaggttttgataggtaaacaaatacataagtgaaataaaatgaaagttagcaagaaaagcgtaaacaaatgtagattatttttgtatcctgggctgtcttccctttgatgtccaaatcaaaccttttaatataacatttatatcacttagttttcctatattaagccacctactttatttgactaattattaactccagccaaataactgcagttagaattaaactcaccagttaagtccacattgctgtgtttattcctaccatgagaaaggaatcacagctattcccagtccaaataaaccatcaagtaggcaagcaaacattcaaacagaccattacttgactgggagtgtcaagatatatttaaaattgtctaccattcatcaaatgaggaatccacctactccaaatctacagatccccagagaaggtctcaagcaagattattctgaaaaaggctgaaggtttgctctatagattaaacaaggctggaaattttttaaaacacttcttttatcaagagatttagtctatggtccattctcttgaatgggtgggttcagtgatagcttgaccaataagacacagcagaagtgatgctgtgctcacttctggacccaggccataattaagagactagcagcttttaattcctgtctcttagaacatttgacctaagaaaccagacaagtgcaattgccctgagcccaccatgtagtaagaagcccaagccagatggaagcaccctggaggacaaaagccatgtgaggagagagggagagagagaaaaaaaatagagagggagagagcaagaaacaaaaagcaccaagactcctaacgtgagcaaagatactatcttggaagtggagtctccatccccagcagccccagttgacaccaggtggatcagattcaaaccagccagccaagtccttcctgaattcctgacctgcaaaattatgagcagaataaaagttattttaagccactaagttgaggatggcttgtaattcaatgatggatcagaagcacatggatctacttcatataaaaaatgtatttcattaaaaatagaagagctcaaactgatcctctattaattcacactttaaatgacttcaataaagcttgttcaacataattggtttatttttcattacagtgacaaaataaaaaaaggcaacagcattcacgtcagatatgcaaaaaacacactttcaaaacaaaattgacattgtaatttgaaccttgacaggtttgagcagctctcttgtaaaacttcctctcactgtctaagtatctctccttaaaataaaattgaggcaactttgaagcacctcatactccaggttaactacatgtgaaaatgataaattactttttactactcaagactactgtgccctctaatctgagtgattaatttacatcctgctcagtggttcacatgcaattactaccgtgagtccaacgaacctgaacaagacagaattgtttagccatctgtacaagctctcactatatttagaaaagtacagcaatctccaggaagctttcaagttttagttcattttcctctcaatgactcgtgcactctatgctgcatatcaaattataataccactcccttggacccaagtttgctcaacccactttattttgttgttgttgttgttttgttttgttttgttttaggcttttagcagcctgaagccatgatttttagtttctgtctatagtgataagaataaaagagggatgaggaaggggctttactggcccaaatagaaacagaaactaagaactcatgactgtattctctccactggacacccctggaggagaccatgcaacacaggaatctctactgtgagatgacgctcattagaaaaggcgagactaaagcagtgatctaaaaaatgccattgttgaaacctactggcaaattttaattgcattaatgatttttttaatctgcatgtaatctgtttaattccataacacccaagtcaagtacaatgaaagcagatacaggccgtctagattgaattgtgggcttcaaatgcttggtcagcaaaaggtctaagtaactttatttcctaactcttctcaataaaaagaataaatattacagaatataacaatggagtcaccttataataaatgtgtccttaggcaatattgacattgtgtgaaaatcattaagtgtacttacacaaacctagatggtatagcctactacatgcctaggctgttggtatagcctattgctcctaggctacaaacttgtacagcataatactgtacttggtaatgtgggcaactgtaacacaatggtaagtatgtgggtatctaaacatatctaaacatagaaaagctaatgcattgtactacaatgttactgcagctactatgtcactaagcaataggaattttttagcaccattataatcttatgggaccacctaactcaagaaaagcctcctaacatacatgaggtctacacctctagataagcctaagataatatgcttactaaaagtttatgaaagctcttcctaagaaagcatccatgatcagctggacctttagaatcccaactttgatggagagtcatagctaagtttaaagaataaagatggaggttggaagtagcaagaaatgacgctggagaaataaaagaggtcatgggagaccgtctgtgccattattgtccaatgaaatttgtgaaaacaaatcattgtaaaaaacagaaagcagtgtatacaagatgaaccaatgaatgaacaacgtgaggtgatgaatatgttaatttgcttgactgtaatgatttcactatgtgtatgtatatatatatatacacatatgaaaaaatatcatacactttagatatatatataatttttaaaagatgaacaaatgaataaattccacgaggaagtacatgacatttcctaagctcatttcattattctatcattagagaacccactcaccctctccatagtcacaacctgtatgcatgctcaaatacacatgctgctccaccaagtcagcaaactacatctgtcaacgggtcctgtaatggggaatgaaaatcgcatatgcactgaaaaatgggcttcccattggacttcggaggccatgcactcaaaaacctggtgagttatttttgaactataaatacagaagatttaagtccaacatttaatagccacataggttagggccagtgaccacctgatccctcatggctccttatgccaaagagtgcaaagcacagcccagaggcaggctgggcacatgagggatgatgacagatgtcattctagttaaaattaccctttccacagtcaaatcgaaagactgccactgcccttaaaggaatctgtgcctgtgctttgagctcaacagcattttgtcagcaaatcaggcaaaggatattctgagacaaaggagaattcagacactaaacatgttatataaagaccgctttgtgctccccatccataaaccttcagcccccgccagcctaatcactctctggtcaaggttttaggaaaatcactagacagcatggcagtaacaagcttttgagcccacaggatctactctcttgtgaaggcatccacctactgtgcctcactagatgcctgcaatcaatttttaattacagcagcagtcacgatcggagataaagcacgcaacatgctgagaaagaaccaaaagcctgtttattacagttccagtccaccatgagccagacttgtgaagagctgggccacaaatgaatcaaccagttgcagctcagaaagacgttcttacctctgggacgttttcttatatttcctcctgtaagaaaaggcataaacatatatcagaaaagggttgtggcaggcagtgggtaagaaagggattacttcagtggggatgggcatgggggtcaacacttcttaggggggtttctctgtgaagcttatgggtttcaaagcttagttaaaagtttgggaatgctgtgttatattgtagtcagaagtacagaacctaagcctttagtaaaaaatagcatcccaagagctcagtggctctgctcccatgttcttcccttttccttttgaaggttccatggcattttagttgaggtcaggctttaaagaccacaaaatctaggttcaaacctcagtccttcctttaccaggttcatgaggttcttacagagtaaatggacacaagcttacaaaacacttcttttatctggcacatattaaatgggttaaatggtgaataatgatcagttatttatgttgtcactatcgttactattatccccaacatctagcactgaggtccctttaaggatgtgcctttttaaatgtaaatgtgcaatcatgcagctaaactatgagatgagacataaggtcttcaaaaaaagaagaagtgaggaaggggacaatgagaaagtctagaagcaaatgttgagaaccagcattaggaaccatccccaggaagcagaagagacccagttccagcccacgtctgttatttacagtcatttagccttgggcaaatcttgtgcatcaggcttcttaatctatcacatgaagctagtaacatctgctctgaccatctcacctaggtcagagtggcagacaaggagaaaatggccataaaatgtatgttgtcccaatatcccaaagttcttcatatgtgtgtcaatttttgtagactctgaagacccttaaaagagtttcaataggctcagcactggaggggattagaggagaggaagtgttaaggaaagaaaatccatctccttgtagcatatccgggaagtacaatgtttcccagttgaccttagttccacaccagcatttccattacagtcactgtacccaggaagcaaaccactggtttgctaatggagagctgtgtaccatatttctttgtaaactaaagaggtttcaaattgagaatcactaggacctgttacatctctgttaaaatgaaatcacacagggcagtgtcaggtgtgtaaagcagcaagtaacacagaacctacagtgtggtcttgactagatatgtagtgatatctatttacctgaaaggagacacaccagaatgacaaccatgactccagggtagtaggatgacaaatcactcctttttagttttatgaattttccaaattttctttaaagagtgagcattataacagaaaaaaatattaaaatatggatacacctagttacatataaaggtatatacaaatataggactatatagagatatttccatgtttatattatatcacatataatagggaggaaagttgactaacagtagattaaggcttggcctttgaagcaaactatctatgttccagtcttggctctagcacttagctttacaatgctggactagttattaaatccccctgaacctcagtttctttgcatataaagtgggaagaatcagagcccctcttctgagaccttgttatgagaaataaatgagataattcacctgaacatcagctccccaagggcaagttctttgtgtggtttacctcatactctccccaaaagctatgatgcatgtgcactgatcaatcactctctcgcacctggaccctgtcaccaatgacagctcacactttccaggcagcagccaagggcagaggcttcaccttcagccatggagcatagtgagctgtgggtgtgacctgtgcccttggactcattagcacagcagtctaacaaactgatctaaggtacaactggcaagacgaaaaaataacccattgagcgtatacagggaccaaaggcaaggaggcagttggaaaagaagaatgcccctagcctctactcagaagcccaactaatcctatcagcagacagcatcttcagaggtcagaagaagacagcccttgctattggtttccacagaattctcccaatacttgccaaagaaatctataaaggcactgctgggagttctgaaagaatcaaagatgaacaaaaataagaaaagcttcattttcagcacctactagcaataagcacttaatatactttgctaatcctcataactctgtaggatcccctctctgaaagagcgcaaattctaaaaaggaagttaagacatgcacctaaagtgttattttaacaacaaatacaagggatgctttgtgaaagaggtagtcttgattgctgggtgaaatgtcagcaggaagaaatatggaagtatacagcaagcagaaacagagggcatgcctcatggtctcaaaccagtccagcaagcagggactataaagtgaggtagcaggaaataaggctggcaagtgctaaggacagagttaagtgggaagagtaataaaatttatattttagaaaagatgatacccagggggagtgtcacctcttgtgggaagccgcattacacaccctcttctgtgctcccacagcatgctgaaacctctctgacaccgttctccgtggcattgcattgtctcatgtctgattttgtggaaaggcaacagggctctggagtgtgatagacctggctcaaaacctaacttcacccacactagctatgagacctcaggcaagctctgtgctaaatcaagctttcatttctgcatctgtgaaatggatgagatgatctcaaatgagatagtgtattaaatttgtcatgtagtgtgcctgccatgtaagaggcattctaagatttttaggccccttggtccctagttctgagcttcttgaggtcagaggtctgtcatatgcatctctatatctatcccaagggcatgcacgttaactggcacatggttggctaaataaatgaactatttgcaactgtcacccatacacatcaaaagatgggttgtgcatctggtagacccaaagaaagacagaccagaagtctgattttcagtccaactcaccttcctgacacgcccctcgttcatagatatattcttagcttcagatattgtaaagtttcccccttcaatcttctcccatttagacacagccctaaaatcaacccaaatggtatcatcttacaatggagtttggaggtcagctcttaaagcacaagagaaaatgcaactcataaaaattactcaagatccaactctcagattattttgaatgggcaagattggtgaggcctgactgagccctactcatccttcagttctcaactgaaacatcacttccaaagaccttctagggccccccaaactgggtaacactccttctgtgtgtcccatagtggccagagcttacccaccacattgcacttatgactgctcatggtcatgatctgttattcttatggaaagaatgatggcttacctgacatctgctagtgtttcttccttgtcatggcaactgctcaatatgttgttattgaattcatgaatgcatttacccaaaaattgatcaaaaatgctttctttttattctttttccttctactaagcaatgatttataatgagcagtgaggacatccaccacagctgtggtttcctacacacagagggaaagcaatgagaaggctggggagctcacatttgttgagcacctcctctgttccattcctcttacacaagttaactcacttacaactcctgcaaaccctgagaggttctacctactttcgacttgacagaagtgagtctcagagaggttaagtaacttgcctaaggatacagaaccttaaagtggctgagacagaaggcaaattctgaagccttcaaagaaaattaaggaatgtatacaaagaaggcaaaagattccaccaagaaacttagacactagataaaaccaaaataaaattaataacaataaaacatactgcattctgtccaccaaaatgcaggaaatgagctggaaaaaaaaccccagtttattcttggccttctatttttaagaacttcaacagaatccctgactcgcaatctgaaagacaaagggaatttttttttgctttgttttgtttttgagagggaatctcactctgtcgcccaggctggagcgcagtggcgcaatctcggctcactgcaacctcctcctcctgggttcaagcgattctcctgcctcagcctctgagtagctgggattacaggtgcatgccaccatgcccagctaagttttgtatttttagtagagatggggtttcaccatgttggccaggctggtctggaactcctgacctcaagtgatctgtctgcctcagcctctcaaagtgttgcgattacaggcatgagccaccattcctggcttgtttttaaaatttgtttctaaaacttaatttaaatttgtaatattttgaaacttgaaacaacacactacaaatctcaagatttcatgtagctagaccaagctgatgtagaaagtagagaatgacaaagagctgttgtgttctgggacctggcaaatttggcagggtgggagatggagaggccagcttcatgctgggagagaaggcaagggcatcttcacaaggccaggctgaggacaccacttcaaagaaggtctagagtggcactttgcaaagtctgttccctggaatgggtccaccgttctctctctctctctctctctctctctctctctctctctctcactgaaacacacacacacacacacacacacacacacacacacagcttcatctgtttgtcgtttctgtttttctaaggggaggcattacagcatactgctcaagatcacttgcctgagctttaatcccttctccaacttattgtgtccgacaggctgcatgacctttagcaacttatatcacttctccaaccactggtttcctcatctgtaaaatttgggtaacagcagtgcctgctttacggggtgatgtgagagttaaatgtaatgatgactgcagggcatttagcatagtgctgggcatcctggaaatgctcaagcgtcagctactgtactaaaaacagtagtattgcataaataataatggcattataattcagtaggttttcaaaacttacttgatcaaaaatctttcattgattttaaaagtcacaaaaaaaaggttgaagattgcttttccagaatggaaaaattggatactcccaattttccttatcttggaacacttgaaccacaaagaaagcaggtgctaatctcagttctgctaagaggagaatgagctgaaacactgcccagcttttcccatgcataaggggccgtgtgcctgcctgtacaccctgccacccaccccagcaatgtcccacttaacctagcagagccacacactccccttaaatgtcaaagctgagccattgcccaaaaggcaggagaaaagaaagtaaaactggatagttatgaactggatatcacaataatccttggaaatatctaaaattatctttcaaagaaagtcctttttatcaataactccctaaaaactgagcccagtgacttgcttacacacatccttaagcagtctcaggaagttgtaactcaatgcggagatctcatgtgctatggctagaattattgattaacccatactcatttagctcttaagtaaattaaaagaccactagtcttaatgtctgtttatgtccggaatgtttcaatggaactgtggattacccaagaagtattaaatgatgcatgtgtgtgtgtgcgtgcacttgtgcacaacaggggacatgaaccccaaaacccccctcaacggcttcggtccatttacaggcagctggtcacatcctgacaggcagattctgaaataggagcatcatcaaagggcaaagagcactgacctccagtatttaaataggttccccaaagctctccacggcagtgtcataaagtggaagcttctagaccctgaacttcattttccttctcctgccctcagtcagggagataaagaatgaaactaagcaagcttaaggggtgattctgtccacagtcaggggcaaagtaaagataagcaggcaaacagcgagaaacaacagtgaggtgggagcaaggatgcttttaagggtctttatttgctttttgatggctaggagttcccagagtactgggcacacctgcagtcaaatgtaagcatcaagtactccagaatcaaacagatgatttggaaattgtttctaatagcctggataagtgagagtcgattaaacattgatgctaaattatgaagcgcctggcagtctttcacttttttaaagtgagtatctttgaacaacagccatatgggtgctgcaataatgaggtttataaataggcttaatattctaacaagctggctttgaaaaaccaaaacttgtgctctgtttctaagttgacagaaagatacctcccagttgggcacaagatttcctggtatgggaagttgaatatgcaacaactgcatacacacaatgcaaattccagttctgccttcagtgttctccagggtttctgggtaacaatgactcactcttctccaagtcctatcctgtctccattcttttctccagagaccactaccaccgccgacacacagaccgcttcggaaagcttggttctcagccctcagttctctcaagggataggacattgaaagacaggctcagataaaaacaaaatgcacagcaaggctcgtgtagttaactacaggttctcatgagtacagatcacatgtgtttcactcatgggaaagtggactgagataaaatgtcacaaataaccatgaaatgagtgaggatctgaacgatcatctgatcctctggttttgtttttcactggcatgcagggtacaggttggaaagaattggatatctctagaaacttctaatggatctcttacatcatttgtatgaattaatctacgcgctactgagaatggaaagtctttgtacatttcttctcattcctatcagtgatttcatttccatgatgcatgtattaaaaactaactttgcaaagctatccattgcttcctggcctttcccatattttgaacaagtaaatgctaatgagaaaaatatatacataaactggtggtctcttgacaccttccacaagaatatttaagggtgagaaaggagataatagagtaagagaatctcctgtcttactagctcgaatatttaactgatgagctacaaaatgaaattccatgtgcacaatgatttcattttcctgcctggccaaaagtccaaagcaagacaacaacaacaacaaaagattataaaatggaaaaaaaaaaaacctcatttttaccttgaacagcccaatcattaggaaagaaaaactaacaaaaacaaaaattctagggaatttattagctaggttttctagtagagaaaattgttctacagactcatactgtcattgaattatcttagaaaaggaagatcatattcagagatagccagctcccaaacatagaggactccagtatgtttagccaaaagtgatggatcaaattcacatgaaggaagcctttgacagtgtggtttgggggtggggatggtgaccctaaagaatgggagaatgcaaatctgaagcagagatgtaaataagacagtcaattttttactctttcttaggagcaagtgcatttctatctagtgctggccaggcagtggaaagtagagaaacctaggagaaggtaacaaactccaaactaaacaaccccacaggaagccccacctggggctacaccaactcacatggcagacccaggctgccccagtgctcctgtcctcccaaagcaagccccactcttcactgatctccctccgcatcccctcggctgcctgcagacagctggccagaaacagaaatcaaatctgctgctcatgcctgcttctctcatgagcctggattaaaaattccagcacttggactcctatttaagaagccctaaatgggacccctccccaaagaaagctgaactcttcctttggaaggcaagattttttttttagcaaaccaaacacaatttcctttccttctagctaaaagccttttgctcaaagctgggcaatgagctaatcagtggcaccaaggaaaaaacagggaaaggttttgagagaaagaaaatagaaagcaaatgtcatgcttgtggaagcccaagtagtacgttttttgcataactgatttagtcctctattcacgtatttacaaccacttgctgtgttataagtactgcaaaactgtgtgggtgggaatggaagcaatttttacgaccttcttcctgggagcccgtctcctgcttaaataaacatcagtaagaaaagctaaaagcaaaactatctcttaatatctgtgacggcactgccaaagtagatataaatccaaaggattaagacaaaatctcactcttcacagatctatccctgtaattaggggaggagtagggttttttctaattgaattattcacagagctgtttcaattctctactttgtttttccccttgtagatttagccagaacaaaaactgtaatcttctgctgaatttcacttcaatgtcagtctaatttttctaagtcttgcctacccactcctgcagtgttccttccctctccccactctgtgcccttcctcccaactcttatcaaaactgactcctggcagaaagcagctgctggtcatttacaattccaggtgaatttgaatcagtgccatggctccttgggagcatgagtccttcctatttcatccaaaatcctatcttgtagtagcatcatctatgtaagcctccctaaacacacgctctataaatctcaacaatttaaatatggcaaaatgagcccattgtccaaaatacagggaaaaaaagcgccaactagcagatgcatttcttgggaccattttgagctcttctgtcaactgaaatcagatgagcattggaagcaaattttcctgagctatagtagttaccttcactgaaactatgccaaatctcccagaaattggtgctttgaacgattctttcattttttttttaacaatgactaatttcagtcagtgattttatagtcagaatggcagttctgaaacaacatttatgaggcttgatttatgataattaatccttctatttcactaatgagctaggaaaggccttatttatgaaagtgtttaaattcctcacagttagcagacacggtttccagtgacacccacatggaatggtatactaaatgcaataaacttttgtgggtcatccttagacaaaagtcagagagacaaatgaaaacaagtggcaggatgtcagtcggaatttgaactactcctaaaacatctggaaggagctttcaaagattaatctttcacttccatatttactagatgtatctctagagtgtaggaaaagtcttggttatttaagcattttctttggttggaatctggataaacaacagtttaatggtctttggatatccaattgtgactttcagacaaaatgctccatgcactctcatactgattgtctaaattattgctcttctggtggccttaagggaaaggaaagctgtattttggcagaatattgaataccgggtccttgcaatgggtccttggatttgggtagaaatagaaggaaggccttaaagagcagagaaagggcatgaatgggcagaggtggtacagtgagtgagcgctgtggccagaactgtggactgctccaggagacaaggcccagccatatccatggaggcacctctggagcaggcacaggaggccaagccccctcaatggagcctaaactgcagaaaggcctcttgccagagccagagagcctccacgcagccaagcttcacttggcccttctgcagtgggctaggctccaggcttcaggtctcagccccatggcatgtgccctctacctcccagaaggtccgtgatgagggctcatcccatttggctccctgggtcatggcctctttctgcccttggaatactgggaatgaccatactggtttctgtctctgttccaaacctatgttttgatgggcatgataccaagtagtcaatataagtttcaagtaaagttatgattattagctggcctaagtaaatgccaatattttgaacaagtaaatgccaatgagaaaatatacataaatttttggtcttctgaaaccttccttcagactatttaggggtcacactaaactgtattctctacttacaaaatttatagatatattaatttggcatcattcagatatacacagaattttcctgcttactttgctgggctgtagattatatctccagacctgtttaatctccagactcacttatccaactgctcttgccttccccatatctcccctcatagtcagtatgtcccacactgaactcatcccatactgaactctctatcccccattcattctgttcccactcacgacaagacctgcaaacatgttcctcccttagtgatcctaatctaagaaaaaagaacctggggattcaagccaaaaccctgcgagttgaccttaattccactttcttcctcatcccccatatccaagtcctgttggatctacctcctaaaaagttctcacatccatgcctactgataatggcttccccttgctgaggccccctggtggatgaagtcggacctggctcctctccagctgtgtctggagccttcgcctccttccagtctgcgctgcagccacttggccttctttcattttctcagaggggccatgctccttcttgtctttagatctttacaggtataaacatcccaggccttaaatgcctagaatacgcttccctaactctacttaactacaatttacataatcttcatgtctcagcatgcgtctcttttcctcagagaagccttctctgaatcccggaccaggtttgggtcctctcttctatgttttcacagctccctgtgctggacttcttgcagcactcgtcacagcaggtagtaatttatggaagtattgtttaatatattcctctactgtaggctgaacatcccccgagggagggagcctttgtcttgtttcccactaattccctggtgcttagcacagcaccaggcacatagtaagtgccacagaaatatttggtaagtgaatgaatgactgaattttctgcatacagatgtgtattccttcaactatatgaacaaaactcattacctaaaatgatcaatttttatatcttctggatggaatgattctctttagttttttcataatctcacaagctaggaacatctagctttgtcttacggtcattaagactcatttattttgtttaataacagctgtcaagaggactctgtataaacagtacaataaaagcctgaagaataccaacactttacacgaattcagtatacttcctccagaaatagagtgttgcatttgttgtagaattcatttttattgctagtgggaaactccgatgatggtcattctcaaagctgtcccagtctattgtaatgtgccttatatttgttaagttggtgcaaaagtaatgcggtttttgccgctaaaactaacagcaaaaactgcaattacttttgcattaacctaataacaattatttcttttagttgtttctcaaaaatccaggagataggtcctataaacacttttcttccatgtggggaaatggaaaccaaggaaagtagtcttccatgagccaaagaaaattaaagattgaaaactagagatggtaatgcagaaacctctctgctgagggctgcttcccaactgacagaggaatgctgtaaagctcagtcaagatattaagcactttgctgctaaatattgagttgtaattaactaatacactagcataaccaaattacaataatcaagtgatgatgtactagtaagctgcatgagtattcaagtaaagaaaatttcactgtaaatgtgagaatctacttcttttgatattcacatttttcccctttaatatacattaagaatgtatttcagagagatttaacttgatctttattaagaaaagaaagactcgaaaacaatccttcaaacacaaatgtctcccttctctgaatcctagcatgtagcgtccacatcacttagtcagcaattaattattgccctcttttttgttgttgatttttaaccttttcacatgtataagacgtatcttgtttccctcaatatattctaagtttcctgatggtaaggattttcttctgatattttcgtatcccttctgaagctcctagcacctagtacataatggaaacccaataaaaatatgctgaacgatctggcaattccaattgaatgggagagtaaaaggaccagttaatacattaaatatgtaatctgggggaaacaaacaacaattttttaaagtattctcctggaattgcttttctggtaagattcaggtcaatgccctcttccctgggtcatctccttgcaaggatttaataataagaaccaagattctcagacccaccactccaggccaaaggtctctccatggctccatattgccatcaccaatagctacttgaacattccagaggctaccaatttaacatatctatacccaagtttatcattctgctttatcctagcctgctcttatctccatagtccctaacgaggcaaataacaccaaattcactgagacatctaagctgaaagaactcagaagacaacagctcctctttctctactctaaatctatgttctgtcaattctcatttcaaacatgccccctgttctttcatcttcagcagcgctaccccaaatcaggcatcttccccaactggtctccaggcctcgagtcgcatctccaatctgtcctccaccctttttccagaattacaatcctaaaattcaaatctaattttgttactctccagcttaacatcttttaacaatttcttataactgaaaggataaaacacaaacttctaaaaatattatgtatcataaaatatatatatatttctctagaagatatgaaagaacacctagaacacagcacttttttgttgtatagtaaaatgtgttcaattactcacctcctcaaactatgagcatacataattttgagtaaaacaaaaagtaaaatttttaaatgtcatgtatcactacccagcctctgccttcctttccagcatcacctctcatgactacacttctatctgtccctcagtactgcactagatgagctgcaagaggacaccacacattaagcttttaaggaaagtaaggctcttgggaattgattagtaggagaaggtaatcctgttacccagaccaattcaggggccaactacttctgacggaacggcggtgggggggggggggaggagccgggggccagtgagggggaggtggtgagatttatctccaatagctccatgttgcatgacagcaaacagacccaaccatactctctccttagggaattctcaatgagtggtgaacatagagaaggttcactagaacacaagccatatctcagttaagtgcaagcagctttgccagtagtccctaagaacatctcagaaatctcaactagtttattttgggctgcccggaagactccttgtttttctctcatctttgtaaaaggtttctttgcatttttgcaaaaggctgacatcaatgaaaagagtctaagcaagtttcttccttatgactctaatgagtctcctagaatgaatacacaattcactgtagtctgtaacaccttctctggccctcccaggtagacgtagcttccttcgcatccccctggaactatattcatcacctccaggtactcatatcagtctctgccactagccttcaaattgctgaaagttaagtaagtatcttacctacttttgcaaacccagggcttagcaaactgactggcacctaatagacactcagtaaatgttaattgagtaatcccatgttgcctgaacactaattatatcatttaaaagttcggttatatagaaagaaaacacagagagggcttaaataagaaatttaaaaccaaaggtccaggctttgttgcctatggcttttctcctcatctttgctgtgtaggttggaagagtcacttaacttctctgtacatcaatagggtattagttaagactgtttcagagaaaccaaattcaaaacatcctaagcaaaaacagagtctaactagctcatgtagctgggacagctgacagaactggagacacatctacaggaactgggacctccaggagctgacccagggattcccactccgtgttttctgcttccttttgagcactagcctcactgcctcctatcataaaaggtcttctctatgaggtgggaaatggatccaatggcagccccatgaaagtccagaagaaaagcaaagcctccctttcccacagccaatacagaaatgtcaatgagggactctaatgcttctgtttgggatccataccctacttgaaaccaacttttattacctggaaggtgaattctgtgattggccagtcctgtagtatgctggggtgaggagtagagtctgttagcatagtaaggtggatgggaagcttgctgcatagacaaaaacaatagttgttgcagtctattaacttaatagccattctcttgcctttatattaataatgttactttaggtaatgcaaaaaagcatcatcatcttcatggagtgttatataagcataaaatttattataccaactacctcatagttgggcaaaataaatatatgagattagataattataattgtgataataaatgccaaggaataagtaaaacctgctctcttgctctcagtttttaaaaaatgcagcatagaaacacgtttctgacatcatctagcaggctggcaatagaaaaactttttggtcgggacccaaggtacagtcataacccaattgctcaaacccaaggagccctatgaggcttcatcaggggtatatagaacacccacagccctgtttccctgactgaaagattctgtaacaaaaaagtaattcagagggacacaaaaaagtaattcagagggactcaaaaactctatccagtcctccagagaaaagagatatgacaacagctcattgggaggaactgaggtttatggaaaaggaaaaatgaggctcctctccaaagagtaagaggacagcatccctctgagagttccaattaagaaagctcaggtgtgcagtatttgttttcttctcacttagagaaatgggagcatgtgcgtaagcagcatcagggccacagagcaaggctgaggaccagcaccctccctggaaatcacagctagcctctgagcgttagtgtgcagaacctcgctcaaggggcatgggcgccatcatcataacagacacctgggcttgcaggtgtctataatcccagctaagatagagtgtttaaaactcacatctccaatatttgatgcactgttagtatgctgatgatgctacaatgctaagagttattcctaattctttcttagagaaatatgtaaaacagctctatgtttcaaatatgtattactgtataccgggtggaagcgtaggcactggggataaaaagcaaaccaaaagcaagtgaccaaagcaaaccaaaaaccctgtcttcatggggcttatattctagctggaggagacagacaataaacctaaaaataaataaactatacagcattcggatggtgggaagtgctagagaaaaataaagcatggcagggtatgggtacgggttggaatgtataggggacacctccctgcaatatacttggctgttgattatttgcaggtgataaccacagaaatcctcttgctctggtaaagactacctctcaccagtgtgaaagaggggctataaagaagggaaagagaaagcccacatgatcaccacagtgggattcagccctgggccacaactctgccacacatcttgcccatttcccacctcagtttagatttctgtgccccaacctgggcaatgatgttaataaaacctgcatcctagctagctcatggctcattgtgttgacaggtctcacggccataagctgtcctaaatatatatttatcttcattttgaatatttaaaagctcacatttgggtttttatgcttcaccacctattgattgagcatctactatgtgctaaatgctgttctaggtattgcagtgagtaagtatgtgtcctcatggaacttacattctaatggaggagatgaaaaattcaacaataaattaaatacgggcgataccaacaagaaggagatgcgataacattgaataatccaggcgtgagttgatgatcacatcctgaagtgagatgtctctcagacaagctgaactgaattcctgaccatctgtggtcacctacagagccctttctataaaggtgtcatggtaatatattggtatgaaaatccaattatggtttgaggctttctaaaatgttgaaagagcagcttcctttctcttactgacaatctgttgtgtggacaaatatgcacacacccttccttcccctaagggtttctattttgtggacggcaaagtgttattccaagttgtggactgcaaaaatgttattccaagttgtataaaagagtgtgtgctttggtttccagagtctttagctatttattctagcactgctgttatgtttaaaaagaagaagaagaagaagtggtaaggatcacatactggtaaaaatatgtataataataacaaataatagcatctccttttcaaattagaaagtgaagctataatcaccccacacttttcatgttcaaaagcactaggttctgagtagatacaagagactagaaaatgaaaatgtagttacattacactgcaacaccttggagagagaagcctagcagatatgaaactgagaaagctacacgacgcagtgttgtaagtgctaatgcttttccacacaagttcccgcctcagcattgctgatttgaccaaacacttgtctctagcccaaatgtctccatggagtcggtttaaattgaaaagcagtccaagagaagaagttcctgggtgtatggatatgaatccctctagtcagcatggcaaggaatccagctcgacaacgctttcacattatacactttgggcccagactttgtggacacaacaaactttctgtgtgcagcacaatacaatcggacgtaatgttcactaaatataacatgagattactgtaaacaccactccgagagctgctgcgttgcaggcatctaaactgtcaggaaagcctgccagccagagacaaggtttccaaataaatttacagtctccactagcggtggctagacaagtcaaaaatcaaattatttggcatggtttcccattgaaatcaatggcaatgaagctcacttggactatatatggaatggcttttataaattgcacctgtcaataaggaccccttaaagaaacacatactaccttaatgcttctccttagaaactttgaatatcaagctaacttagatcaacacattttttatttgtcttttgtttgtgtgtgtgctttcaaaaacaataacagcagcaaaacaaacaaactggcaggaagctggttttcccatcagtgcccttgttagaaacagaatgtctagagaatatgcttggagaaaagccatatttttaaaccacactagatatctgatgccaaatgactgatgaaagtagtatctagtagtaatggaaggtgtctttgggacctgcccagtgactgaggagcaagctgtgaatatacagctatccctcaagctcctgactggagtgaccagcagttcactgatgatgaaatatttttacagaaaataccatgtattttcaggtcacctctcctcagtacccaaaaacagacagaacccaatgaagtgaatgaaattcagagatctccatccatcagggcaactagaattctggccactctatttcattgttcaaatattgcaagaaaaccccaatatcgtttctgccccccctttctccacaagagcctttccttctagtaaacatttctccaccaaaaagaaccccaggaaatatcagaagttcgactgggctaaggagagggaaaaaagaaatgtagcagccagaatgcatgttgaattttaactgttggtaagttcttggaccacctgcccaagtgtatgcaagcagtttgcagagaaaaattcttccttcaattaaaagtccctgtctgggtctcaaacttttctccctgggcaaaaaggatcagaaacacctcattgagtattgggccaccataactgactcatcaaaggacatctctccttccccccaaaaaagcatgacttggaacagcaaggcattctaagacagaaagacaaccctctctgtgttggaagaaaagtagcagtgactgtaattaacagagcagcagttgtggaacttctagggttgtatttaaaggcccatgcaggaacagggtgagcagtcgtgactgcggctgtgtggtaaaataaggatgggagcgggaaatggggcaggagaagtaaataggtatacttacagcccgcggagccgaagccagattttctcgatctgttccggttgcaggtatttcagagagttgctctcaaattcttcaatctccttggttggcgactccatagctgcaggtaggtgaccactggcggtgaagctgagatagtttgggctgtcccctccccgtctcctcgcccagctcgcgatgcccagccaggcgcggcgcgcgtttgcccggcactttctcggcgcgctcccccttctgcgcccccagactccgacttagagcggactccgatcgcggcaaaccatggccccaggtgcgctccggaggcagctgcgggaaccagccatggtcccgggctaatgcccagggataagcacagggatagggatagagatagggattgggattggactccagctccaagagaaagcacctcgggtctattcgtattctccccctacccccaaacaaagccacagaagcgatcagcgcgcagctaaagggtttggaggtgaaaaggagggctgggtggggaggagagaaagtgagaagggagagaaaagcggcggctgagcaaagcgggagccggcgcgggcggtggggcctgacccggacgccgcgcacccggctccgccccgcgcccagcgccccgctcactccctggccgcgcctgccttcgcgcccctctgttttctctcacttaccagcagctctgctgacaagcgagaaaactgacaagtgagaaaagtcgtctgtcagcgcccgggctggtgtctgggctgtcaccgcgggcgcggagggaggggcgcgcgggcaccgccgtctgccgggcacacgctgggctccgaccccggccgggcacactcacccccgcagggcagccgcggccaccaccgacctgcggagctgcgtgggcttccggaaccctcacctcaacaagagctcggctccgcgcgcaagtaggagggaagggaaatccttatcctcccggggccagggcacgcagaagccgcgaggcttcgcggaggttgggcctggaggtcccccacagcctcactctcgcacccgccacagaaccggatccattttgaaat

SEQ ID NO: 56 - DNA, 545752 bp, Homo sapiens
gggggcaactaacttttagagattgaaaaaagtggcaatgagaggaattttatttttttttaagtttgtgtcattttaattttggtccaatttagacttttagagacttataccataaaaacacccctcttgctagtttgttgctggcgtctgggctgatcccacatacagcaattgaaaagtctatacaagaacaacaaagaggaaaatcacatacaactttcatttcaccttggtggagtcaaccaggatagtacctgctccaacagcctccaagggtcttggaggtgtgtcctgctgtggccagtgggtgctgagaagcagataggtagaccctccttcactccctctcttcttcccctcggcctattttctgttccagttatgtgagatgttctgaatctttttcattttgatcctctgatccagcatcttgtaccttgcaggatgctcatcagttttctttgagactgaaggtgcataggagctagatgcgtaagcagggcgtttaaaatgacgcaaaggaggcttgatgactggcggccatggaaaggaagacagacaacggttagcctcacccacgacatgccacaacctaaatattgtgagcaacttcctctagacctgtttgtttcctccaagaccaggaaagaagcagtttggattctccctggaaaccttatggcagatagatgaataagcacgttaccaccttggtcattcagttaaaataaataaatggaagaaatttctagagatacagtgataactgcagtacataaaggtcctttgacaatgaatggatggggttaagggagtgagaggaagcattggggtcatttctgggaacagcaaagcaaacaaggtgaacacaggtatatcattaacagcatttagcattgtatgtaagcttttagtgtttggaaagtggcactcaatccccaagggatacttaaaagtgcatcattaagaaaatatttataaaacacatataaagatcttgtattcaaaatataaaaagaattcttaaagctcaagaaaaagaaacaacccaattttaaaatgggcaaaacatctgaacagacttcacaccaaggaagatgtatgtgtcaaataagcataggaaaaaatgctcaacaattagagaatttcaaattaaaacaactatatgctactacacacctccacaatgctaaaatctaaaaaacttgacaacaccaattgctggcaaggatgtaaagtaatgggaactcccattcttgctgattggaatgcaaaatggtacagccactttggaagacagtttgaccgtttcttatgaagctagacatagtcttaccatgcaatgcagcaattgtgcatcctaggtatttacccaattgatggaaaatgtatgtccacataaaaacccacacatgaatttttgtagaatctttattcataagtgccaaaagctggaagcaactaagatgtccttcaatagttgagtggataaacaaattgtgatacatttatacaatggaatattattcattgtgataaaaagcaaattaactatcaagctatggaaagacatgaatgaatcttaaatacatattgctaagtgaaagaagtcagtctgtaaaggctgtatagcatatgattccacttatacgacattcttcaaaggacataactatagagatgataaaaacatcagagattgtcaggcgtttggaaagaggagggatggttaaataggtgaagcacagggaatttctagggcagtgaaactctcgcatacaatactgtagtggtgtatatatgacactacacatttgtcaagacccatacaactttatagcacatagaataatccttaatgtatgcaaataaaaaaactatttaagaggtcggaggaatcctagaatgaaatgcaaattgtaacaagacaatgtaaatgcattgccaatgtaggaaacaacctcactgaagagtgggggacaagacggtcatcgaagtaaccttgtatatgaacagaatctgcaagactaaaggccgaagaagctgtacacaagcactctattctagctgataaaattgtttcccatggggctattggttatcaactctaagaccactctacatgtataccagaattcaacaattacgtaaacagagggtggatggtgagaaatgttggaggaggttagaatggtccatgtggtaatgaacttgattatatcaatatgaattaatatttagcttaatagagatacaggtgattatatataaaatacttatagatatgtgtatgtacatgagttggcattcacacatatattgtcttgctctatcagctgaaggggagggggtctaggaccaacgaagtcactacaaatctagaagtctcagcagcaataagcacatctactgccctgatcttggtttctaaaaccatttgctaatagcagaaaccagggctccttgcagaaatgactgattccagaactcggacacaaaatatacaagaagtacctgaagcatcttgtagagccagaaaatttgaagtgttcaaaaaaaacaaaacaaaacaaaacaaaaaacaaatacaacaatagacaaaggagccctgaatgaaagatctactgaatgatcaaaattgaatcaaattgagcaacaaaataaacaaggcagtattgcattttaacccgaagtataaaataaatatccatgagtccacactgatataaataaatgattgaataaataaataattgtgggagaataatttatatacatatgcctcccttaaggagaaggagcccttagtatggattggacaaagtgacatccttccaaaaagtacagactaaaatatgagacaggcttggcacggtggctcatgcctgtaatcccagcactttgggaggccgaggctggcagatcactggaggccaggagtttgagaccagcctgaccaacatggtgaaaccccatctctactaaaaacacaaaaattagctgggtgtggtggttggtgcaaacacctgtaatcccagctactcaggaggctcaggcaggagaatcgcttgaacctgggaggtggaggttgcagtgagccaagatggtacacttgcactccagtcttggtgacacagcaagactccttctcataaataaataaatatatgagacaaaagagtaactttatatagagaaatctagtaaacacttcttccaggggatcaaggttgacaccagtggcatgtgatgaaaattaatattttgtgatgaaaatagaactttacttctggagtcttcctcccaaaaatatataaccccattctaaaaatgaagaatatcaaataaattccaattgagagatattccacaaaatatctgacaggtattcctcaaagctgtcaaagtcaccaaaaattagggaagtctgaggaactgtcacatccaagaaaagtctaaggaaagttgatgactaaaagtaatgggttatcccggatgggaccctgggacagaaaaatgacactgggtaacaagtagggaaatttaaataaagtaggaacttcagataataataataattaataataataaggacagcatctaatctgcagatctagacatagaaggtaaaatactcattgacttttcctccccctgctcctctctgtgccagcccccacctcatcccttctaggttctgctggaaagtgtttggtcagtgagataatgtcaacatgaataaaggtgaaaacaagtcaaatgatcatcaaaaacagatgagatataataactaggtgaaagtgcaaggaaacagagccagttgaacccttgctcactggctttccctgcaggctcctccactgtcactgaaaaagccagtgcaggagcaggacacacggtggatctgctggaagggccaaggtcagggacccatctgtccaatgcctgaggcttccttgtgaaaaaccagctctgcacatctcttccaataacagggacatgcatggtgcttgtgaccaaacaaaagatgagaaacaacttaaatgaacaatcatagggaattggttaaattctggtccattcttagaatatgctactgtgatactatggaaagatgatacagatgactactaacaaaaatagaggttcatgtaatggtgttaaatgaaaaagcaggatatattatctaacctcattactagaaaatataaacatatgtgcataggaaaatctggaagaacatacatttaaatcatagcagtggttatctctgagtagcataaacatggctattttatctctttggttgtttatactttctaatttttctatgatgatcatgttctagtcatgtaacttttaaaaaagaaacatactagtaaacatttcttctatagaatcatctatcagagttattctacgaaatcacacctgagagaaaatcagtcaaaccaagttcaccttggaccttagtactagacatctcagacaagccatagctgagtacacttttcacagcatacagattaacttcatcactggccatcagagaaatgcaaatcaaaaccacaatgagataccatctcacaccagttagaatggcgatcattaaaaagtcaggaaacaacaggtgctggagaggatatggagaaatatgaacaattttacactgttggtgggactgtaaactagttcaaccattgtggaagacagtgtggcaattcctcaagaatctagaactagaaataccacttgacccagccatcccattactgggtatatacccaaaggattataaatcatgctgctataaagacacatgcacacgtatgtttattgcagcactattcacaatagcaaagacttggaaccaacccaaatgtccatcaatgatagactgaattaagaaaatgtggcacatatacaccatggaatactatgcagccataaaaaaggatgagttcatgtcctttgtagggacatggatgaagctggaaaccatcattctgagcaaactattgcaaggacaaaaaaccaaacactgcatgttcttagtcataggtgggaattgaacaatgagaacacttgggcacgagaaggggaacatcacacaccagggcctgtcatggggtggggggaggcagaaggatagcattaggagatacacctaatgtaaatgacgagttaatgggtgcagcacaccaacatggcccatgtatacgtatgtaacaaacctgcacgttgtgcacatgtaccctagaacttaaagtataatttaaaaaatggtaaaaaaaattaaaaaaaaattatgctacttctctttttaaaatacttatgaggtacccatactcccaagtatgcctcataaaagccttcaaaaaatatttattcacccacttcttagagtacctattgtgtgctattgatataacagtgaacagaacagacagaaatccctgcctttatagggcttccattctaataagatccttcgaaacttttaactcactcacagaaataaaaagtgttcaggtataaattatgctatggctacaagctccttaatacccatgccaacttcacccattgcaatatcctaacgtgaagtaaagagttgcagcaaatggctctgttgttacatagtaatatatattcttctatattattataggtttgtttattagatctcagagtgcttaattctgtttcttagggtaaacaagaaattatggcatcaaattgcctaggaacaaacataaaagcagtgccgttaccctggagaatggtgtagaaaggggagagggcttcagcttaaaagcagattgttgcaatgtctgagccagctgattcactgctcttcaagtcaccgtccctctccatattcattctatttcactactcagcaggaactcagccaaagtattactgaatttcccacttctcagcatgaagaaacatttaccatttgctgggattctgattgtcagaacaaaacctctccttgccactggagtcactgcaaatagagttgaacctgctgatataggtagactccccactgagtttgtggaaatacttatatggctgctgtcaccctcactcaaaatgtgggataaaggaaaatttcgtacattgctgttttgtatgcattcattgcctttcccctctgcaatggattgtgatttggtgacagagcaaaacaccagagccaggcatgagggcaccatcttgaatttaatgtggaccattcttctggggtcctggtatggccttctgagggtaccctcattaattgtctggctatacctaaactatcggaaggggtccgaccctcctcctttcaacgactgggcacttcccacagctgaatccaaccagtcgtacaatccccgaccactagtggagaagaaccaaacctggatccccacccctgccacaaataaatggttgattatcagcaagttggacacttcttccccttggggatactttaaaaaagtctggcctcatctcttagaacaatttgcttggagaaaatgatctaattagttaatgaagattgtgacaaaggcacatatctcagcacagtacctgaacttgggaaaattatctatattacttttaaacatgcttagaaaaacaaaagttcaagccaaaaattgatacatcaccgtcctttattttataattatgctccatgtttgattttcataaaagcaatgctcttttaggagttttaactctcaattgtttaattatttttcataaatataacaatttctcccaaaggtatctatgattttctcccctttcactgccacaaccagcctatcttttgttctctctctctctctctgtctctctctctccattctctctttctctctctctctctcatcatttttcttcgtggctacttttttgttttggtatggggaacagttgtacagaattatttttctccaggaaacaggttcacatttattcatatatcaaatacagctattaggattatttatattagtctactggaaaccaaagtgcccttcaacaaagctgtgtaataggtgtggttgtggggagagggtttcctcaatcaaatttaactgagttaaactagtatcttcacaccaggacttaccagcaccttaaataatgctaacatctattaagaatccctgagaacagccaatagcatgtagtttctctcaattttatttggctaaatagctcctttttatcaaggacatcttatagagtgaaaacgccttcagaaaaatggaattaatttcttatcatatggtatcacactatatcaagtcattaacccagtataccctgttgttttccactaaatgagagcaatcaagagagaacagccgctagtcctcatccacgcttgggtctggcctcattcccttgagttcaatatgatttcccatagcactggccttggtcctttcaatccactgtgacttcagtgtgacctttggaaccccacactgcagtgcagcagtatcttcaggtggaggttttctgaacctcttcaggtgagcatcacctcaaatggcaataatttggtctacttggagcttttgagtaaattctaatattggtagccttagttttaaacaaaaataagtgttggatatctgttttttctctttcaaacataatgctatgatatgacatttggaaaaagcactttctcctatagacactttctatctgcaatgtgtacacacacacacacacacacacacacacacacacaccaaaccacatatactaaactaacgaaattaaaataatcatttattgccacttaaatgttattttacatgaaggaaaaaactctactatacattctatttctaaaatcagtatctgtttgtggtagaaagcccttatcaaaatgcacaaaaaccatccaggagttttgaactgcaagggactggaatgttaacgtgagccccactgaggatgggacaatatgagatttgatcctgtgattttcatttcaggaaccgctgtggtaaaatcattgtaatagctgatactatgtactgggcatgtattttggctaaagtaactggccaaaatcacacagttagcacaaaggagtcttgattctggattcacacacatgcaatctgaattcacacccttcctcctatcctcccatatctaaaataatcttgtaccaaaatgcagagtaagttataataactaccaataataaaagagtcaagtcaaaattgtatctcatttatattattaacatttaggtatgtacctgagtcatatactggattattgaatacccttgaataatcaataattttgaagcaataatcttgcttccctgtaaacaaaagtaagtcatcccctaaccccactttaaaatagtttgtggcaatggctcaggaagtaactacattaaggtcctgacttaaagagttctcttaaataactgctttcatcttttccctcccttctgccagactggaatattaacaagtattccaaaactctaggccagtggagtctagccaggcaagctccaggactctttaacttggtggttctcaatcctggctgcatatgggaaccacatagcttttaaaactcttagtgctcaatttgtaccccagatcacttaaagcagaatctatgagggtaggactaagccttcaggaattgtttaagctcttcagataattttactgtactggagtttcaaaactactgtcttcatctctccaatcctctcattcttcatcttccatgagctatttgcaactcctcaccatccttggaagctggccagattcagttctggcactgtccccataggacttggacactttatttcagttttccatttaaaaaaatggaaataataacactcacttcacagggcaatggtaagaataaaaatatatcatacatgtgaaaacagccagcacagtgctgacacatagtaggtgctcattcagtatcaatttccatccctttcctcagatgaagacatttaggaactatctagaagatttgcaagtgccgggaaaatttagtagcagcatgctttcccaactagggaatttatttgcctctctaagacacaaaagccttatagtgaggccacattaataagagcctttccttttgtagaaatacaatttagcaactttaacccaaccaaaaaattactttcgtgccatgtgcgttagatgtagtgtcgtctaaggtgataatctattcttaaactcttcaaggtatatttcatattaaaaactagaatgattaagcccattatctacattttttatttttttgagatggagtctcgctctgtcacccagcctggagtgcagtggcgccatcccgggtcactgcaaactccacctcctgggttcaagtgatctcccacctcagcctcctgagtagctgggattacagaagcatcccaccatgcctagataatttttgtatttttagtagaaatggggtttcaccatggtggccagagtggtctcgaactcctgacctcaagtgatctgcccatctcggcctcccaaagtgctgggattacaggtgtgagccaccaagcctgtccccattacctacatttttaaagacccagattctccaaggactttacctcaagaaagtgagaatgctgaattctctatggcttccattttttcatcacacagagcaaagaatgcaggggacaggaagcttgcagtctgagaagctatttagaaggagctgagttgatcctgtctgaaccaaacggccactagtatggtatggaaagatgacccaaccagcatttccagatccctagagggatatgcatccatagaaaacagataaaccatgtagttttgctaccttccatgcaacctgaagttgttttctcccactggtggttctcaatcccgggtgcacatcagattgcttggggagctttgaaaagtactgatgcccaagccttacccccaggagtctctgaagtaattgatcaccctggagtggagcccaaacatcagtatgtttgtaatgcccagttatcctaatgtgtgaccaggcttgaaaaccactggctttgggactgagtctgttttgagagcaacttggtttatacttagctttagaaggataatggggcggccaacctgctccctgttcctgttgtctgggaatgcccaaccctcagccatgtgctaagattgtagaaacacaatttagcaaacttaacccatggtatgagagaaaattactctcttaccatgggcattagatgtagtgttgtctaaggtgataatctattcttaaactaagaatagatctaagacaggatcttagtgctaaggtctgtgacaggaaaatgagcccatggagaggcttttgggagaggtgggtggtcttatgaaaaaaaccatgggcttggggcacgtcacagagctaagctattactagctgtgaaatcctaagtaaataatctgttctagcactcagggtttggttttctttcttccttttttaaaatgagaatagtaactgccttccatggttgtggtgaggattttaaaggaaatataaatgggaatatgcatatgcagtacccatgtgccattgcacagtacacaatgcccagaatgttgtaggtatttgatatacagccatcattgttacacagcacaggaagacaaaaggtcatcattgctgcctcgtgatagcgccctccctggtggatcttcttattacaatatagaaaagtcacataattccccacaggatgggttttattacatgaaagatctcaccacacaatgaagagattaacttaatgaatttatttgtgaatatttggcagagaatacaccactttgattcacaaaagaccagttatttaaaatctgcatttgtgaaaatatatatattatgtatatattatatatatttttatatatatattttatatacatatatttctattctgctacctgaggaagccactttgctgaaactatgtgccattttaagcaaaggaaaaatggctagcccacattctaaaccatttaggcaatgcaaaaatatagtggttcattcactcactttggttttgtttttgtttttaagacggagtcttgatctgttgcccaagctggagtgcagtggcacaatctcggctcactgcaacctctcaggtttaagtgattctcctgcctcagactctgtagtagccgggattacaggtatgcaacatcacacccagataattttttgtatttttagtagagatggggtttcaccaggttggccaggatggtctcaaactcctgaccgcggtgatccaaacacctcagcctcacaaagtactgggattacagacatgagccaccctgcccagcccattcaatcactttgagtaacacctaacctcaagtacaaagagtgctggaaatcccagtgggaagtatgccttagataaccaaccaagacggaaggagttccagtccctgaattttaatcttgaaatcattagaaaactgtcaaggacacttctcattcttaagacacgttgcgtttattatgccgagtcatggtaattatttgagtcactcattggaagccattcctgagccagtgattccctggattttttggagcttctttgtgccttattccataaataactcaatcctgcctatcagcttcctgaggataggtatgcagtatatgcatccccagaacttaatcacagtattaactggtggtgagaaatatttaatgagtgaataaactactctacttcacattcagtaaccttcataaatcttccatttactaaagaataaatgaatcactttgaatatacacaagctggaaatgatgattgggatctacagatccgaatatttctctctttcttcagcggtgtcttgatatttagattttgctgcccatgtttgcttgagaagaatgtcaacaagttcctttcctctcaagctttcaagtttgagtccttgttttacacaaatgctaaaatcttagctcatttctactggtctcatgataatatggggaggcactgagacatattttttgagccttctttccctgaacaaataggtgaaaggggaggagcaatttaaatgaggctggaaaaatcggctctttttcaaacgatggcttcctatcaaatgccctgtgacttcatgatttaatgctaaggatataaaaatagactaaaaatgaactccctcaaggtgatgatcatctttaattttctcatttataatgtggttataaattttctcatcattaatgtgtttcttcgttttcattttgtttgtcttggcatgattctagttgtttcaatggagaatcatattttggagataacgcaagctaagtcttttgctgtatttttcttaacaacgtgtgcattttcccacttgtgcatgagaagatgggaaatgtaaggctattcagaagctcctatgtcctttgttcacactaacagtggccaatttcagaagaagcctataaagatacatttcttcaaggtgatagagctcctgcataacaaagctggatcaagtgggataggcttcaatccagtccacagtaagtgacaactgccatccttcaatcaactcaggtaaaagacagttgcagagagaacacttaccagagtcttcacttaaaagatagtgcaggatccctcccacaccccaacaatgtgcttgatattggtacatggagcttgatctcactcccaggcagaatacaagtgtgaaagaaaagtggttacagtgaggactatttagaatcagtctttaaccattggcaatgaccttcagagaaaagagcacaggcctgccccctgctaactttgggtaagctattcatctctttgtgccttagtttcctaatctgtgaaatagaaataatagtacctcccttagagggttattgtgaggattcaatgacataatacatgttaaggacctaatgttgtcctgatatttgtagatatgcaataaatgttaaaatatctgtggttgggcccggcgcggtggctcatgcctgtaatctcagcactttgggaggctgaggcaggcagatcacgaggtcaggagatcgagaccatcctggctaacacagtgaaaccccgtctccactaaaaatacaaaaaattagccgggtgtggtggcgggcgactgtagtcccagctactcgggaagctgaggcaggagaatggcgtgaacctgggaggcggagcttgcagtgagccgagatggcgccactgcactccagcctgggcgacagagcaagactgtgtctcaaaaaaaaaaaaatctttaatataaaatcatttaagcatacagaaatgtataaataatgatataataaatacccatactctcaataaagtttaataaaatcttaataatttttacatttgcttaaacattttttgaaagaaattaacacagatagaattaagttacccggcagatcctctctatgatacttcactctcttccctctggaaaagccatcctccagaatttggtatttatcattgctgcgcatttatgtatgaaattattgcatttgtatccacaaaatatctaatatttctgcatgttttgaaacaatataaattgtattagaaagcatatatcttgttgcaacttgctttacttgctcgacattatgctcagcattgtttgtaatagcaaaaagtggaagacaaccattaataggagaatgattatatgtcttttggaatatttgcattataaaatactacacaaatgttaaagtggatgaaggttttcaaataactagctttatattttgcatagaatttcttttactatgcattagcaaacctaatgtatggcaaaagtttttttatgaaaaaacttttaatgaaagtctgtctgtgggtgccatctcttaaaaacaagatagacctggattttttctttcttatctaatcaaataatctctatattttaaaagcaagttgaagccacttgcaattattgttattcctgatatttttggacttatttctactgtttaattttgttttgtgtttatcattctttattctttgcttctctgtcttcctttagccttctattaagttgatacattctcttcgtttattgttgttcatttgttgatttaggtgcctgctgatatggtttggatctgtgtctcatcccacatctcatgtccagttgtaaactccaatgttggaggtagggcctggtgggaggtgatttgatcatgggggtagatttccccctggtactgttctcatgatattgagtgattcctcatgagatctggtcatttaaaagtgtgcggcacctcctcctgtttcctgctgctctggcaatatgaagtgctggctcccccttcaccttctgccatgactctaagtttcctgaggcctccccagaagaagccactatgcttcctgtacagcctgaagaactgtgggccaattaaacctcttttctttataaattactcagtctcaggtagttctttatagcaatgcaagaaaagactaatacacttggcttagtcagcttgggctgctataacaaagtactgtgactgagtgggttacaaacaacagaaatttatttcttgcagttctagaggctggaagtccaagatgaggtttccagcacagttggcttccagggagggccctcttcctcttccaggttgcagactgctgacttcttgttgtgccctcttatggtaaaaacagaccaagctagctctctggggtctctttcataaggtcgttaatcccatttgtgagggctccatcctcatgacctgattacctcccaaaggctccacctccaaacatcatcacattgtgtgggggttcagtcaggatggtgggaaaaattgtaaaataaaccttcttgaaaggccagaaggttttagcaaaagcctcaggatagagttatggctgaaggcagcctaatcctctttgagctatagcaagggtaattaacattggaatgtagaggagtctatctaaatagcttgtttaatcatgtggtcctaagactaacctttgccatcagcaggtgcatgactgctttctacttggggggttggcaatggtaattaccttctagtggtgtttacttgagacttttgtcatttaatgtgtgctgaataaatgctaagaaggccagtgagtcgggccaggctgcggttgccactgtttacagcactctccttggggtctgtaagcggcccagactctcagctggactgacaagcataatatctgtgtcagtgtatgttattcatctgttgttggatcaaggtctgtgggacggaccgctgcaacattggggattggattttaacatatgaatttggtgggaacacaaatattcagtgaataacaatgctattatgtttccattattttactgatgatcctttgtgttaaaaagttacaaaaattacgtagttctgaccaaagacaagatagatcttagcactccttaggtccatattgaaacatcccgccttccatctatagcttctctttcctattttaacacaaaagtcggatgttattttatggtcactagtcactcaaatttaccaacatgttttaattactgatgtgctcacccctaattcctgtgtctcatacattccttgtgggttcacttttcttcttgttgacatacttcccttaacacttttttttttgaatggagtggcccaggctgtggcccaggctggagttcaatggtacaatctcagctcactccaacctccgcctcccaggttcaagcaattctcctgcctcaacttcctgagtagccgggaccacaggcacgtgccaccacgcctggctaatttttgtatttttagtagagatggggttttgtcacgttggctaggctggtcttgaactcctgacctcaggtgatctgcccacctcagcctcccaaagtgctgagattataggtgtgagccatcgtgcctggccttaacactttttttaatgaaagtctgtctgtgggtggtaaattatcattgtatacctgaaaatgttttaatgtgccttcactcataagcaataatttagctattttaactattacatattgctctattttcccttagcatatggaagatattttcttcattgtcttctggcttctactgttaccaatgcaaattttgctgtcagttgattacttgcaacttccctgcacataatcagcttctcatagcatttaaggtttcctcacccttgatgtagctttaggcaatgtcattcaatgtctttaggtatgaatttgtttttgtttagttatggcactggagatgtactttccatctaagaatttgagtctttctttacttctgggaaattattacctctttgttgaaatattgctttcccacaactttctccatatcctgctaaaatttctgagagaagtagtttatggcaatttgtctatcttccatgcttttaaattttttattgagatataattcacaaaccataaattttgcccttttgaggtatatattttgagggttttttcctatattcataatgtttcacaaccatcaccactgtttaattccagaatattttcatcacccctaaaaacaacctcatatccatgagaagtcactctccactctcttttctccccagcccgtgacaaccactaatgtactttctgtctctatggattagcccattctgggtattttatgtaaatggaataatacaatatgtgaccttttgtgtctggcttcttttacttagcaaaacgttctctaggttcatccatgttgtaaaatgtatgagtacttcatttaagtcactctatgattaactttttgaaaaacagccaaactgtgttctaaagtggctgcaccattttacattcccaccagcaacatgtgagggtgctaatttcaccacatcttcaccatcacttgttatttcatttgttttattattattatagcatcctagtgcatgtgaagtggtatatcactgtggttttgatttgtatttccttaatgactaataatgttgaatatctttttcatatgtcatttgtatatcttctttggagaaatgtttgttcaaatccttgccactttttaattgggtcgtctttttattgttgagttgtaaggattctttacatattctggatacaagatcctcatcagatatgtgattctcaaatattttctctctgtggattgtctttccacgttcttgatagtggtttccaaagcacaaaagttttttattttaatgaagcccaattacctaattttttcttggttgtttgcacgttgttatgtttaagaaaccactgccaaatccaaggtcatgaagatttacctctatgttttcttcttttttattttattttttttcttttctgagacggagtctcgctctgttgcccaggctggggtgcagtgacatgatcttggctcactgcaacctccacctccttggttcaagtgtttctcctgcctcagcctcccaagtagtgggattacaggcacccatcaccatgcccggctaatttttgtattttagtagagatggggtttcactatgtaggtcaagttggtcttgaactcctgacctcaaatgatccacccgccttggcctccaaaagtgcatgagccaccaagcccagccgtttccttctaagatttttatggttcatgatctttcatttttttgatatggttccctctccatgctatatttggtgtaaagtcttcaggactatcctccaacattaattaacttttccactgtgttctaccttgaacttatactatcaactgatagttttctcttttttaaaattgcaatgactatatgtttgcttcctttttttaaatttcagattttgaaccacttcttttacatatctctgctttcttgggtttgtacaatttttcttcattgtttttaggataatttttcctccatttggctgtctgagtatcctaaatacattttaaagtgtttgacagcctgcaccaaaaatcaacttcttctagaagaaattcatgttccagttgccaatttctgtggtacactctgctactggcaccaattcttcctcctgtacctgtgccctttgctttctaacctgcacttccctgcttcttgactttgcctttggccagaccatttttcacagcagctgtgttattttatgttcctagaagcaatataccagggttcacatttctccacaccctcaccaatacctgctatttgctgtttgtcttttatagtagccatcctaatgggtgtgaagtggcatctcactgtggctttgatctgcatttccctaatgactagcatctttctatgtgcttattggcccatttgtagatcttctctggagaaatgtctattccagtcctttggccatttttgaattgggttttacttttgttgttgttgctgctgctgttgagctgccagagttctttatatctttcatatgtctagatattaaccccttatcccaatatataatttgaaaatattttctcatattgtgagctgccttttcactgtattcatgtgtcttttgatgtataaaaagtttttaattttaatgaagtccaatttatctattgcttcttttgttgcctgtgacattttggctaatttcaagtagaagatacttggtttgggaggccgaagcaggcagatcacaaggtcaggagatcgagaccatcctggataacatggtgaaaccccgtctctacaaaaaattagctgggcgtggtggtgggtgcctgtagtcccagctactcaggaggctgaggcagcagaatggcgtgaacctgggaggcggagcttgcagtgagccgagatagcgccactgcactccagcctgggcgaaagagcgggactccgtctcaaaaaaaaaaaaaaaaagaagatatttgggttttgggttctttctctctctcgcctgcctagagttttgtagttacttccacctcctcccttaaacttccacttcagagccttataatggcactttatgactaatgctctataatcatattggcatattgcagatccaattccaaagctagctcggtctggcagaaaagctgtcccaatgtccttccatctctctaggccaacagcttcctgttaatattattaagctgtggcttggaggaaacaggctggcagcagttgttttagcctgtccaccccatgtcctgtattcaggttatagccctagctctgattcccagtgtcccctgcagcacttttagtcccttttgctccacaggattcaagctccttcctgccactccttactcaggatgtggatcacagctgtcccagggcttctgcagttctctctctctcttttttttttttctggttcccagagttgtttgtctctggcaccagtttttttaaaagatatatttttttattataattttacctaccttggcgtgtgtttgagcagaggagtgtttgtcaaaaaatgaacttactcaaccatcttgaccggaattcacagcaaatgttttcatctcctaatgactgaattggatcagcttacagcagattgatttgactgcactggatctaatcatgtaggtggtgttgaagaaatataaaaccctaaaattccaattaaatccattcactggctgtaaaatcaaaggtttttaaaagattctatctattggtggtcattcagaagagtcatctcttctacagctatgagatggtaaggtggagctgtgagcaggagccagcatgcatgggcaggggcccccatggcacacaagccagagggaggcatctgtgatgctcctgaggcaggaagggaagtagagagctgggtattgcaatgaggtggtgagcacatctgctagtgaaagcatgattccagctccttccgtgcacccctcaggatgtgaagcacagctgccctgcagcttctgtcctgtagtgtcaatctgcacactgtgtagtaccagttacacagattaattatgtctggtgttttgagaactacccacttccacctctgaccatctctcaagtcctgtagggcagaggattgtggtttacagccctgtaggctttggagatgctcagaatgcagagcctaagacactccttttgggaccactttggatggctaaagacaaggtagctgtgattctgagtcagaggccttgggaacccagtggccatccctgggtccccagcagagcaagtgggtcccaggacagctctgcatattcttggaggtgacaaggatgccctcagaaatcccacctgatctagcaaggctatgaccttgtcaggagcaaacaccatcacttcacactggaattgcttggtttaaagctgatttcttcctgatactctgtagtcccaagagcataataacctcaagcagagacgagatgcgaggggcttccagaaactatagaacaagatctactcactactcaaaagcaagtctgtagagttgaaacaaatccaaactttaagatgagcctttttttctgaggatggttcccttctgtgtagtcgtaaactaaatgggaggctgctcactcacgcaccacgtacccagcttagaaacattaatgcatacccagtaagtgcctgtcaccttggcagcactgggggcagaaaggaataagacagtcctcatcatggaaaaagccacctatcaatgtacaacaggacttagaagcaaaccattgtagtgcactgtcaattccacctagatgattttgacaggactacaaagagaaattagccaagggaagaagagaataaggagcatcccaggcactcacagaggcaagaaaagttcaagggttattcggcggatgtggagtccacttgtttgacttgggtgagggagctacagaaattgaagttacaaaagcaggcagacataagtcatatttcatctaaaatgccactaattgtaaaatgaactattatttcatgtacaaccaagaaaaaaaaatgctgctaattgaattttcacacaccattgactgcaaaacatcccaattcaaaatgggttaaaatgcaaggcaatgtgcctctcagaatggatgaaatatggtaattccccaaagaagaaatgtaaaggtgaattaacactaaaaaaactgtttttttaatagaaagatacattcaaaccaaatgtagatatcatttttctcttagcaaatcagtaaaatattgaaaataatgtttagcattagcaaggggatcatgaaatggacaaactcacactaaaaccatacattaataccatctttctgaaaatcacttaggtaataatgtgtcaggaacctatatatgtctgcattctttgagccagcaatcttacttagtggaatctatggtaaatccgtacttacagactcagaagacttatgtacaagaatgtaaggtcacttataaaaatgcatgttatataaatgctaaattatcaatagacatataaataaactgtggcatagtcatagaaatgttagtcaattactgaaatatttgttgaagtatttaataacatgaagaaagtctcataatgtagtggtaagttttaaaaggaaggaaacaaaactctacataaagtattaatctaattcaaatctagagaaaaagtatttaataaagacaggaaggagaggtaatcttggttaaccctgagtggtagcattattggcaacatttttccttcttatgtttatcattttttaaattttcttcaatgacggtatttatcttttataatctttccttgccccaaacagatgtgcttttccaaattctgctcgttaaaattaaataaaaattaaattgtagttgagaatgtaagcacatgcatggagacagaatgatcaataagtgccccttatattaaacaataattatacttgatcctcatgaatacttatgatttgccagtacatgtgagattgggtcgaacagaggtcatacatgccttccatatttctcgatagtagagattattatgagcactatgtcaatactgggctaaatttacaagcattatttctaattcttatcttctcccaaacagatgagaaaacagacattccaagaagctgaagaagcacatgtgagggcacacaatttgaacacagaaaagctgggatttaaacctgagtctcgatctcaccacagactcacactacttcccttgcacgatctgcctctacaaggcagatccttccatagcatgtacagatgaacatcaaagaggaccaaaattctattctttccataggtgagggggacgattgtgaaccaattatagaaatatttatgtccattcctagaggggcctcacaaatgagggtgacagagacaaagctctctgataacgtgagtagactggataactatggggccatgttctcagtttatcaacccaattcccgagaaaccaggcctttccattgtctgtggtcactaagataatggtgcaatgctgtttacccacctggcaacgtaaggcgacacgtggagctggtgcttggggctggtgagccgtgagaacgctgttttgtgcctgtgaagaggaaaaagaggataaggaaaagtaggattgtggaaaaacctgttggacaagtaaatgttcatctgaaatgttatcaagttggggtctgaaaacaatgtttagaagcaggttaggtgaggttgcagggtggtgcatattctgtggtccagaaaagctgggagcatcgcctttgcctttgtgtgtgtgacagtacgcagttcctctggctggaaggttgatatgttgggaccgatgtgccactgagcaatgctacattttaggatcacaggggaagttttctaaataggaagttgcctgggcgtcacccccacagtacaggggtggaggcccagcactcatgtttttaaaacccctcattctaatgtgcatccaggatggaacaggatggaggactatctgaagaaggggaagttctgatttagaatgagggaatcgggggttttgtctctgctttgtccttataggctttacttgctattggaactcaagcaatgaactggatctctctgaagctcaggtcttcatctgcaaaatgacgagaatgacaacaattgcgtcgaagtgttccagtgaggattaaaggaagcaaagtgtgtccagtgctcaggaacaatgggagacttcacaaatgctagtttagtggggtttcttagtttcccagcaactggcaacagaattcctatgaggaaggggattatctttgttctaataaaccctttaatgggtcacgaggcaatgaaaagtcaaaccccaggatgggatcaataaggagagagcagaataaagggacaaagggagaactgagaggtcctgccaaaaaattttacattttttgtatatatgtatgtgggtgtgtacgtatatacatacgcatatatttacgtataaatatatacacacagacacatatatggacacatatcttatatataaacataaatatttatttattcattcattcatttattttgtcatccagagtgggaaggaagaggcctggaagccagattctagcaacacggcagatgcctgcagtctgagctggcagaaatgcagagagaattcctcagcagaggatatccatgagtcagtgttaggttacttccgttaggagtccccacaaacttcccaaacttttagttaagtccactttatatgcagaggcctggtgtaagtggaagctgtgctgattgagaagaccctatgtgtcaatatagtcactgataaagataacaaaagaatcagtttgtggggtggggggaggggggagggatagcattaggagatatacctaatgttaaatgaccagttaatgggtgtagcacaccaacatggcacatgtatacatatgtaacaaacctgcacgttctgcacatgtaccctaaaacttaaagtataataaaaaaaaaagaaagaaacaattagtattaaaaaaagaaaaagaatctgaagactgggcagtgtcagaggaagcagagacttggggttggaggtgagtgggagagcggtaagctttccctaccccagaatccctggggaagagtggagacatgcactttggatgacgtttgatatcgttccattttattttatttatttatttttgagatggagtctcgctctgttgcccaggctggagtgcagtgatgcgatctcgactcactgcaagctccgtctcccgggttcaagcaattcccctgcctcagcctcctgagtagctgagactacaggcatccaccaccatgcctggctaatttttgtagttttagtagagacggggtttcactgtgttggccaggctggtctcaaactcctaacctcgtgatccacacacttcgggctctcaaagtgctgggattacagacatgagccaccgcacccagccccattttcatcttaaacaacagggcaccaatcctgacattgtgtgacaaatgccctccagacaataacaaatgttattgttaatcattattattctttccttcttttctggcagcagtagtagtaaaaatagaaaacataaaattaatccaaatagctcagacctacaaaaactgttaatttgtatgaagtgaagggaactgtatctggcgggactttatttctccattttccaggtctcacagatgccctgaaggtcagagttggtggagaacatagagggtccaaccctggctgtagctgtgcttcagttcttgaacctcagttgagtaactcagttactcctgaggtgatgtttataaatatgacttccaagctccttgattggaccctgaagcagaatctccagggaatggagccagcaatttgaattttaacaatttcaccaggtgattccaacgatgatcttgtaatctggcacttcactggtctaatgaagtgtcttggacactccggggtgaaagatttacgcaaagtgatactctgtgtcaaagccagtgctgccacaatgcacaaccccagtggatgcccgtcgcattgtatcttacacaaagaatggtggaccctgggtgtgcaacaaataggccccattaggaggcactaccagagggcacatctgtgtcttttatgttgtgatccagagccgttccttctctgcccgaaatgcctctgtgtcccacaagattttttacttgtctcatttgacctttgggatagggtttctcagcagtgacactgtgacatttgggctgtacaattctttgtggtgggggctgtcctgtgcactggagaatgtttagcagtgtccctggcctctacccatgagatgtcagtagctcctccctagtcatgacgatcataaacatcctccagatggtgacaaatatcctctagaggcaaaagtgccctccattgagaatctctattttaggttgcagacagggcttcaagtttttatttagagatgtggttcccaatttggctgcttggtcattgctaatagtcactcccacatattaagcagttactgtggccctggtgccatattacgtaggcaccgtgaaatatagatttgttgttgtttctgattttaacattctgacaacaaaattatcccattttacaggatttgaagacaatttttgtctccaaacattttgtttaaggaacttgactaatgttactgagtgttgtgggaggagggaaaaacttaagtcaagatcattcaaagttcaaactcaaagaaatttttcccctgactcttgctgcttcttaaccaacccattgtctgggtttccttcaagcacagtctcccaaagttgtctaagaggaagaaaaacctgggacaattattttaacaaaaatgaaaaacaaagccagtttcccaggcctcactaagctctcggagccagcacttccagaggcgaggtttagggacctgggtatttcacaggtggcccaggtgattcccatcatcaaacaggcttggaacaccttgtgtggtagaaatttccttttgtcgaactaacgaaaagtgtggcattctgctttctgtggatactcttgtgaagttgagagaacaaatttaatgttgcctacatgagtacctgaaaaactgcaaagtgctcaatgaccacaaacttccaatgttgctacctgtagaaacgctattgccaggttatttcatagaaatgcttggtggaattttttaaaaaataactgactataatcttccaaaagcctgcagcttgatagcttttcgtagaggtagcttttcatccccttggtgtcttctttgcaaacactgagtaagggaactctgggaaccttgagtcagtgaaaaagcagaactacaaggccttctggaaatgctgttattttctctgttagcttggtgagatgcccaatatatcaggacagggatgaagccatcccacctctcataaccatgagccatatacaggtagcaggcggggatacataaaataaaactggttttgattttgccacgggccattggcggggggttaggttctgagtcagcctcccactggcttccagttcactgaggatgtgttcttgaaatctctttccatgaggaagctaccaaattacctatcactttactcaaagttccactcatgggagtaatacccaacacatctgagtttcattttctaaagcccttcgcacttcacccttccgttgctccctctcatgtccaggaagaacatcagaaaccaggtgggaacagccagtcctgacccagcttctaaactgtactgtatgatgcacacagaaggcttcagaccacccaccacatggaactggttcttggattcattgtagaaatctactctgtcagtggttttcaatcctggctacatattagaatcatcaggggagttcttaaacaatatgctgacacctgacccttcaccccaagatgctgtttagttggtctgggtgggacctgggcatgaggactttttaatgttcccaggtgagcctgatctgcagccatgagaaacactgccttcactgaatacccagagatgtttctttcagttgtcgggagggaagccttactttcttctgaaacaactggtgtgctcatcctcacggatgtgaatcttgtaaatggtttatttccatttaaacttaagattccagaaagcttagacccagtttatggcataatgctaggaatcaggggaggccgatttagactgcacgtctgcttattaacatttgccctggtttgttccatctatgctagctctactttgtgactctggttttattccatttacttaatcattaaaaaagcaatgtattaaatttgcatgattttagaattctcaaatatctgataaatgaggtaaaataaaagcaaatgaacaaacaactatgtcaatgctgctattgctaaatttcattttcctcatctatgaaattgagaaaacatcaatgtcaggacaataattgcgagcatcaagtaagagtacacacatgacagtgcttagcaaactgtgtcatacaacacagtttttattatttgttttagaaaggtgtgtgtatgtgcatgtgcgcatgcgtgtgtgtgcacgtgtgcatttgtgtgtgtgtgtgtgtgtgtgtgtgtgtgtgtgtgtgtgtctaagtaggtaatctgtcatctttgggaaataaacactttaaggtcaggaattacatttcccttgactcacagcatgtggccatttaaggagtaaacaacccaatccgtcagctaggggcagagatgtcaccactgcagcttatgtgacttgaggtatcctttgacaaatgaatagctttcagatatttcaaattaatgtccttgtttggttcaactagagggcaatgaatccaattcatcaagagtgtggagaagaggacagtgatagaagtgacaactaaggctacccgcctcagggtgaacgcacacctaagactcgggacttcacaaagttagtgctaaagcacagtgatttgcagcttaacctcaaacaaataatttcccttctgcaaaatggggttagcctggccaagcctatgcctgctggagaaagggtgatttaagagctcttgagaccaaacatcatcattattaatggtctggcaatagcaatgttattatagtacaaccagatcccacagggcagaggaggatgctgaaaagctgaggtatgaaagtttctgtcaacttattggccattttcaatttctctgttttagcatattgtaaatgactgcctttctgatacccacagacctctgatcattattgctgagcatatctgccaacatcttctttgtgttccatttgggctggggcacagggcaacaagccattgcctgaagcctcagaacaaatcatcgtttttgcccctttacagctttgaagagagagcatcagtaaaagtccaagttctgcttcaggctgtgggaacactgaaagagtctggaggtcttcaacgccccaccccccaccccccacacactgccctaagagttatcaaccaagagtatataaattagagctgcatattcagagtatttaatgcttttttcctgcacaatacaaccaccatcaatactaggtttagtttcgtgtgatttgaatatgtctgttcatcacaaagaagaatgattaaaagcaagagctattcagagatacaacaccacaagctatttaaatgtggctttcaaaatatttgaatgtgctttgaacttgaattggacatatgaatgaggagttaaaaaaagtgttaacaacctgtgacccagtaattgtatatctggaaatttgtccagtggagatattcagaaatgtgacaaagcgttatgtacaaagagctccattgctgctatttacaactgcaaaaaataaaataaaagcgtataagttaattgcccaacagcagagaggtggttaagtaaattgcgctagagccacagaataaaatattatgctgctattgaaattatattaatggagaagttaaaaaaacactcacaagaaaatgcttacaatccaatgttgtgtgaacaaaccataattcaaaattaactatactatatggccttaactgtgtaaaaatgcatagcgaaagatcataagaaaataaagtatctacaatgattaattgttggatggggtattacaagtgattttaagtttcctattatactgtcgatactttccaaattgagtaaattctatttttactttaagaaaaaaattaaaaatatgtttcagtgaatggcaagcatggctgctttggagaaacatcacagtcgccttcatcagagcaataataccatgcgaaacgatacaccaggaggccctgatgaaggggtggtatttgtgtaatattcagtatcaccactagagggttctctctctgaggccggtttgaaggcatcaggctggatgccataaaggatgtaaaccacttttatccccacaaaggggagtaatgaatgactacacagagtccctgactcatgatggcccaacttaaatttttggacttcatgatgatgcacaagcaatacacactcagaagaaaccgtatataacctttctgtttttcactttcagaacagtattcaataaattacatgagctattcaacactttattataaaataggctttgtgttaggcgattttgcccaactctgggataatgtgttctgagcatgcttaaggcaggatagcctaagctatgattcaaacacagctggtaggttaggcatattaaatgcattttcgacttacagttttttcaacctacaatgagtttattgggacgtgaccccatggtaagtcaaggaacatctgcattccctagtcagactccttatgttcatggcttgagcaggaaaatattgccaaatatacccctttcaagagtaggagaaagaaaaagtttgcaattcagaaagctagcatcacagggctgtaaaaccatatcattgtaccctgaagaaaattaaacatatggaatccagcttaattccatgaatgctgagatttcttatgcctctgataagcttctgataacccatttacttcatccctcacagtcaaaaaaggtgaaatgaaacgtgatatagtcatactctgtgtatgtctttcagcatgcaggcaaaggcacttggtgcctgggtattatgagacgtttaagggaatacaaaagagacagatggttgactgagtttggacagctctatatctgagacagaacatggacaacaatgggaaacattcaaagaaagaaaaaaaagtcttttcatttttccaattccaattaagaggttaactcattgtttttatttggtaatcagaagaacatacaagtacttatgcattactagatgctgggggaaaattatacattgaaggactgtcaggctcatctgtgcaataaagatttacaataaacacatcattaatttttctgagaacagctcagtatactctgttttacatgaatccttatgatttaatcttgtatttggagatatgatgctatggcatttggataacattggttaagcagcatcttagagaacagaacactcttcctcagaatggatggccattcttttaccctgtgatgtacaaatgcaaattacaacctgcattttatctgccagaagtgtatttcacatcatggaagtacattctatcacaaccatgaaatcaaaacaagtccattattaccatcttcccttttggaagagcattctcagaatacatccagaaataccttccttattcctccaaagaattgtttattcagctagtcattggttgaggtttgggttttggttctgcttgcctctctcttttgagtcttgctaaatgttcttgatagtaatccagatatttctcacaaatccagctgaacagcagcaacatctaaagctgaggagatgagttgagttttccattcatatatggccagtgccctcatcaggaaagagcctacagactcaaggtgagtagggtgtctttaggatgctatgtatttaatgcatagggtgctacgcatcctaaagagaaaaaccctgtgagagcaaaaactgtgctgtacactaagggaggacaataacaacatcatattcacctctaggtgactcaccttgctttgggtaattgatttcccataaagatttccttttttcctgcttccttttcccaagctatttctgcctccccatctatccccagcgacctttgacacccaaaactttcccatacgaattgcatggaacaaggtgcttttatttttcccattattttgtgtttgtacgtgctaaaatgatactgcaagcagaatgggttacctggacagaagcaaaagaaggaatttgtgaagggtagaaaaatgggaggaaaaaaaaaggaaaacataaaggagagtttgaaaaagggaagacatttaaattagatgaggggaatctggttgtacagtgggcacaagagctgataaaaacctaaccaagctctacaaatgaaaatagcaaatatatttttgaaaattttatagcatataaaattgtataaaaatatcatcaaagcaagaaaaaaggaaatgtatactctatagttctacctctagaatcagttattggacaatacctatggctgtaggtttttcctatccatctatatatattaatataatatgtgactgtatttctgtaccatcacacatatacccactcaaagacaaggacagtagtacacaaattctactccaagataggtcatgagagggaagcaaagactatacaatgatgtgtctccaggacaatctatttaaaacccattctatagccatggggttttaatgggctttattttaaatgaattaccctgcaccataaactgactgagaaatgatcctgcaggttcagaagccagcactcatgaagaatacgtggctgaagctgaccaaagctgagaggatgagtctccagttggcactgcctctggcctgcaacagccagcattcaccccacaaagggggacaaggtctcctcaggggagactgaatgagtgtgccctgagcgaacttaaagggcccacaccccactccctgcttctcctggctgagcagatggcagcccaggctgggtgcaagtacagttagtgaagccagccattgccagggttaatccacttctgcttgggaacagaagccagaataaacatgaattcatgtcaaatatgtctggcaatattttccaaaaaatgactagggtgggtatttaagaaaacaatcaggaattaatatgtttaaacttgaccatcatacatctttcagtccaggtcatccactgcacaatcgttccttgtttaatataaaaacaagaagctatttcagtggcacaattcttgcttaattcagacattcctggagaagcagccagcctttttacaaatgtccaaggaggatctttagaggcctgcttcccatttttctaatctccctgggaacatgttcatgatcagataaactgtctaatgcaaatgactctggtaacattctaactctagtgtcacctctgtgcccactagtgtctttggtgagagagaggaaaccttaaaaagtaaaatctggccttggcaggtaatatgtctcttgatacccagagggaggttttataggaatattgtcattgctcattataatttttttcattaagttcattttcttagtgataatgaggcctttaatcatggatcacagttgataaattattactttccatttgttcatgcataagatccaatataacatcattattgcaacattatgttctttaacatctaactttgccatggtttggtgctgtaccaatcatattattggtggagcagaactatgcagtgattcctcatgctgcacatagagaatctatttgctgtaggagagtctgtttaaggttttaaaagtttccactcggattctcagtaaatccactgacgttttatatagattggtgtcatcttcccttttggaaagacattctcagataaatcctgttttagtgcttttttttttttgtattgttctgtttttttcttaaatcaagaggccatagagaagtttttattttattttttccataaatttggctatgacaatttctcccaaattacctgcaatttcctatctctggtaataagctatttgtgtgagtagggtatgcctgcatatacttagaagataagcctttagcagtgtgcttggcatatagaagttgaataaattttcagggaaatttgaattttgtttgcattcacaagtggatagtggaattcagttagacgattttgaatgtgtttcctgaatgctgaccgtgttccaaacactgtggtgggccagcactgcgtctcctgtggggtgtgtgggcatctcaggatcagaacaaagtttccaattaggaaaaaaattgttgcctgaattccctaaattctctttatttgggatagaacaccacatacacagatttccaatcttagaatcttctctatttcactatgagaaaaagatttcatgctttttttctattgtttttcctaggctccatggggaatgttacaaagtaatttccatcatcaaagtctctgctcataggttaagaaagaagaaaatatattatattatctatctatctatctatctatctatctatctatctatctatctatctatctatctatctatcatctatctatctatctatctacctacctacctatctaaggaaaagtgacccatgagagaagtgatattaaaataaacagtatccatacttccaaaatatggataacaaaaattggtcttcaacttttggattaccgtctcacatcccatgataatgttgctttttactttacacttttgtatctaaaggcatggttccaagtggaaaatataatacaatggcttaaattctacaaatgaatgaacacgtgcactaggttattctttggctttcagatgtttagatatcattttactgtttaagtgtatcagatccacaatgggatcctgtcaaatgttttcggtagtttataacagctccaaaaatgaaatggacagtggaagaaagtccatttgaatttaatgggttagaaatgagtctcttgtctgctgccataaactattagggctcataacctaagaaagattggcacaaataaaatatggaacaaaggcctcgataagaatgggtcattatgccactgaaacgtaccacattaacacaacttaaatatagagctatttggtgacatggggacccaaattcaagggctaacttgtcacattttatccagggacgtgtagagcgcatggtttcgtctgtggtaggactatccctattgctgtccccacatgctagttaattcttaattcaggtgtgtaagcccttgctctgtgtgtgtaaaccagagtaagatgccataatctgtgcaatagaataatgtttgtcccaaattgctgctcaacttgaagaaagctatttcaagggaattaaaagaccgcagaaaataagctagagctttggaaatattgcttttgcagtcagcactgatttggaataattactttaatgttttatcagctccagtatcaattcatagcatcatataatatagcattttgtatttttaatagataactgcatttttactcaatatcccttcgaaacactttttaaagatttaaagctaagagtgagttacatggagttttgttttgcttcactgagagttttaggtgaagttctttatggaatgaaattctctttctattctttttcagctgattaatgacttaaagcaaatgaaaaacatttccatttttattggtgctagaaaaaatggctatattcctgtttctttttcaaatgttgtttcttgttgcttgttagattataaaatggaagctgtagactttctattttgactggccaaaaagccccacatacaaaaatacagaatataaatgaggtaaaaggtccaggttccaaggtcaaaaattgacatactcttggttatatttaatttcaatacaaaatcataccacctctaagaacatagcttgcaaaccaatgccccatggattgaatgcagctcacaggcatgtttcatttgattagcacagtgtttgtaagtttttgagttagttgtcaatatgtaaaaatttggagagagcttatatcaaatcctaggtatctaggacccccatccccacacagctcaaattcagttgctgcctaccaactaccctgttttgacagcacccaccctctccaatttctcacagtccccattgctccttcctgtcttgctgatacaaaggcccactatgaattgccatttaccacaatgactgtgatattacatggcttgctttattcatttacttgacctgctaggcccctgaagtcatttgaatttctggccacattatgtggtgaggtcattgttatgaacacagggagcacaacagaaaaatctaagtgtttctccaaggcaaaatgtaaagctgacagaagaaatctgttcaaatatcagcatgctgttgtgcattcgatactacaaagttcttcagatctttctgttggggaacattttggcaaggcaaaggtccaggaagaccacatacagtctctttctttctgcctgaaaaaatgccaatatttcaccttagtaataaaaggacgtttaaatatctgttctcgtgctttttcatgtagaaattaaatctgtagtggggaatacacttaaacctattgcctagctctctttctattactaatccccacttcatcatcagcatattcatgtgcttcactcttgggaaggactcagagattcctgtgtgaccaataaccacattttaagaatcacttttatctaaatcacatcatttagactcataaaatcccactttacttgcactcccttagatcccacctgtaatttggtctcaagggggctgcaatgttattctctttccatgctacatctactattcttattttttattcgtgctattaatccacttctatcttgtatttttaaaaactcactaaaatgcaaagaattatctgccatatctccctgatactaattcccttagcactttactgaataaaaagaagagtgatgaaataaaaccacagatatccaaaagaagatgtccagccagtggtaaaaatttcagtaaccacttagttatcaatgctaccagtggaaacaatgggttcccactcaacagtacagtcaccagctgaacattcaggtttatactaatgaatgcacagagaaaataaattagccatcaaataaagattcctatagaataatcttttttagaaaacaaacagaattctgtattacagaagtgggaaaaaaagcataagaacaattttaagtctgaaaggaaattggagaaaacaaatgttcctgactcaggaaaggaaccagagactggaatcatcatctttgcggtgatgaatgtcagcatggctgtatcatcagtagccagtgcaaaaatgacaacatttaaagtaacggcattgacagtcataaaatggcaattactgtgtgtgtggcttttttcaggcctctcccagcatatccaggatgtccattctcatcaggccagacagatgccttgaaagccaggtcattagcaaaggattttgaggatgccccttcatgttttgtttctgtttgagtaaaaatctcacgttgtttgttttgctcaggggaatatcccccagagttctaagacctcaaaccaacccccaaagattcatcccctggaaggagatggtgtgagggaaggccaagggtcagggggtggggggcttgtgtttgaaagttgtacaccttctccagatatgggtctttgtggaagaaggagaagaaggagaatgaagaagctcagctagaatgatgcaagacactggcagcctcttttattgtctatgaggtcttttttactcttgtgaatctgaaaaaaagaaaaagaaaaagaaaagtgtcaatgctgcctttccccccgcccacctccaccctccaagtctgaggagaaggaaatctaggggaccaaaaaaaatgggataaccaattaaacatttccatactggtcattgctgtctcccttgtaacaagatttgttctattcataaggggaaaatgtcagtgcaaaactgtaatatcagtacatttgaaatcttaatagttgctgtaaactagattagcaaacatttggtcatgcagtagggatattaagccaccttcttttgcaatggagatgacggttttgttgccagatctggtcaatctgtctcaagggtcagtgggattggaagaaatcagattcatctaatcccaactgttttcatatcaaaagcaatactcctccctctcagaattcttgccccaccctcagaagtttcccagagacatttaaagcaagatgtatcctagcccaaatcattttgcagatgggtgaatcacctgagttctccactggacccagagcaagggggtggaggaagacgacaaagatggaaaaaggactaggttaatgacaatagacaatattgtatttcttttcaactggcatgctctaccccatgtaacctcaaaggtcttaggcagaatttaaaacaacaaccacaacaaacccaccatattatttcttccaattggtgttgcatgctctgcaagtcatcatgccttatagttagaaagtgttcccttctatgcagggctccagttggcttggactttaagaagggtaacactattatctacagagatgttagaagcctttacaggacaaggaaagtttcccattcaactttaaagactaagatactctcctaagatttaggtgaatttagcagaaaactcattgggagataggagaactccttctgatctattgtaattacagtcaattctcaattttccaggggccattgatccaagcttcctgctgttcctctaactttattatgttcttgattgttcattatgtttaccctccattaacaccttcacccatttgagagaaataacagacaaaagtgaggcttcataccaatcactttactccaatactagcactgataaacttgccagtgagagaaggaggtgaaacaaaagctgaaatcaaggatgagaaattttccattgatgttgatagtctatgcacagtttggtccacatggaattgcaatacatgactttgtccttagtactctgaccctgccattatcaacttgggatcatacgtcatgaggcttcttttagagagtcatcataatactaaccaccttcagagatgtccccagaccctcaaatgtaaagcccaattttgttaggatgacagaaggttgggtttgattttttaataacagacccattggttggaaggaagctagagacagatagctggggacagctgataaagaccactatttaactcagtgagcctcacctggccaacaaggagaatgatgcacctcctgcagactgggttagcagagacccacggtccagactgctgggtcccagagatggaaagaggcctatctagggtcttaatgaaatccaaaggctgctaaaacgagatattcctccatttctaatcactgcttatgggtgagatggtggagtgttccctctggctgtggatctccatcctcccctccagctttgtgtcaaggggtgaagggaaagggtgaataaaagaagtttgtgtgtttaagctgtgcctgtgttcattgtcattaaataccaccagcagtaaaagaacaagaagcatatgttctatagctgggtctgtgacgtgatgacctgagtcatcatccctggccttcccaaacacatgccctctaaaagtaacttctgtttgtgaatttcttaagtcacttaagaaataccctaaggtccctatatcatagctacctgcaaaataatgttccaacccagactgctgactctttgagaacagggaaaacacctcatttatcgtttataacacttcttgcatgtagtgcaatgcctgacacatagcatatgctcaacaatatttttaatgaaaaagaagagaattgaataagcatgaggaggatgggactgataaggtgtggtgatgaataggaggtttccctccaccctttttctaattttgactttcacagcatgaaacaaaaatttaaaagaaaataataaacacaccaattatatattttattcaatagtaaggtatgatatgtcaaaatatttacattccctatgaagaaacccaattatggatggctttctatggagctaatctcacagagaaggagcacctgctatccaggcagctttggcatggtttgcaaatcaggcctggtcctcttttcactccacatcctatctttcattgtgttctggttttatgtatttgttttcaatataaactgaaattcagtaagcatcagcaagactacaaagtatatgaaaatgaggaccctgaagacaaagtgttaataggccactctgtgtgtaactgagatgcatgactttttgaaggccacaaaaagtagttaaatccttccactttttaaagagtgactgatgaattgaaatggaaactttcttgccacatcttggaataattcaggaaactatttaagtgcctgccccttgacccaagactttttatacctcacaaggtaaagctgtgagaactttaaatcctgaagtgcaaatacatggtatatgaattcacagaaatgtatttactctataggagcatacaatcatgtttcagcaacttcatttagaaaaatgggagacggacttaaaacaatgtggccttatttatggtaccatgctgctcccaaaggtaagtgcagatgctgtatataggtcttaaaaccatgtgatttaaagataattggttttagaagaagattgaagttcaatttaacatgacttgattctaaagatgtgtttatccattataatgtttattcctggatcacaaatggagtgtcaatgaggcagccctcataagaatttgccactgggcttaaaaaatattttaaatgcatttctcttccatttttcttggatttgatgtttttacagcctgattcaactatcacctaaactcaaagaagtaagttgacttggctgaagagagagatggggttcaaaaccagattttcaggtcctaggaactctgtaccatagctgcctccctatggagtcaactttctgcaaaaacagcaaagtgatacagcacacacctgacaagttataaaactctaaatagaaaaaaacgaatgaagaataagtgtagagaaaccaaaaccaatttgaaatgtcatgtaagacttctattgggcatatgaatgggtcctcgttttttttttttttaaataagaagaaaacattaagaaaaaacaattttaaagtatctgttaggctttatccaggtatggacttaattgtcctaggtcacaagtacatgacagctattttaaagcgttattttcaacatgtgcatgctttctccttgccctaaataatagagcatattattataataggattatattttcactacaaataatatccatgctacagcactgctaagacaaaatcctctcatcatgtattattccagcacagaaaaataaaacagaaggacagatagacagacacatagataaaccagatagatagatagatagatagatagatagatagatagatagatagatagatagacagacagacagacagacagacagacagacagacagacagacagacagatagatagacagatagatgggcaggcgggcaggcaggcaggcagacagacagacagacagacagaagacatttgtgggaatgtaacttcttaaaaccttgcctatgccattaactcctaaaatttacccatttgatccaaacacacagaataagaacagtacaaagaacagttagtttagtgcaaaagtaattgcggtctttaccattactttcaatggcaaaaaccccatttacttttgcagcaatctaatagttcttaggtccaaccctttccctctttgtctttccttttgctccactgcatctgtgctaccactgaaaataacaatgatgttaaactcttcctctctacccttgttgctttctctctttcatttagcatgttctttctttccaaacataaaatatgtgaacaactgtctctgttcttctgtctcacactgcccaaggtgtcttactgctatcatgctctgttttaagaatgtagcacattaacacaaagacaatgattaaaacactgaactctctaaatgcccccaatgcctggcccacttttagcagacaagtaaaagtcaggcatcagtaactcctacaactcctctgatgataagtcaacatccctgattcacagaggtgcaggtgagggtagagttaagcacccttgtctgcacaaaagagtttagtttctgatcagtctttgaatctgtgaagtcaggaagaagcccaggaccgtaaagaaagtccttcagatcagtaagtgaggcttggattttagacatgaaacattctgactactcttcatgtttttctcaattttattatttcaggaaaagcagaaaagattctaaatgatgagaaaaccaaacaaacaatcattttctcatgttttcactatggctccagggcatagaataaaaatagcatatattgcagcggactaatacttaagaaatgtagacatggtcacttggagagcaggatgcccatcagtggagaatgctaagaaaaaatgcaaagaggggaagcttgaatacttgctgaatactgcatttaatagcttttttagcatgtgagcgtctagaaaagaaatggcattaccaatgtagatagtgttaagttctgcctttggcacatatttacttcaaaggttccctttattttaaatatttaaatataatgttaatagagtttcttttggcaaatatattgttacttgtgtttctccaatcccttgcatagaatctgacaaaatatcatttttttccaggagaaaatatttatttcatgattactaagaagctttattttaaacatcttgaacatcagtattaaggaaaaaagaaaaatcacaccttgccccgtagttacaaaattttaattccctctgtcaaaccagattcctttaaaaatacagtggtacattagtagttccacaaagtatctagaagacagagtgaaacaatgaaagcttatgtagcaataattgcaaaagaaaagttgttcagaaagtctaattttatcattaacaaagagttcataatatacttttatttgacatttctactatggagttacttggtaagagactgggatctaaacacctacataaaaaacatgaattgatgttagaagtttcccttagtataacacaatttatttaaacccatcaatctcatataatatataatataatccacatattatggattggttaatagatattccccaaattcataaaataaaaccaattatgttgggttaaaacatcactgaattaataataactctcatggttgggtcaacctacagcacagcttccaaaattaagtacaaaatgacaatgaagtatctaaatcaaaatgtttaatcgaaaaaaccttttagagtttaattagtgaagttttaaccagatgcatgagaataacagacacctaaaaataatattacaattctctcctccacttattgactttttgttttccttggacagggacatatatatatctatatacacacacatatatatatatgtatatgtatatatgatttaagatgtatgtaatatagtttatcatagagggtatatattatgtatatatgatatatattaatatatcttacatgttatatgtcatatatgcatcatatatcagatatatcatattgtatcatatatcatatgtatgatttatgtatgtgtgtacatatatatgtgtatgtgtacataagtgtgtgtgtaatttcagttgctattttcatactacaaacatgaatttccagacacaaaaatctgcaagaagacaatggtagtcacctgccatcttgttcctttataattcctttatattcattatataccatccttgaaaagcacaaggacattcactgaacctaaaagtatataaaaaatgcattgatttgaaatggacgtttattaccaaaagcgctaactgttctgattcactatgactcagatgaaatgctagaaccatgaataagtaacaggttttgtacgtccatgctcccaagactaaaagtccatagcaaaaaaggaacaaggtgctttttcaggttaacaccgtttggccacttcccactcacatattatggattggttaatagattttccccaaatctataaaaaaaaccaattacgttgggtttaagcatcactgaattcacagtagctcttattgttgggtcaccctacagcacagcttccaaatttaattacaaaatgacagtgaagtatctaaatcaaaatgtttaatcaaaaaaaccttttagggtttaattagtgaagttttacccagattcatgagaaaaacagacacctaaaaataatattacaactctctcctccatttattgactttttgttgttttccttgggcagggacattggagtggagagtttagatacttgtcaaactacttgagaaaataaggttgtaactgctttagaaaacacctgctaaaccatggcatttccttactattaatgttccacatgacataaatatgttaaggaaatgggtcacaggagttttcatggacaaatggctaagggaaatgggatattagtcagaatttgtgttcttatgacgacttaattggaacccaaagcactccagatatttggtccctctttgctcatgaaaaataacctacgcagatgctggattctcatgctgaaagcaattccttcattaaagaaatgtctactttttgtcactacatagaaggctgcagtgggataccttcctagacctaagaaatattatcctttgagacagaaacaagtttaaaacctaaaggatgggattaactatatgtataaactgcctcaaaatagcagattttgacttcagtggcatgaccactagtgaagtatattacaaatgattcattactaaaaacagttaagcactgaagttataaagggttaatttttaaggtaagtagaagagattcaaagttattgctatggcaacactatcttgggtgtgagagaaaaggatggggtaacagcttgtcttcccaattcacattccttggcctattttacacatcacatgatctgggcacaccttcagaggggtgtagagctagtgaaaatctggtagtctaaagtggacaaaaaataatgaggaaaaaaaatcgagaacatctaccttaaaaacaacgcagtatcgtcaagattaaggcccagaaaagcaatcaaggatgactgaaagtgaacaagaataataatctactccaagatattaacacatctcatggctgaattaatgtgtggctaaaaaacaggcaagaaaaggggtgccatagaggggtgcctcttgcactgtcaggatatagcacatgcaagatgacccatatccactcttcttggcagctccgtcccaatgatagaaacagatttcaagatattctaccttaagatcacaattcatcaactaagtccccttacatgttcagttcaccaagcaaccttctgatacaatttgactttccaagtaagttttccttcaagaagaaaccaccaactggccagttgacatgaggatcccagcatatgtggagtatatatttcacattgtacatcagtaaactgtcagtcaaaactacgcactggtcacaagtattcatttcagtgtcaacaaatcctctccagcataatcaactcttcctttactgtcaatatggaattccttgttctgccattgtgtagagctcttctagctaatcagcagcctctctttctaatcatcacatatcccgagctcccagatgaaggaattttgtgtttcccaaatgagaccattcttatataaagaacaaaatgatgaatggcaaagtaaatttcactaaaaagtcctatgtcaagaattctcaaaatgccaaacattttctatgacttatgtgtagtgacgcaacataaactagagtagaagtctgaacaaaaatggtcactaagaccaccatcctctaagaatggtaaatccattagaatttggtcaaaaatcatatcaacagttccttagaaacaaatagatctttcagaaattgagaaaaatattaaaggaattacaaaattctccataacatcttctatatcaagggggtataagattcattcaaatatgagtgtgctgaagacaagtaagtgtgttcaagtgttgctatggctctgcatggaccaatgcatagccagtgtcaactacaagtgataacacgaagccctgtgggaagaaatagcagagattggaaaactaaggtgataaaatgaaacatcaaccaaaagaaaggttttgaggtgtctaaaatagggcagttctttattctggcatataaagacaatccaaaactatcgtcctaagtagtatggggacattttttttttggaagaaagaataacgtgagtatgattccttgagatgagaaaactggaatacaggtgtccatgccagtaagaaaactgataatgccctcagggtccgtataaccagtgaatgcacacctgctgaataaaggtcatgtgacaaagcatttattgtttctcaaatctctggaaatgaacctaagacagaaacaatctctagtaaagacatacatgtgtcagttctacccacagcctgctgtttgactcttttctccccagatctgcaaagcagggcatacctccacatctgtacaggcccctcctatctttcactaccagcttcattgaagagcaggtcatgatgcctcaccctataggcaactaacatttttcaaaatatgaacatgatgaaaattaaataccactcaagtgtaaagttgtattcttctgctgttttcattaatggcttggcaaatcaattcaaatagaacaaaagatgccttaaaagctcagagtcatccattccaaattcatttatgtactccatttcaaactaacttgttaggaatcatctattttttaaaaaattaaaaaagaaaaaaacagaaaaaacacatacatttcttcaggtgaccactgtgagccatgtagcaagtcaaggtcatgagacaacagccttgtgaagaattatataatgtagatatgattagaggcaaattcctataatgtacgcaataacccttttgatcacagttatttgttctatgcaaactaacaagaatactggctaccctgcctcctccattttttctgtactaagattctaaataggagaatatgattatcttgagaaatattcagaaagaatggttgtaagaaatacaatttcctcattgagaaaacaaactgacaaagctgtgtcctgacagccacagtgaaatgcagagctaagaaattattatgtggatgtaatatacatatcccctcatacaagctttgttttatcttaatatggttttaaatttggcttttaattttcacatccttaatgatgtcaaggatcttttaatgtgcttatttgctagttgtatatcttctctagtgaaaagtttgttcaattttttgtatgtttttaattgggtcgttttcttattatttaatactgagtatctatatttaatgaatatcagttatttaacaaatatatgttttgcaaatatccccccagaatgtgaactgcctttttattctcctaatagaggcttttgataaagcataatttatcaatttgttttttatggtttgtacttttgtggtcatgcctaataaatctttgcttaacccaagatcaaaaagagtttctcttatattttcttaactagaaactgatagttttacattttacatttagctttatgataaattttgagatgtcgcttgtatgtgatgtatagttagaaattccttattttgcatatgacatttcaagcagtcatcatcatttgttgatgactatcattttcccttggaattgtctttgccctttattaaaaataaatagtccatacacatgtagatctatttttggagtatctaagctattctgttgatctgttggtctgtgttgatgccaataccatgctgccttagttaccatagctttatagtaagtcttgaaatcaaaccttctctgtagtcctccaactttttcctttttcaaagttgctttgtctattctggatgttttgtatttccatatgaattttagaatcagcttgtcaatttctaccaaaaaaaagcatactaggattttaattgagattgtattgaacctatagatcaacatgggaagaatttacatgtcacctgtctctggaaaatccccaaatatttggaaattaaacattacacttctaaataactcttaggtcaatgtagataccaaatggaaattagaaagtattttgagctgaatgtgaatgaaaatgcagcatatcagagtttggatcatgatgctaaagcagtacttaagaaaatctacaccactaaatgcctacattaaaaaagaaaaaaaaatctcaaatcggtaaccatgactttcaccttaagaaactatgagacaaagtaaacccaatagcaagcagaagaaaggaaataataaagatggatattaataaaatagaaaacagaaaaacaatagaaaatattaatggtgatgattaataaaatatattaacctttagccatgcagatcagggaaaaagagagaaaacacaaactacgcatataaaaaatgagagtgataacattattaaaaattctacagatattaaaagaataataacataatacaaacatcctttcaatttaattctatcatggtccatgaacatatttgtttgccttgaatccttttgaatttattgggactaatttattctcccagaatatagtctatctttttaaatattctgtatgcacttgaaaaagatgtgtattcttctatggttgggtattctaggaatgccaattatgtcaagttgattgacagtgttgtagaagtctttgtttccttgctgattttcatatctacttagtctattaattattgagaaagagataataatgtctccaaataaattgtgaattaaaaatgtttttgtagtttgtttcaagtatttggtgcataaatgtaaaaaatgattatattctcttgataaacagacaacattatcattatgaaatgaacttctttattgctgaaacttctttattcctgtctttgttctgatatctactgtcatatattaatatagccaccaggctttcttttgattagtgttaagacagtataccaatttaaaaccttttacttttgtgctgtttgtgtccttttttgattgtttttgtttttatttgtatatgtttatgcgatacaagtgtaattttgttgcattaatatgtttaatagtggtgaagtcaggaattttatatttgtgtctttttgtataaaggcataatatatttgaatattacaatctcacaatctctgccttttaattaaggcacttaagtcatttatatttaacgtgataactgatttgctttgttttaattctgtgatcttcctatttgttttctatttgtctcacctgttctttgttcccttcttactctttttctaccttgttctggattaattattttatgatttcattttatctgttgctggctaatcagctatatatctttgttttgttgttttagtgattgctttagagtttataatatatatgctcttaatttacctcaatcctccaatgattttataacacctcatgcatgatactgaaccttacaatagatatcccatttctcccctactggactttttgctactgtagtcatatatttcatttttgtatatgttataaaataaacagtacatttatattattttgtttacctagtcaattatcattaacataaattagaaaaatcgtatatatttacctatgtagttgccatttttaatgcttttcattcttttgtacagatctatattttcatacggcataattatccttcacctttccttaaaatttcttgcatggtgcgtctactggtgatgaattcattaagtttttgtatgtctgatgaaaacatcttaatcacatcttggtttctgaaaaatatttttgctaggcacagaattctttgttgattttttttcctttcattaattaaaaaatttagctccactgtcttatttgcattgttccccacaagacatctactgtcatccttatgtttgtttgtctgtacatatgtgtaatttttctctggcagtttttaaatttttctcttcatcactggttttgagcaatctgactatagtatgcttttgtgcagttttccttatattccctgtgcttgagatgtattgagcttcttgaatctgtggatttatagttttcatcatctgacaaaattatagcccctgatttttcaaatatttttcctcctctctcctctacctggggattccaagtacacatttattaggctatttgaaggtgtcctacaattctgtttttattctttttttctatttccttttgggtagtttctattgctatcgttttgctactcttttcctctccgaagtctaattccatccagtgtactcaccattaatctcatctaatgttattctgtcaataccatcaatcacatttctcatatcagatattgtagttttcatatttagaagtttgattttagtcttttaaaaagatcttccatgtgtctacttctgaacatatgggctacagttataagaactgcttttatgtatttgtctgctaattctaacatctgtttcagttctgcattggtttcaattggttgggctttttctttttattattattattattattatactttaagttttagggtacatgtgcacaacgtgcaggtttgttacatatgtatacctgtgccatgttggtgtgctgcacccattaactcgtcgtttagcattaggtatatctcctaatgctatccctcccccaaccccacaacagtccccggtgtgtgatgttccccttcctgtgtccatgtgttctcattgttcaattcccacctatgagtgagaacatgcggtgtttcattttttgtccttgcgacagtttgctgagaatgatggtttccagtttcatccatgtccctacaaaggacatgaacgcatcattttttatggctgcatagtattccatggtgtatatgtgccacattttcttaattcagtctatcgttgttggacatttaggttggttccaagtctttgctattgtgaatagtgctgctataaacattcgtgagcgtgtgtctttatagcagcatgatttataatcctttgggtatatacccagtaatgggatggctgggtcaaatggtatttctagttctagctccctaaggaattgccacactgacttccacaatggttgagctagtttacagtctggttgggctttttctttattgtgggtagtgttttcttgctgcattgcatgcctggtaattttttattggatgccaaacattgtgaatttcaccttgttgggtgctggatatttttgtactctatgtatatccttgagctttattctgggatgcagttaaattactttgagacattttgatcccttttatgtcttgcttttaagattgttagatagaaccagagcagcatataggctacagcttattattccccatgactaaagcaagacaaatatgagtcttttacctaattttctttaaataatgagatatataaatctggctagtgggaataggcacttttccctgacttgtgtgagcatcaggactgttccctctaatcctcttggatggttctgttctggcctcaggtagtttcctcattgcatgggttgctcagtgtagtagtttccctttacacacagaggatattttctaagactcccaggggatgtctaaaacctcagatagtgctgaaacctatatgtattacacacacatttcttttttcttcttcacaattgcattgatagaagatttcattcttagcatagatcttagcagcctcagtataattttttttctttctttattaagtcaagaactttcgtctttttacttaaaagaagtactttgtggcttctctttggcatatgtgaattgccaacatctccattcttttgctttggaaccattgttaagtaatataaaggtacttaattgcaagcactgtgatacttcaacagtcaatctgataaacgaggtggctattaagtgacaggtgggtagtaagtagaaccagtacagtgcggataatgctggacaaagagatgattcacatcctaggtggaatagagcagtgatatggttggctgtgtccccacccaaatctcatcttgaatcatagatcccataacccccatgtgtcatgggagggaccctcggggaggtaattgcattatggggatgagtttttctcatgatagtaaataagtctcacgagatgtgatgattttataatgggcagttcccctgcacacactttcttgtctgccaccacgtaagatgtgcctttgctcctcctttgccttccaccatgactatgaggcctcctcaaccatgtggaactgtgagtccattaaacttctctttcctttataaattacccagtttggggtatgtctttattagcggcctgaggacagactaatacaagcaggatggcatgagatttcatcacattctcagaatggtgtgcaatttaaaacttataattgttgatttctggaattttccacttaatattttcagaccacagttggctatgggtaattaaaaccacagaaagtgaaactgacaataagggagtactattgtactcttatattcttcagacctctagagtttatctctctgtaatcctcttctctccagtattttattctgttaactaaagccatcttggtcttcctggatttttattcaacttctcaactcagagagtcactgagatgtgcctatgtcactcctctctatgctgtctggaagtactctcaatggctatgggtaattgaaaccacagaaagtgaaactgctagtaagggagtactactgtactcttatattcttcagaactctagagtttatctctctgtaatcctcttctctccagtatttttcctgttaactaaagccatcttggtcttcttggatttttatccaacttcttaactcagagagtcactgagacgtgcctatgtcactcctctctatgctgcctggaagtcctctcaaggcagtaagctgagacaatcgtagggctcatttcatttatttcctggctcccaaagatcactgttctccatttcctgatgtctggtatcttaaaaagcactcttccacatatgctgtctggggttttgggttgtttcaggtgggagggtaaatccagttcttgttacttatctttggcaaaagaagacattcatagactgtcttgccgaccctttccactcttcataactcacttttcagtttcatgagaccatccataaacattccagttaccaggatattcaataaaggagaaactcctgctgaattccctccctaagacttggtttataaccacgcagggcctaatcataatctgttgtttgagaggcacaaaagatggctatctcttatttctctgttaatgtgatcaagtaaagttaacggcaagtttgtatttctggatagctataataaattatggcaagtccatgaggctatgttattacaaacatgactaaaaatgcactgaaaagagtatatttgtgtggtaacccacaaatcttccgatgccaatggaaaagtttaaagatgattagaatcttggctcagagacctggatctttttatgtcaatacatttctccctaggggtaagtaaggtactttcaaaggacatccattctttgaagtcagttagaaaattactgctgcaaggtatgaaatagtactgcagtagacttacagagataatgtacagctgcaatgtgttcattatgccaggatgtaatttacctttcagcacatactacttccccctgtgcatgccctggctcatgggagtttgggaatagccaactgtgattcagtttccactgggtttctctctcaatgttcacattgggcatgaattgtacccagatactccctctcaaatattaaagagaactagtcaccaatggttcccagggattggtctaggggtagggacattaaaaattgttaaattgactcccactcattacctgacataataggatccaaaaagaaatgttcaaaaatgtatccagttttttctacatagttttaaaaacaatcaatatatctcctgatctacatatttcctttttaaatttttctgaagtagagagctttaatgaccaaaaagaaaaggataggtgggactcatcaaattgctttccacttcctgccaccaagaattagctttagtcctgttaaaggttttggactaaaatagtgcaagtcactgaagctcaatgctctaagttctattgataccaaagcagtaatgatgtcatattagtccatcaatgaatataaaatgcaaagttgttcatgattatgtttgtgtgcaaacttccaagtatacagacacaccaggacctacttgaggaagtggaagaacaggctatggagggaaacagagacagacattaaaaaatgtctcttttatttatagcagtctgcttactgccccatgagatccagaatcctgctcattaaacaatcaaactttacacttatttgcacaatagaacataaaatctattttatcacttcccccctccccccaaaaaaacctgtttaattcttttaaatacttgggtatgattcagttacaaagggcgcagttaaaaaggctttatgaaggtgataaaatataatccacaatgcccacatgacatcattatagcagatgtttgtaccacaatatacaaatgcaacaagattcaaaatggcatacgaaaaatttgggacttgatttattctgggcttttatgctatagaaatttaacaggaagctgtgggccaatagttggatacaggatggagaaagtgtctgggttctgggtttgaagttgacagcgttcctccactgtacattttctggctttggttgccttgatttggtattgatggctggcaaagagcctctggtatttaaacaaaccttacctataatagagtctggctcagagactgtcattctaaattctattttgttctgtgtaatttacttcttagtcacaattattcaagaagggtacactcattaggtaagtgatttccatttgcataagcacattggtaaaaaaaaaaaaattgcaggtatgtgttccccaggtattatgtaataagacacctggagttaattatttgcattgtctttttagaaaaagtttgagaacggttttcatgcatgcaagcaaagacagcatgtcataacagcttagggctgaaagctaaaggggctgcttcctttataatagatgtgcaaagaattacgttccaatttattcttactcttccacctggttacccagcatttgttcttcaaaggtattctaaccaaatgattcaaagaagagtttagcatcaaatatgatgtctccagggaggtatgatttagagagtctgggattctctcaaaaaccactccgtggaaactttaatttttagcttaatatgatgtctgtgtatgaggggataactagtaatgaacctgtgtgatagctgaaacaatgaagtttatgtaaaaggccagggcaggtgtttcaatcttatagttcaaagtgtgaagggtaatataatttgaactttcaggttttagaaacagtaaaatgttgttaatcttgcgttttgcattgtcattgcctttaggacttgttcttgctggcaaaactgtattttacaaccatatatgctgcctcccaacattagcactataaagacccctgtttttgtttttgttttaaacaaaaataagaactagttcaaggaaaaaaaacatgaaaacataaaacatggaacatttcttatttatgctgcatgattccccatcaaaaaacttataaatacattagcagtatatgatactccattctagctgtctgatcagcaagtctaaaataaactttttatgatgtttaagatgaaaaatggcaagtaggaaaagaaagggtatagaaaacatttgtgatggagaaagtggggtgaaggggaagagatacagcaataatttataaattattgataaagggataatagtaccctttaaatatagtgaagggtttttttcaggatataagaatatattcacaaccactatttcaattttgggtatgattctaacaagcttacattaaactgcacattttatggaaaaatgtaatgagaataatactcttaccatctgttttctttgaatcatttccgatgttagagtgatccttcttgtctgtcttatttttaccatctttgaagtcacctgaaagtaataaacatgacaaacagtatatgtatgcagctgagggggttgttataaacatctttaagtctgccaagttttgaaaaagtgcagcataattttatagtcataagagtgtatgtgtctgagtgtaaatatcttttgtaatcacgttaggtcctggaaattggattgtgatgcagaaattgaggctgaaagttcttgttaaacagagttgtagttaagttatgtgcttatcttctaagagaagcagttaagatttactgttaagctgtggagtgaggagaaacccgagctaactgtaagttctaccaattaatagctatttaacttctctgtgcttcagttttcctatctgtaaaatgggtatgttaatacctaccttataggcattttggataaattagaaggcatatcactcaatacagttattattattctaaaacagagctagaaatggtattttaataaatgatcttgtcaaaatgtagtttgtaaaagttgtaaaatgctattcttagaacacgtgtcaaaaatgtatttaacccacttatgagggaatagtaagaggattccaagagtactggagctgggtattgacaggtattttagaaacacgtgaaaatatatttgctaagttagagacaaaactgggtatatcctacagggcaataaaaccataacgtttggggttatcttctctctcagtcaaaaatctataaattagcatataacttcacagtacctaggcttgaatcaaatagtaagtaaagttaaacacagtcatgttcttcaagagtagcattcagcaaattaaggcccctgggtcaatggtgcccaccatcgattatggcaaatacattttcttgaaacatggccacacttactcatttacctattgtccttggctgctctcatgctgcaacagctgagctgaatagttgcaaagagacaggcaaagccagaaatattttctctctggttctttacagtataacagtgctgcatccctatctaaaataatttaataatccctgggcatgtgtgttcaacaatatgccagtattacatgaaaaggtcaggggcctcttcacccagccttattttcaagtgttggatattttcttaccagtcttactaatggaagctttctttttagcctgcataaaaccaagaacacattctcactcaaatactggtacttattgaagccaaaagatcccaataataattggagtgagctgggcctccagggaatgtgtatgagggacaggatttactcttgtttactttatttgtgccaggcagtatgctaaatgctttgcatgcatcattttattaaatcttctaatagccccattatgaaggggctactattattgaaagtagacaacttcatcaaagattcattcactaaatgtccaatttgtaaaatttgctgaatatcccactcaccaaatgattgaggatgttttccaaatttaagtttttttcttgaggttcctgcagccagttagacaaacacaggccattccatctatgttaaggggtatggactgcccacacatacatttcataccccaccctgaactcacatctgccacaaccatgcacctggatctccctcttggcataactgccaagccctcaactatagtatttgcaacttctctatgaagttcaagttttagatttcagacttctgtttactatttccatttctaaatgcctttggcctatgaatttataaagaactgattatctaagcatgattcaggactattgggggctgtaatatattctacaaaccacatacttgcaatggaatttgacaaatactaagctaagctagaagtcaataaactcttcaggttccctctcattcttaattctgaaatgggatggaccgtgatatggtttggctgtgtccccaccaaaatctcatctttaattttacctcccataattcccatgtgttgtgggaggaacccagtggaagagaattgaatcatgggggcagtttcccccatactgttcttgtggtaatgaataagtctcacgaggtctggtggcttcataaggaaaaaccgcttttgcttggttctcattctttcttgccaccaccatgtaagatgtgcctttcaccttccaccatgattgtgaagcctccccagccacgtggaactgtgagtccattaagcttcttttcctttataaatgacccagtcttgggtatgtctttatcagcagtgtgaaaacagactaatacacactaggtggaagaattgaggagcaggggagtctactctggccagggtccaaacaggaggattttaagtgcaggacatggtcatcacctcttccaccaccaaaagagaagaaatccttcagaggtcccacaaaacagtccaaatactggcttttccctattttaatgaagccagagatggactcaaggatcttgagcactgtagtcaaactagttccttctagttcattcttccctcaatgagcccccacactcttaatgcatgctttttaagccctctaggttgctctgaactggagctttacccacagctacagcaacaccaggatgtcttctggaagtcgtggagatggttccctttgctggttgctaaccagcagcccatgatggttcctgttctcagccagggatggggaggctgtgggaggaagtcatctcaacagagggcaaagattagaagatcctgtcactgccagtgggtgcccaaaccttgaaaacccctccttcaccaacaaccttcagctctaacttggaagatatcctgggcactccacaaagaagggggctgggacagtgacacatgcttgtttgatgatgttgcctgagcaaaatccattaagtaatttcccatgggttgtatctggagtaatggctgacgtgagctgttactcaataaacaaggggaagtgaaagagactttctgtgcagttataaatcattttaattaggctgctgtaatatagtcccgaaccaccattaggctttcttattattgctctaaactgctttcttttcccacctctcatttactgcttactttttaagggaaatggtagactgttgcttatttcaggaaataagcacagttgtgaaatcaagccagccttgttgaagactcaggttcctgttttgtttctttcaggctttccccttaaccaacttcaaaatgaattattatttccacatctgccctctctgggtctttgtttccctatggtagaattcatatccttctttgtgactagcttatttgcatttattggtttctcccactgactagacctggggttggcaaactatggcccatgggtcaaacctggccctactgcctggtttttcatgacccacaaactaagaatggcttttacatttttaaatggttaaaagaagacaaatattttatgacatatgatattatgtagaattcaaattttaatttctataaataaagttttattggaaaacaggataactcatttgtttgtatattatctgtggctgctttaaaatggcaatgttgagtagttgcaatagagaccttatgttctgcaaagcctaaaatatttactatcttgtcccttatagaaaaagcatgccaatccctggaataagtatattgtaagcctcttataaacagcagttaagtttccatatttctctgatggcccctctccctgaaggcaccaaaccacagggacaagctgtttacctaacagagcattgagactcacacagatcagagtttaacctgagatctctacttaatggttgcttgactttacacaagtgatttcacttctctgagactcagtattcccacccacaacatgggaatgagtttttctacctcatagaattgttagaacttttacatgatttaatgtagatagaatctcaagtacaatgtctgatacatgttaagcattcaataaaatggtggtattattgttattgcttttactaagggcaagacatttctaacccactctgttaaaagaaaaagcagagggaagaaacacaccttgcctttctcaccaccccttacatgttcctcttttgagaggagtgattatttatctgggaggtagggttgagcatgcacagcccggcccagccacccacatcccagactgctttgagatatgttttctgtaagacacacaccttttctgtcactctagaagcagcctgccagggtgctggggtgggggaaaagtcctgtgcctggctatacagtgtctggttgtgtaaattcatttcagagcaaaatgtaaagaagcccatgtattcagcagaccaactctgtgtttcccaagttccagttttagtggagctgatgtcttgatcattgactttctgattttgttacctatctctcagttggttcagtcctcagaaggggtagcaaggaggggcctgtactgccctctaaaacagtaacaggtacataataaatttttgttttaaaaaatttttgtatgaacatatgtttttattttttttaatttttatttccataggtttttggggaaaagatggtgtttggttatataagtaagttatttagtggtgatttgtgagattttggtatagccatcacctgagcggtatacgctgaacccaatttgtagtcttttatccctcacacccctcccaccctttcccctgagtccccaaagtccactgtatcattcttatatttttgcatcctcatagcttagttcccacttatgtgtgagaatatacaatgtttggttttccattcctgagttaattcacttagaataatggtctccaattccatccaggttgctgcaaatgccattatttcattcctttttatggctgaatagtattccatcgtgtgtgtgtgtgtgtgtgtatacatatatatgtacacacacgcacgcgtgcatatatatgtacacacacacacacacacacatatatcacaatttctttatccattcatggattgatgggcatttgggctggttgcatatttttgcaatagtgaattgtgctgctataaacatgtatgtgcaagtatctttttcatatgacttcttttcctctgggtagatacccaggagtgggattgctggatcaaatggtagtttgggtacatgaaaaattcttattaaattctttataacttttttttccagactataatgcacttgaatacaaagcaaatgaattaagagcaatctccagaagggggcaggacgagtcgggacaatggccttctgtgcctcctagggtggtcaccaggattaactgaagtaatttttgcaaggttcctggaatatgatataagctatcattattattacatgtgttaaaatattgttctctgattacatgttataaatggttaattataaaaataattggagaacatcgtgctaagcactttctacatgtagaaatcattgaccacggccctgtggcataatagctagaacacggttctgagtagattacctggtcgcaccaggcaggcaagagaatgaatatgtacaaagagaacttaaaacagcatctagtgtgcagtcaatacatgctatttgttgttattctcttcactgtttttactatcatgagtattactgaaggttccatgaggcctgtgctgtgaataggtattactatatacattgtgtagaaacagtagaaggttaagtagcctggccaaggacactgaaaagggagaagcacagcttgacttgaatctaggtctgttgactgctaaattaccttgctattcagccacaacctgtcaattgcaagctctggagactcagaacttcctgcctgcccctaaacaaggaaaccaaatcaaagccctgtgtacttgctcatcttgttctctccactcagaagtatctttagcccatctgaccagccagcttcagcattcaaaaccccctcttgaagcctactctgacatttaccccattttataatccccagtccccaaaaagctaatgtgtttttctctgcacatgttcctcgggcattttatctgccatgtcactactttcacttgcacatttcactagaaatatttggaggatgtctctatcacctttgatattttgggcttcttgtggcctttccatttctaaatccctagtgctaagcatggtgcttggcacgtagttgttaatcgatatttgttgcattaaatataagaaatcaataactatatgcacactatggtgaccagcttaccccagtttgcctggagctcttctgtttttaaaacagaaagctctgtgtctcccagtcccaggtaaactgaaacagctggtccccctaaagtacacacttgtacacacacagatatacagatatctattacaggaaaaggctcaggcaaacctgaggtctggccctcatagagcgatggtatatatgggaaaatgactttccatttacccactttacactcaggaatgtgctggggttgatcatggtaattttcccccagctggcaggcaggcaggcactggctagagtctccagggcagctggaaatggccagaaaggtatcaatctccctgaagaggatggcacaggtgagctggtagctgcttctgctggaatcctgcagcccaatgaggtgggatcagaaggaactggatgagcagggaagccttgccctgtgagctgaccccatcagtagggttgttcaccagtttccattcattatgtcattaatgccgcgaaaagagcccttcaccagtgtaagtctactcaccattctgttgctgttctcctgatgacttctcggctttggagtttttcccacgagggttgtcacttttgtttgcccgtgttccattgacttgattcttagtttctccagacgtctttttctcagctttgccagatgcgccttcttcagcctggcttttggcttccatttccttttgctgctcctctgcggccaggcgagccttttcctctgcttccttcttggccttctcctctgcatccatggcaagttgggaaagccacagaaaagagaaaaagaggtcatgccgttaggagaatggcctgttttagtacacaaagagtatctaaggtgtttactgagtgtttgggtacatttttgcttaattcatcagattggcatgtatacttaggaaacgaataaaataggttcataatgatgtcattctgaaaacagttagaggagaggtcagggagaaaataataaggataataattaataaaccaatattataattgtattattaatatcaccgttattaatagcttctattgaacgtgttcgctctgccaagtattatgctgagtgttttttggggattatttattttcatcctcaaaacaaccttacagcagctactattactgtgactcaatttgacaaatgtggaaatcaaggctgagagacatcataaaactttcccatagccacagtaaaaactgcagcttcatgtgggcttgcttaagacctagagtttaaacacaaacaattgattacaaaacaaaaagggaaaatatccaacactagagcaattgaagacaaacacactgaggacactgtttgttaatttaaaacaaggaaggggataattgagccttatgaaaaaaacatggtcttcaaactgtccacaagatgagaggtagcctttagtttggccaggtacctggtctgtgtctttccttttaatgaaaagatgctagcattatttctaatccagttgattataaaagggcttggctctgtgcttagtcaaaaccaccgcagaaatgcgtaggttaagtatttatgaaaagattggttcactcatccaactcatatttattgagcagttgtagcgttaagcactgttttaggtacgaggaatacagcagcaagcaagtggatttataaagaggagatcataattaagtaaacaaatgactaagatacttgcagtttataaaaagcgctttgcagaaaaccaagcagagtaatatgctggaatataatcagcataggggagggaaattgcagtagacaaggaggtggagaaggaaggcctccttgacaaggtgacatttaaccaagtcctaaatgatgaagagctggccatgcaataatctggacaaatagtatctcagtcagaggaactagaaaatgcaaaggccatgaggtagaaatgagcttggtatgctcaaagaacattgagtatggttaaagtaaatttgacaagggcttagtgatagatgacgtggtcaaatgaccaaggacaagcagggttcagatcatgcagggctttggaggcaatgaggtggcattgcattatggagaataacctacacagaagacacataacagagcccaatcctccaaggttctagagactcatcccatgcagcgcttaattcactgccaaggtcttctagcctgtgccatcaacttccactgggaaaagtattattacatttttctctacatgtgttttaaaatgctccacacatcattatcaggtgtttactttatttcttttgtgttagccttggtcctagaaaaaagctaatgctcataaataatccatttgtttttaatctaatggacaccagagtgactatgcatctatcatgtttccctttgttttagttgctaaagagctcaaagcccaaatttggtccagattcacacgttcacgaggctttatgacatgtattttgtgaaagtctatgatatcttgtttagtctacttctcctgactttatatttgcttacctaagatgtcttccttaatatattatgttttcattcattgatccatccatccatccaaaccaatgccctagcctcatccccaaacaaattaaataagattctggagaaggaggggcaagaataggatagtttgaatgttttccaggtgatttaaacatacagagttgagaagcactgatttaaatgttaaatgtttgccattcagtatttcatgacattctactccccaaaaggatgtatttgtaatttacattgaaaaggtgaggaaagatttctttacaaataacataattatgtgcatgtaaagtataatgtcttctggcctttatagaaaggtacaactacagagtgaaagaatgctcttgcagaagaagatggtgagatggcattctcagtaggatgcaggaccacaaaaggttccctggaatgttcactcaggctttatctcttccttcttcagtgactgaggatggggtttaaatgtcatctttgctactgaattcccagtgcttagcatggtgcctggtgcgtagcacacactcgaagtatttgttgactaaatgaaatgtaccctacgggtgtgatttatcctatatgcaagtgtaaccttatctgtatgtatcttcatcagtcctcagcaaattaaacaggcataaaatacagaaagtatataaactctaagtcttattctgaaagagtagtcatttgacaaatgttagtttccttaaccaataacgtaggtgagtaaaaagatgactatttttactacagagtgggaaactgaggcaaggaagaggagaattcattcatacccagaacctggtatcaattttagaaaataatttataagcccctcacagaatccccactgaatccatggcaaattttcaatattcaaaataaccccaagttggaaataattttgataaaaactgaaggtattaaatgctggtttgctataagagagtataaaatattatctgagcaagagaaattcatttgacaactgagtcagaccaatttcccatgggaaatctagctaaaagcatacaaaaaactggtggcggggggtatatttcagaaacaaacctggtttttcctcaactgtagctatcgggcaattcaagtttacatgaatgaatggtagcccttctgacatcatgatctaatcagatacgagcctatcctactgtatgatttctctacagcaatcatgttccagcaggtggtcctgcagcttttctactcaatttccatctcttagtcacatctctgagatagctgacattagtgtgatcgactgcatgacacccaaagtggtacaactcaaaatttgtagactgaaacaagcaagcacataaataagaaaaaagaaaatatattgacaggaggtaggtctttttaactgcaatcagattcctttatattttctgggtgaaattatcggtatagatgaaattttcgtataacaagaaaaaggacttgagaacagttattttgtacatgctcacagcttccaacgacagcaagtatacagagaattcacttttcaggtcttagatttagcatctactaggcttcttgactagtagaaagcaagagatgtgcggttcatttctgtttcctttggcttcccatgtcagactgtctgtggtgttgggacttgggatgaaaacagccaagagcaagcagctaagagttaaggtagagcagagccctcgagatccataaatttgcttcctcccagtggagagccagttctaccccacaatgcatgtccgtacagttttggggaaatacattgatttctttgtcttcctgaataatgatactatagggtctcagttaaaaactgtattgggctaattatcccttgatataattttctgaaatgcctacttaaactacctacaaccagagagagaaagagagagaaaaaacagagaaaagagagagaaactgaccagaaaacccaaaatactatatgaattttgactatttcaaatctcagttctatacaagaacaaagaaaggtgcttctagacatttaagaacatagaaggtgttcccgcttcctgaaaattttagtcaaagaaagaagtgctccagctgacagaaaacttcaatcaacattaaaaactcaaaaatgagaaaaatatgtaaacgaatcatatactgtaaatctaaatattcagtatcagaataaaatattcaaaagaaaggccaaatacaagacaatattatattatgatcccaatttgtcggcaaaatttttacttatacatatgtacagaaaagcaaattacaaagaataacatcagaattttaataatagttatatatgtctagagaggtaattagtaattttcattttcttttatatatattttttatacttcagcatttgtaacctaaacatgttagtcttacaccagaaaataaatgttaaaaaaaagtactaaatactgaatggaaattaatcaatattgatcagacttgaaaattgttatgtccatacatctttagttggcaatagtgatttttaactctaagggctataaaaatatttatttaatctttcctaataattatcagttcttgcctacctagttttgtaaatcaggttggttaacaaaaccaagacccatttccagtgcatttactaacaatacatgttcaagtgccccacggaggacagcctttcttgaaatcagggtcatctggaaaaaaagagcaacaaacaaaacagccaccaccaacagaaaacagatgcgaactagatttctaattagcaccagtcaaccagtcaacagcattactgagctgctaagaatgttataaaatattagttacaggttgctattttcaccaccaccttaacttcgtattcaaacctttaaccttcttttccaatttgcatacataacagctactacttaggtaccaaccttgtgcaggctgctttctcagtgctttataggtattacttctattcacctcaattctgcgatgtacattatcatccccaaagtgagtctcaaagaacctatctgaatttgccaaaaaaaaaaaaaaaaaaccttgcaagtcaagactcaattctctctccccttccctgctaattgaaatgtgccctgataaccaaactattctcccacaagatatccgtaacaccaggctctgtgcctttgcccaacccctttcttcttgttcccatttctaaatataacacctccttcaggtcttaatcccagaagtctgctacatgatgccttcccaaactcccaagcaaggctacagacaacttctttgtgcttccaaaatagttcaaacacacagttatctctatccccataccaaatgcatttaaaaattattagctgtttatttatctgttctttttaaagggccagttttctcctgaaactgtcaaatgcttccccaggtgattagtttctgaaggtaattttagtaagccagataattgcaaacaaattattttgaagtacctctttaaattgcatgttgtcagaaattgaattttcaagtgtaatgagtgtaattgattataagagagtgtttctttgcagatgatgcagtagctgccatcgctgcttgcaatgcctgccaacagggaagattgaaatgtttaaagcatttgaatggactaggagagggtgcacttaaaatatggaaggtgttggctccctccatagctcagggtgcaacatctgtcctgaaatgataagggttcaattatgccctaaaagtgccataaatataaaccctttgcctcacctgaaatgagcagccacttgaacagaattttatggacaagtcacaaaattggacagaattttgtgaacaagcctttgaataactccaacagtgaggctgctgctttcctacactagaagcagaacccccagccccaacccaatatatgggaaccaacactgctagaacatgctcttacccaccgtccccacccttctcacctggtatactgacaccaggagggtaaaaatgtgagatgttgtgtttggggaggggataatgtgtttttgtctgatgtgagggcctagggcttagactggtggtgctggtggcaacttcagggctttgactgaacttccattcttcctttgaatgaaattctgtagtaatgtctcttcccttcccctgccacaagattgtgagttttgagggcaaggatgtctgttactcatctctgtaccctgggcaccgggcacaacctggcacacagtaggcatgcaatagatgttagcaaaaaccgactcttgttgaaggctcacctctaggaagcccagtcccctcactgggctcccagagccaccatgtctttgtccctacctggaatcagacatcacagtgtcagaccccttatctcaggtttgcgctacctgtgcacaagggcatctctccctagtatgataatgtagaatgtaccgatcatggaggacatgctcagtagtcacaaatgcacatatgaacaaaggaatgtaagctttccaaatcatacaaatttccatatttttctgttgatagtaccaagggccacaacttttagttttgatgatgtctgcttcagggaatttctgtttaccgacaatttaccatcatctcagaagatcagttatatggtttgagcaatgagtgaagggaaactgagaatatgaaaggaatataaaaatgcctgtaagaaaattaaagctccttatatcccaacataatggccaaggcaaggtggctattagcgggtctttacttaggtaaaagaagaaataaaagcctcacagttgtgccacatgatatcaagtgaaaacgacaagatgtttagcagaaatcaagaaataataacacccatgtcctgtagagtcttcatactagaaaaaggagtttagtctcacagcataaagggaatcatgtcaggaggcttgcaggtctgctgcattttatcatgcattgattcgtagatattatgaagatcaaaagatggtagattctaatattcggcaatttgaatctgcatcctgagcaactgtgctttatttgtaacacacataactcagagaggacaaccttgttttatgctgaattggtttggacaggtctgtggcatgttacctttgggtaccttggccctccatctctcccgattgatgtgcaccacttccgtccaagtagctttaaagctcttatagtcaacggagatgacagaattgttgatcggggcacttccctctgaaccagaggtcttgacacctgatcgcttggcatctgacgagctgatgctattcaaactggaaaacaaaaaaatcataccaaagaagagagttagtgtttggaaaatgtctgccaatgagcaagcccagaggaggaatggttagcactcctaaagttattgctgtgaaatatctggatcctgaggtttataattattctattttccacatatgaccggtgggaaattctgaattttcagcaggaaaaacatcaacattgcagtctcaagagtctctatattcttcatatttcttctttgctatttggcctcttcttttttccccataaccagaatcccctcatgtgaattttctctgctctgttctctgaaactgactaatttgaactgggacatctacttaattccacagttcacctacctgcttccacactgaccacttttccaagttacctagcaacttgctcctctttctttccagctctaccattcccctgcaagggtctttctgatcccagcatacccaagtccaggggaagtgataatttccttaagttgctggaagaagatggaaatgcggacagcatggagattgtgagggactaggtcatgcaaaagaccttatgggtaactttgtaaatattagaaagcaccatctttctggaaaatctcaaagaagtaactactgctaccaagtggttaaagaagtgactggtaggaatacaaattcatgatggactagacaagcagaatatatttcagtcactgcctgaagagctgtggggccatggggactctggcagggggctctgtcctccttgttagcaaacttaagagggtctatccatctggagcatccctggggtcccctgtcctaacgcctgtctttctttactccttttcctgctctttgcttcttcttttcctattcattccacttctcttcttcctcctttatgacaaagcccactgttctacatgaacaaggagattagtagtagtcgtaatagtagtagtatatctaataaagactttatggtagctagcacttcctctgttctagatcctgttgtaaggtttaacatatttttaataacttatttcgtcttcccagtcacctctgagtattataatccacgttttctcagatgggggaagtgagacaattggcctgcgattgcacagctagtaagtgatgaggtcaggagtaagtgatgaggagctgcccttgatataatgatgtggtggtagaaggtgatttcaagctttcgattctttttctctacttcattctttgtgcaaaccttgaaatgaaagtcagtttcatttctttgtaagtattcttgatgagtggtactgtctttgtggagtattacatgagcaaggattgtctgggcacagcaggtaaacatgcagcaaatagggtggcaggggggcagcaccaggtgcctgctggtcacgatttagaccttggtcaccctttacagtttagcctggagagtacggataatacaatttcaactcctctgagaaaaggaaagaggcagacaaatttttctgagaaggagctaaggcaaatgccattatgaaataccatccccatccccagcaaaagaagaattctatcctcaaggacaggccaacctcaccctcagccctcaagcttccccactgacctcgaacgcctctgtcctgtcccaccagtttgagaggtttcatcgattaatggactcacaatcttctcggtcatgtccgtaagcacagtgaaggtgggttccacgatgaaatcaatgaaacctgaagagaaacagcaatgcttcagaggaaccacatattaccttgggcctttccatactttccagaagaaactgatctagaagttccagatcagattaaaagagaatggcttgatcttatgtactgtatgtattccttgatttgaatattacatgtcagtttcatttctcctacataacttcctatgacttttcaggatacagttcaataaagtgcctaagaaatatacactcaacacccactatagaacaagcactgtgataagagctgtgtaaaagaccaagactgaataacacaacctgcctgaagttgtgacatttgagctgaacccttaagaatgggtggagaggaagatgtggctattcactctgggcggtgggaatggaaaaagccaagtgacagagatgggagggtgtaagatgtgtctggggactgactagggagtagggattcttttggatttggggaaggaaagcttgggaaggcaggttatcgacagctctaggaagggaggcttctaagtgttcagatagagggttgggacttaggtggacactggaggctcctggagatgtttgagccgcattgtcataagagtttttaaatgttctttggaaagttaatctggcaagatagataagaaggaagaaagcaggaagggagaaggatgagaaaatcatttagaagctattgcaattgtttaaacaaaagataaagaaggctggaaccagtgccactataaagtggaaatgcaaagcaggcacagatacctgcacagcaggaggtggtactgcctctgtatgggatctgccaaagacactccaacaacaaagcagggaaaacaggaaatagaaggagaataaggccaagaaaagacaatgggctcagtttcagatttgctgactttgaggtacaggggggcacatctagatgggagagggcaaacagagttggaagaaacaggattggaaagtggaagagggctcaggcctagaactatacctttgtatagtgatagagagatggctgaagtcgggctacagagattgtcccaacagctcagacacccaaatgttctgcgacaatcaggagagaaaataggagctgaagctagtggggatgctggtaattcattacacagtcacatgaaaaccggaaggaaactaaatatcaaccagaggaaatgttgtccattctccttcgaagggcatgtttggaaatgtatgaatgcatatttagttttcacaatggcccaggtagaggtaaagctggcattaatgcccagcagtaaaggatgttaaaagtcctacaatgtaattgacaaaacaagaattgtctcaaccaaataccaatagtatcgtgattgataaggaaacagtgatagccaaaagtgtattatggttaatacagtgttgtaattgtgtatgtgtagtatgtattgtgtattatggttaattatagtgtagttttaagctgaaactaaagtatttgatgacaccatttttgccttttttttcctgacaaattaagctcaacatgtccaaaccagaactaactcataagcttccccacaacctttgtaaatgggatcatggtccaaccacttaatgtagagttctgcctttatctcagctttgcgttcagccaaatccttgataccttatgtgccacctctcttctggagaggccccgttactaccttagttctgatattcatcatctcttctttgtaatcctgtaggaggcagtcaactactttccttgcctctaatcttactgaaaatcctccaattaatcctctatgctactggcaaagaaatcttctaaaaacagggtaggcaaactttatctgtaaaggaccagatagttattttagactttgcaggccatatcatcgctatcaaaaccacttaactctgccactaaagtgctaaagcagccatagacaatatgtaaatgaatgcacttagctatgttgtaataaaactttatttacaagaacaggtggtgggccagattaagcccacaggctaaaacataaatttatatatttttaacctcacttaaaattctttagatatgccctcatttcctacaagaaagtataaacacatgctattattaacactatataaaatctgggcttgatacgtccctcactacatcctactccgtacccaatgttcttgccatatggaaatgtttagaatttgctgaccataccaggcagttttaagtttccctgctttgtatatgctacattctctgcctggaatacccttctacccacccctagctcacctccaacacagatcaccatttgcccagacaatgcctactcacttcttgggactcaattcaaatattatcccttaataaacctaatggttcacacactctgttgtgtaccttatcgtactaggtacaaaagtctaccttggcattataacattctaatagatttttgtttttgtaacattttgcccatcacccaatactggtttaatgtctttgagagcaggtaccatatataatttgtctttgttcctataacatctattatcatgtctagcagtgcccaatatatgaagactcaatatacattataaaaaaagcataagcactcaaaacacaagtagaaaaatgcctaattcttattgaattttcttaaatgacttcagactcttcaaaggtggagatcactgacaacatttaacttagatagggcactggtgtcctctcccacagatgaagatttttaaaatgcatatattatggttattagcaattcaaaagttattcttaccttaaaaaagtgctttaaagaaaagaaaggatggaaggaagacaggaaacaaggaagaaaacattttaaaagatccattcatggaagtagattcaacaaggaaatggggctgtcctgaaaacagggctaggagaagcatcagtgagtagaaatgccttgttagcttacagtcctgcatgcagaatggcgggatggagtagaatgggcttcctgccaatgacacttgttatctccttggaaagttggggccccctctttctcttgacagggaatgacagagacaccaagagtatcattgtccaattctcccatgaacaagccacattccagggaaaagaatggacagagtggttccataaattgaatcaggcagagccatgagcacaacatggcagaatggagccagtttcccagccaaagaaccactgggatcatctgtgcttacttctacaggcttcctgctttggtgcttctatccaaagagctgcaaacacgtacctacttgtgactgagcaaccatagtggactttcggtcacacagaggagaaaaaggcagccccagctctgcttctctgtcaccctggaaaaataaaaggtcatagtaaattaaggaacagtaggctgggtcacccagatttcatttagcaacttctgccgccacggaggccactggtctttattttaattattacaattacattataaaataagtctttatggagcctgcttctctacataaaagacaccaaaaggctgaagccctctgggatccaatagttccacccaactgcaaagttcatgttgctgtaaagaaagcctcattgggcagtactaggacctccatggaaaataaggcaacaggcaatatgtcttgtggcctgcagccagcactgcaggcagaatttctgtgttttctcaagtcatcctgggtcaacctgtggccattgtttagctaatgaactcctcccagatgtgggcagtgtctgaaactaaaattcaaactggactgattcagactgattcttctagtgctacctaaagccacacacacttggagcaagtgcttctgggtttttaacctcagagaccagtccataatgaaaagtggaccaaaaagagaataaataattgcttgtgtctatgaagttagacaacaataaaacacaattgtctaaccaatatattctcaatctcaccaaaaagcatcaccataataagcattatgaagagtctaaataataatggagatgttttctaaaaacttgggccagaggcttaatacttgtcatacccccagaggaaaggaaaaataatatgtcacccttcttatagtagtgaagctgtgctaattcattttactggctcaggataatagctactgacttgtgcttgaatccctttctcctactagatgtgagatagatcacaggtaagttattttccttccatacattttagtttttatcacttgctaaatgtgagatagtaatctctacctcatagggttataaggatgaaagaggaaaatgcatgtaaataaataaaaagaactactgttgtttcccaacaggtggctctaatatttaaggccaagactcgagaaacctttagtgaatttgttcacctaatacactccgattgtaataagtactgtcaataaattaatgtaatagcaaataaagggtagtaacaacctgcaaccaggcctggttcaaaactggatgattcttccttctaaggcatgctaccaaagagaatggatattggctcacatgtagcattaactgaaaggacggaaaaggggtgtgtgtctgaggcagctcaacagtggggtcacaatgggagctggggacatccaagggtctcaggaatagtccctaagtggctcagttccttctgcaccctcttcctatatagacaccccagcggacacaatggcttctttatttcaagtacgcactactgaaaactgctctctcaagtggcatgataaaaatgatttcctcctgagtgatttctacctaggtgatatgtagaaaaggaagtgcatttataacataaattctagtggtgtagatggtttggtgggatagttcagctaaaacaaacaaaaccctttttattcccatgtagcagggatacaaattgttctgtcagtacattttaatggggagggtgtgaacactctccatgactattaaaatataaacactaatttggatttcattactgaacaatcacctgatactaaataactcctaattccacgaacttgtctatacccaaatatacacataatttacatgctttgtatttaattgagctgtgtagactcgactaataaaagcttatttttaaaacagaggtacttgaattccctttggaaagcagatatacttacgaattgaaaaaaaaaaacagtgctgataatgtagaggaataaacttctactcatgagtccaacttgagtgataacacaatactgtatgactctacagctatagcttaaaattattcatacacttcctctttattgaagaggtcaacattttcaaaagagggcaaaagtctctatttacacaaaggatttttaaaaactcactcatttttttttcttccaggacagcgcagaaaaataagtatcattcctgcagtaggggttaagataactccaactgataaagccacatagttggcacacagaaggaagataatgaatatttgttgaataaatgaaaagactaatttggttagaaacactcaagttcctttggccactcagacattcatgacagacaaactaaagacagcagttaggcaggtagctgttcaccacatccctattcttctcctcctccatttcctgtctacacagctagaccccattgcctagaatcactgccagttagtgctcaataacagaacgagagaagggatgcatttctaccacagttcaggcctacaatatctcttatgcctacttctccatgttttccccagtttgctggtttgatgtagacaagcactttggaagcaaggtagatggcagaatacggtctaaaatcattgcttatcatagaaccatctgctaatcaagaaacatgagtcctatactgtacatgagtgagttcaaaacttctgtttatgtgtgttgttatacatttgggggtagctatatgtaagcagcaaaccagtcaaaagagacaagggctccatctgtattggaagttcacagagaagatggcacctgtcaatgcaagagcttccaaagacatttaggtaatatctcaagtgagtcttttcaggtgaaatgaagaaaaagcaaatgtttgggaatgcaacagaaggatcaagttgaacaaagcacagcaatgtatattcttctttcccaggggaggaaggcacaaatataacatatgagaaaggcattgtgatgttggatttaagatagcatagtaaagttttagctctttcagaaattatcacctcaaaaataaggagagtaagaaacagaaatgcaatcacacatcctaggaaaaatctgtaatctaaaatcaaaactatatgagaaagggctgccaaatgctgtaaatatcagagaggaataaggcaagatgccaagaggctaggcagagaatagacattgaattgcaagaggccctacaaaagtaaggaagtaaaggcacacacacacacacatgcacgcacacacacacacacacacacgcacatacacaccgcttcataggaccctaataataaaccaaggacaattctagatagcttagaatactactgctctgattgccctgtggtacaaatctgcaaatagttggtctgaaaagaacacatttcactcaaagattgtaaataacaataataaaataaagtgaagaagaaaagagaggaggaggagaaggggcagacggaagagtagaaggaggaggacaaagagatgatggagaagatggaggggaagaagaaaaaggtgaagaagaagaagaggaaggaagagataaaagaaaaagagcaaagggaggagaaggaagtattataccatcagcagcagaagcaggaataaagaacttcaaacaaacaacagatggggaatactcatcagataaatggtgccactactaacagaaagaagcccctgaaattgttaagaacaagggctcaggggaatgagacctagcagagcacaggaaagacattgaaaagggaagaaaactagaactatcacattaatgcagattgtgctggaagcagctcaaaggagaactgaattgataaaaataaaaaggccagtgaaggcactataaacaaaaagagaaacaataaaacaatctgataatttcatagagaacaaaggaaaaaactcaccaacacgtgtaataaataaaaatgggaaaaatactatagacacggattaaattaaaagaattgtaagagatgtttgcaaaatataaaattgtacaacaatacaaagaaaatgaacctcacagtttttccaacatgacatatttaccaacgaggtgaacttatacttctttaaagtcaatatttcatcaaaaagtaccctgaggcagtggctcggattttgtaaattatggttataaaactgaagatgtaacttactctcttagtaaccatggaatgtgtggtccatcagcactgagactatgcccttattttaaaatgtaacccaactttccaaatgtaatttttaaaaacactctatagtgccattgagatttcccatttgaattgtccaatttaaaaatctatagttaagaactgaggcagcatttctcttacatgtgttacttactatagcttatggcatctaggttaaaatattaagtcaataaaaataatttactgaattttaattactaaaaaatagttccagtccaatgagttaacagtcccttcccaacaggcaagaaattcaatatggttattttcatattgcctctagcacatttttattcgagtatatgtatgtgcaaacaagttttcctttacgaggaaaaaatgttcatatgtttaagtaattcatttttactttctcataattagaaaaagaatcactttaatacctcaaactatatgagttagctattatctatcctttcgccatggaccaaatactcctagctgtagagggtttgttatggtttggctgtgttctcccaccccaaatctcatcttaaattgtagctcctataattcccatgtgttgtggaagggagcccgtgggagataattgaataatgggggcagtttcctccatactgttttcatgatagtgaataagtctcatgagatctgatggttttacaaggggaaacccctttcacttggttctcatgctgtctctttgctggctgccatgtaagacatccctttgtttttcctttgtcttccaccacagttgtgaggcttcctcagccctgtggaactgtgagtcaattaaacttctttcctttataaattacccagtcttgggtattctttatcagcagcgtgaaaatgaactaatacagtaaattggtactggtagagtgtggctctgctataaagatacctgatatgtggaagcgactttagaagtgggtaacaggcagaggttggaacagtttggagagctcagaagaagataagaaaatgtgggaaattttggaacttcctagagacttgttgaatgtctttgaacaaaatgttgataatatggacaatgacatccaggctgaggtggtctcagtggagacgaggaactagttgggaactggagtaaaaatgattcttgctgtgttttagcaaagagactggcagcattttacccctgccctagagatctgtggaactttgaacttgagggaaatgacttagggtatctggcggaaacaatttctaaacaggaaaacattcaagaggtaacttgggtgctgttaaaagcattcggttttaaaagggaaacgacacataaaagttcagaaaatttgcagcctgatgatgcaatagaaaagaaaaacccattttctgaggagaaattccagcctgctgcacaaatttgcagaagtaacaaggagccaagacaatggggaaaatgtcacacatcacagaccaagaggcctaggaggaaaagatggttttgtgggctgggcccagggtccccctgctgtgtgcagcctagggacttggtgccctgcatcccagatgctctagtcatggctaaaaggggctaggtacagctcaggccatggcttcagaaggtgcaagcctcaagccttggagatttctgcatggtgttgagcctgcaggtgcacagaagtcaagaattgaggtttgggaacctccgcctagatttcagaggatgtatgaaaccacctggatgtccaggcagaaatttgctgcaggggcagggccttcatggataacctctgctatggtagtgtggaagcaaaatgtggagttgaaacccccacacagagtccctactagggcactgcctagtggagctgtgagaagagggccactgttctccagatcccagaatggtaggtccactgacaacttgcaccatgtgcctggaaaagcagcagatgctcactgtcagcccaggaaagcagtcaggagggaggctgcacctggaaaagccacagggacagagctgcccaagaccatgagaacccatctcttgcatcagcatgacctggatgtgagacatagagtcaaaaggagatcattttggagctttaagatttgactgccatgctggattttggacttgcataggccctgtaacccctttgtttgcccaatttctcccatttgaaatggctgtatttacccaatgcctgtacccccattgtatctaggatgtaactaacttgcttttgattttacagactcataggtggaaggaacttgccttgtctcagatgagacttcgaactgtggacttttgagttaatgcagaaatgagttaagactttgggggactgttgggaaggtatgattggttttgaaatgttagaatacgagatttgggaggggtcagggtggaatgacatggtttggctgtgtccctacccaaatctcatcttaaattgtagctcccataattcccacatgttgtgggatgaacctggtgagagataactgaatcctgggtgcggtttcccccatactgttctcgtggtagcaaataagtctcatgagatctgatggttttataatggaaaaatccctttcacttggtcctcattctctctctttgctggccaccgtgcaagacatctctttactcttctgccatgactgtgaggcctccccagctatgtggagctgtgagtcaattaaacctcttccctttataaattacccagtcttgagtatgtctttatttgcagcatgagaacagactagtacagggtgatattgcaaaagtattatcaaagaaagcatatgacagggggagtggagatttggagaacatcctcctactactattagaaaaacagcctttggaaaaatagctcaaaagaagctcttggtgaaggatgattttgcggagtcacctgtatagttctagttccccccacaccatggagtcccctttgagaattactctgagagggtgagcaatgactctgcaaagagaattaaccataaactaaatagggtacctgttgacatacacatataatagctggggggtgctgcggtgtgtgtgtgtgtgtgtgtgtgtgtgtgtgcgtgcatgtgcaccatagacagagtgaaggaaatgccttgcatttcctaacaaaagggtcttaagaaaacatctcgtccaaccttatcctaaatccttccctccccccgctcccccaacataaatcacagataagaccatagggaattagagaagcaatttgattagactcaggccataaatcagtggaaataaactccaataaagggtcttctggcatttgtttaatgtgctgttaactctagccctacttcattactagatagtttcagaaggaaaacacacacacacaggcacacacacacacaggtgccttctacaatttctgcattcagacttgaaatctaagagtaagaattatcacaatctaaatttattcagaaaactaaataaatagcaaaagagcccatctcttgtcagtttgcgggacgaagttgtgacttgtgttattaagcagtgttttatggaatcagaagtctctgaatccatgctgttgaatctcttttcttgaattagcaagaattaactgaattagctgtattaacttgaatttattataatttaggtcaccaaatctatgtatcatgtcttcaatctcaggcccgcatgtctggatgcagatgtttgaatggcagcacctctagagataaggttagcacatgtgcctgagttggaaagacttcggtcttggtgctatgcatttatttccctatttctctagttccatgcaattttaaaatttgtttttaaacaatttataataattaaagatcctgcctgttctttttttctttttctgagacagagtctcgcgctgtcgccaggctggagtacggcagtgcgatctcggctaactgcaacctccatctcctgggttcaagcgattctcctgcctcagcctctcaagtagctgggattacaggcacccaccaccacgcccggctaatttttgtatttttagtagagatggggtttcaccatcttggccaggatggtctcaatctcctgacctcatgatccacccgccttggcctcccaaagtgctgcaattacaggcatgagccactgcaccagaccgatcctgcctattcttatagacaacacaactctggaacttaggatggagtgaagtttaaatacaactggaatggcagtttctagtgatttcctgaccccaaattgccacatctggtttggaattttgcgtcttggacttgtccattagaaagaaacaacccaaccaattataatagagacatgagttcaagattaacatcttaatcccatagggtgatgccaaagtaactgtcattttgtcgagccactagaaaaaaaaagtaaaagaacccctcaaatgacattttgacaaaagactgctacaaggaaatactttttttcccccaaacagaaatgcataggataaaaataccataatgtcctaaaaagcagtatttaggtaagattcaaatatcacatgaccaagaggcaaaataatctgtggagcccccctcccctctccaaaattactgtaatctcaatagtccttatcctagcattgctgagatataaaattcataaaatatccaatgatgacagtcctgatggagagagagcaacaaggtacctgtctgaagaactcctccaggagtgacattgtccagcgatgatggaggtcccatgcttttgctggatggctaatatctgctgtatgcagcataagggataaggcttttggcttttcaatgctgtaaaccaaaagcacccaaacacatgataaccacactcttcagaacctcagtaagagttttttaaaaatcattaagtttttaatctcttttgttcttccatctcaaaccccacttcagctaaattgaggaaaagacatcatttcatcctacaactgggatactcattaacttggtctccatatttacggaattggactctctggactcaaatccatttctggaatgactgcatccttcaaaaagagagcaagaatccaagagtcactgacttttattggttgcttctgcattggggatctctgataatttagtttcccacagggaattatttttaattctcactggggacaactgatgctgcctctattatttctttcaaccctgatgagaacataccttattgtggtaggtacaacttttatgctttctccttcaaacataatcattgcataagaacactctataaagttgtgttaaaggagatgctctttaaagggatagccacatagacgaggacccattcaaacacctatacaaacaaaaacacaagccacaagcacacttacgcttctggctgctgcagagcagtcttcattgctttgatttgttggaagtgacaagacatatctgtggccatcaccatttcaattaccaaggttcgaaactcccttttagagacaaccatggagaaaaaaggatggaagtcaaaaatggaaagtaaaaatcagtgttttttttttgccactgctaatgaaaatcagtcaacgatttctgacatttctaatctaatttgggtctttaaggtgagcttttcaaataaggaataaatgaaagctaagtattaagaaaatcatttattaggaatatgatacatggaatacacatatcatttggaaaattaactcacaggaaaaaattcaatgaaactgaaaattgtattaaaatgctcttttctccaaatgaattcagagttttaagaaagaattaacttgaaaataatccttggaggtaaattaatcatccgtatttcacattggatacaggtattccatctttttaaaaatagcttgatttttaatagagttttaggttgacagaaaaattgagcttatagtatagctagttctcatgttacctcacttccagcacagttttcttatttttaaagtcttgtgttaatgtggtgcatttgttacaactagtgaatcaatattgatacattatgttaactacagtccatagtttacattaaggttcactgggcatgctgtacagttctaccagttttgacaaatgcataatgccatgtatccaccatcacaatatccatacagaatagattcagcaccctaaaatcccctgtgctccttcgattcacccctctcttttttccctcaacccctgccaatcactgatctttttactgcctctaacgactttattgaggtataatttacatagaataaactgcttacaatttacataaattgcagaatgtaatgagtttaacagttgagtaagtttttgaaaataccactgtaatcatgataccaaatacttccatcatcctcaaacctagccccaggcaaagtttgatctggcttatgtctatctaaaatagtttgaattttctagttttatacatgtgtacataaagtatacacatatatatttagtatatatttcaaatatttaatatatattatagatttcaatatttatatattatatacacatatatttcatacatatatacatatttattatatacatacatgtagacatacatagatacacatatatgtattatatattaaatatgtgtgtatatatgtatatatagattatgtatatatgtatgtatacacacatacatatacgtatgtatacatacatacatacgtatatgtgtgtatacatacgtatatgtatgtatgtgtgtatatatacatacatatatacacacattattttaaaatagtcacacattgaaaatatacacacatattattttaaaatataatagataatacatattatacacacatacatacgcattatatattaacacagatactagatatatacacacgtgtttccatgtatatacatagacacacacacacacacatatataatacaaaatgtactctttctttactcagcataatgatttacaattcatctatatagtggttcatcaatagttcattttctcttattgctgagtggtattctatcatatgagcataccacagtttgttatccatttactagctaacggacattcaagttattagattctagtttggaactattgtgaataaagctactatgggtattcatacataaatctttgtgtagacacatatgttttcatttatctggggtgaatacctagaagcagaatggctggtttataagacagctgagtgtttataagaaactgccagccgggcatagtggctcatgcctgtaatcccaacactttgggaggctgaggcaggtggatcacctgaggtcaggagttcgagactagcctgaccaatatggtgaaaccccgtctctactaaaaatacaaaaattagctgggtgttgtggcatgcgcctgtagtcccagctacttaggaggctgagacaggagaattgcttgaacctaggaggtggaagttgcaatgaggtgatatcatgccactgcactctagcctgggtgacagagagagactgcatctcaattaaaaaagaaaaaagaaactgccaaatatttgtgaaagtggttgtatcactttacatttgaccactagcatataacattttcagtttttctttgcctcctctaatgagtctttaatttcagccattcttctgatggatatgtagtgttatctcatcttggttttaatttacatttctttgttgactatgtcaggcacattttcatgtacttatattccatttgtatacattttttagggaaatgtctgtttcaaacctttctcattttaaaattgaattgtttacttattattgagttataaaagtaccttacacattttggattcaaaacctatgtaaaacataagtgttgtgaataatttctccaatgtcttggcctgcttttttttaacggtgtcttccaaagagcaaaaggtttaatttttataaagttcaatttatcattaaaaaaatgcttcatgctttttctctcctatctgagaaaccgccacctacttccaaggacttcagtattttcctctggaagtcttgccattttagcttttacgtttaggtttataaccaattttgagctattttttgagtatggtatgtgataagggtcaaagttatcttttcccattgttccaaaaccatttgttgaaaatattttcttttccccattgaattaatttggcatcataaatcaattgatgagtcaatttcaaaactctcaattctgtcccatagttacgtatgtccatctttcaccagtgaaatgctgccttgaatactgtaacttaagcatgcttggaatcaagaaatatgagtcctctaaccttgttcttcatttaaaaagtattatttggcatttctatataaagtttataataatcatggcaatttccaacataattctgctggaattttgattggaattgtattgaaacaataaataaattttggaagatttgacatctttataataccgagtgttccactacatgatgacagtatatctctctatgtatttagttcctctataatcagcaatactacataatctttagtgaacatgagctgcatttgtttttgaaagctactactaagtattttatatgttatgtgctattgtaaaaaattattttattttccaatggtttgctgctagtgtctctctccctctctctgtctctctctctctctctctatatatatatatatatgtatatgtgcatatatgcatatgtgtatatataatgttttttacattaaccttgtattctgtgaccttgcaaaattcattatcggttccagtagctcctttacagatccttaggattttctacttaggcaatcatgtcatttgctattaacatcttaacaatgttgatgaatgtaagatcaagcatctttgtcttactcccagtcttaaggaaaaaacattcaatatttcaccattaagcttgatgttagttataggtttttcacacatgcactttatccagttgaggaagctcccttctgtttctggcttgctgagagtttttatgatgaatgtgttgaattttgtcaaatgcttgttatatatctattaagatgactgtatgattttctgtttgtttttaaatatggggaattcttttaattaatttttgaatgctgaattaatcttgcattccttggataagcccaatatatgagtcaggattctccagagaaaccaataggatagaaagagatttattatgaggaagtggctcacataattatgaaggctgacaagtcccaagatctgcagggtaaatcagcaagtggagatccaggacacccaatattgtacttccaacttgaaggctgacagctcaagacccaggaggagccattgttttagttcaaagacaggcaaaaagaattctctcttacttgggaggtggtcagcctttttgttctagttaggccttcaactggttgaatgaggtcaactcatgttaggaagggcaatctgctttactcagtctaccctcttatatgttaatctcatccaaaaacaccctcacagaaacaacagaataatgcttgaccaaatatcagcacacactgaggcccaggcgagttgatacataaaattaactatcacacatgatatattacctttttagtatattgttacatttaattagttaatattttactgagaattgttatagctatgttcataaaatacattagtctttaacattcctttttatgaatttttttccagagtgtggtatcaaaattatgtcttataaaacaaattgcacagtatttcttccttctctaaatacatttgcataagattggtattatctgttctttacatattgatagaattcaccagttaaactatccaaggctggatatttctttgtgggaatatttttgatgacaaagtcaattttttaacagacataggattgttcagactttctgtttcatcttgtgtgaattttggtaagttgtattttgcaaggaatttatccacttcatcaaagttgtcaaatttattgagataaagttgtttgtaacattttcttatgtatttcatatgtataggatatactgttggtactttgtgttctctcctttttattgaccagtctaggtagaaggttgtcaatcatgttgctcttttcaaataacagcttgagctttcttaattttttctttttattttttctattttattgatttttcctcttatcattactaatttcttctatctactttgaatttacattactgttttggtctagcttcctgaagtcattgtgtttggaacttttttctttcctactatgaacatttatagctgtaaatttcctctaggcactgttttaatagtattgcacacatttttaatatattgcattttcattcttgataaatttgaaatgtttcctactttcctctgattactttttgatccacaaatgatttagaagaatgttgtttaattttcaaatatacaggattttcctagatatcttattgatctctaatttaaatccattaaggtcaaagaacatactctttaagcttatgatattttaaaattattaaaacttattttaaaatgtctcagcatgtgtacttgaaaagaatatgtatattgcagttgttgcatggtgttctataaatattaattaaggcaaagtggctgatgttgttcaaatcctcttaggtccttagtgatatttttgtccagtttgtctatcaactgctgacgcaagaatcttaaaacctcctatgattgtgaaaatatatatttctcctttttctcctatcaatttttacattttatgttttggaagtctacagttacctaatagttatttatgactgatgtatctttctgatgacactcttattatcagaaaatctcctttctctttcacaatatcctttttcttgcagttcattttagctaatattaataacaccactgcattctacttattcttactgtttggtacatcttacatacttttactttgaacctttttgtgtatttatatttaaagtgtatctcttgtacaattgcagttggagcttgcctttttatcaattctaataaccttttccttttaagtagaatgtttagtcctttaacatttaatgtaattattaatatagttgcatttgggtctagcatgttattatttgttttctaattatcacctttgcttttttccctttgcattaacttttctgcttgagatattttttgtattatttattttttaaatcaattttaatttatctactgctaaatggtcaatttaaatttatcttttgataaataggtaaactttaacaatctttagctattatggttaatctttttagtggttgcttggggattacaacatacatctttaattttctgtctactgtataactttatgtaacatttaaaaatcctgcaacagtataggtccatttactaacattaactggtctttatgttatcattgtcacatgtattacacctctctacatacaaacctcatgagatggtgttgtaatttttgcttcaaatggtcaaatgcacaatttaaataagtgaagaaaaatggtattttacatttacccagatatttatcagtttattcttttctaaaagtctgatttcactatcatatcattttccttccaataaatatttagatttattaatctaaaaattaataaaatataaaataacaaaataatatttttgaaactaccttaaagaaagctctaaagaaatttctttagcatcccttgtaacgcagctccattagtgacacattcctgttgttttctattatctgaaaataattttatttcatcttcattcttgaagttcatgttcacaggatgtagcatcctgtgttggctttttgttttctttttagcactttaaataaattattctattgttttctggcctctatagtttctgatgaatagtctactgtgattcaacttgttctcctaagtgtaatttgtcatttttctttattttatctttgcctctcagcagtttgactataatatgtgcctcagtgttcttttcatcgaatttaacctgttttaggtttgctgagtttcttgaatctgtatatttatatgtttggcaatatttggaaactgttcagtcattatttcttcaaattctttttctttcccattctctctcttttctctccttctgagactcaaattgcccttatgttggctcatataaaattatcccacatgtccctaacttctactcatttaaaacagctttttcctcttactttttcaaatcaaataatttccaactttgaaacctgaaaaatgaatttttaaaagtcactgtttccttcttctgtcttctctatcatgcactaagcctatgtagcaaattctaaatgtagacattttatttttcagttctaaactttgtttttaatttatgttttcattttactcataaaccttataacaaaataatatttttgaaactaccttaaagaaagttctaaagaaatttctttagcatcccttataacacagctccattagtgacacactcctgttgttttctattacctgaaaataattttatacacaagcacatttttcattacctcactgagcatagaaataatagttgttttaaaagtccaaagtcctcatctgataattctaacaatggcttatcctagagtgtgtatctattgattgtcttttcccttactaagaaatcacattttcctgatctttatatgtcacttagattgtatcctgaacattatggatataagttgtagggaatctgggttctgttatattgctctgaagattgttgatgttttgttttagcaggcaattaacttgtttatactcaaaatacaaactctgtataggttcagtaagcaatacatcagatatcactggacacaaggagggaaacatcacacactggggcttgtcagggggtcaggggctagggaaggcatagcattaggagaaatacctaatgtagacgatgggttgatgggtgcagcaaaccaccatggcacatgtataaacctgcactttctgcacacgtatcccagaacttaaaatataataaaaaaaatttttaaaaaggtttgaaaaaaataataaaaggtggccaggcacagtggctcatgcctgtaatcccagcactttgggaggccaaggctagtgggtcatttgaggtaaggagttcgagaccagcctgaccaaaatggtgaaacactgtctctattaaaaatacaaaaaaattagctgggcctggtagtgcatgcctgtagtcccagctacttgtgagactgaggcaggagaatcgcttgaatttgggaagcgaaggttgcagtgagccaagatcatgccactgcactccagtctaggtgacagagtgagactctgtctcaaaataataataataataaaaggtttgaatatggcagagaacagcttcacacatattcagatacatcatggttttgaaggatttgtgtgagggcttatttagatatttagatcgtgtataatcctggcttcctgacaatctagtaaagtgttctaaagcttgcataattgcctcttaacatattttccaaacatacgtatgctacttctgttatacatacttttacttttctttttttttcttttttttttttttttgagacggagtctcgctctgtcacccaggctctgttctgtccaatggaatagaacagaggcctcagaaataatagcacacatatacaaccatctgatctttgaaaagcctgacaaaaacaagctatggggaaaggattccctatataataaatggtgttgggaaaactggctagccatatgcaaaaaactgaaactggaccccttccttataccttatacaaaaattaactcaagatggattaaagacttaaagtaagacctaaaaccataaaaaccctagaagaaaacctaggcaatagcattcaggatataggtatgggcaaagacttcttgactaaaacaccaaaagcaatggcaacaacagccagaattgacaaatgggatgtaattaaactaaagagctcctgcacagcaaaagaaactatcatcagagtgaatgggcaacctacataatgggggaaaatttttgtaatcaaaccttttattataacttttaccaatagtaaaattggatagagggttccttttttcctgaagtggtgcaatgattaattgaattgctctgcatttttcagatgctggctgagtctagcatattccaataaaatttaagtcaaatattcccatatgttttaataaactaaagctacatggaaactcttagccactcttaataaaaatcagcctctcagattgttcagtaaagttcatttctctaaatccttgaaagatggtgagcacacaaatacccaataaacagctgattatttaattaaaatatgaggactatttgagtcacaacggattcagagttttgtaaggatttagatgatctctgcctgcagggtttgaagtaccttaacctatatttatagctacgatgatttattggcttgctatatatgagacaaagtgtgctaagcattttaaaatgattatgtcatttatcataatctatcccaactgcagaataaatgttactatctattttcaagaaattaaaattttaaagatgtaaagatattgagtcacttcccgaatgtcatacagctagtaagtgactgagtccatattcaaaacacaggtatgtgcctaaatccaaacacacaatttctgtcattcatgcaacagaattaagtgtacataatttttttaagtgtccaataatttccttagaaaatgtcaaaagattgataagaagtccaaatcaaatatagggtgaaaaacacatgttattaaataaaagataaaattcagatttaaggaattcagataaaagcaacacaagtttcctaaggttaaaaaaaaaagcaaatatatccaaagtgtcctcagttgaacactgttagaagtgatttttcaaactttcttctttgagaatttttaggacaatattgaattatttgactcaaactggtttcacttcccaattcatcaataaaaagcaatgtaaagatggcaaaataaagtagttggaacttaatcataacattccatagcctttatttataaatatttgaatatctgtataaagaaaaaagagaaataagacatacatacatacacaaagagagggtgagagtgagagaaagaaagagagagaaagcaacacgaatcaacattttaagcaaggtgttcttttctcaaaaacagcatacttcatccaacttcaaagttccttccctggcctacaaatctctctcttttctcatccttacctccagtcatcctttgagaggttaatcaaaatattcatttcctcgtcatcttgcagaaggcgataagctgcacttaaatggtgattctccagtacagatctgtcattatacagaatagctggatcagacctgaacagaaagccaagcaaaattcagaatgttaaacagttgtgatttacttgggtaattctaacaggctagaacgcaccaccacttttttccatgtttagaaattatctttgtccccatgccagttatatgaaccaaaagctcaactaacactacaaatcatcaatagatgaatgtagggtatgttatatcagtacatgtgtgggcaggaaatatgtgacatccagcctgagaactctctcaaaactgttttacaaccagatctcaattacctatattagttgcaaaggtgtttttttaaaaatatgggtcatgtcaaacttctttatattttctggaatgacatttatttttatttttattttattcaatgaatgcactggtttatttattttagttgtaattttcagaacacatatcacctggtgggtactatctgtaagctgcctctgatagtggcttgatctcaacatttttccatgcaaaagccacatgtggaaaattgagaataaagaatataaagattataatgtcagtttttagttcctatctcaaagaccatactatagctgaatgtcactaaacacacgactgtataatattttaagatcttaaatttaatgaaagcttagattatttgtttctcaccaaggaagctgagtttcagagacttaaaaaaacttgttagagccctttggtggccaagtggcagggctgggatgaaggcaagatcttctgacagttgggccagtgcttccccaagataacttccacctgccattggccaaactttgggctgtatctatcataccttgaaactgttaggcttaaaattttattcatcaaaggattaagggcctggtcacagactttgttttctgaacagggatcacacaggctgagaggctttggataaagttctgttgaacagggccaatgtttaaatttcattccaaaccaagcttaactgaacacattggaattttcccactcctatggagataacgcagaacattcaaatcccgaggtgaaagatctgctgttacatctgttgagtaagttagataccaactgatgtatatttcgtgacacttttccacctcctgtaataaagccattctcctctgtgttgggactggttttgatcctcgtctccaggcaagacccacatatgttcaacccacctctcttccttgggcaggtgatattcaccatggtctctgtcctcagagcaaaggttccacccacagacatacattaaacagtgctactctatggaattccctgtattaaagggaattctgttcccttggaacacaaccacaaaaagctgcttttctgtggctgagactaagtgaggaggcaagaaggtggaactgaagcaagtagctgaagttcttttgtctgcttccattcaattaaaattctccttctgaacagagatcagacaatattgtcttcttttgtgtatactgtaatcaagtgttgagttcattaaatacatgtagattgatttaatgaacacaaacctatctagagtgtgcacctgctttttcaagtgaaatcagcaagtatttatttggtgttaaactctcatccctccctgctacattctttctctttgacttaccacctttccccataccctagctccttttgattactatgtcaaggataatgaactaactctactgtcagactctctccagttccacatcattgtcttaagagagggcaagttcttaggctaggagagggcaaggaaagttttatcctaagtagaaatgacaattgactggtgctattgcctggaattctgtgctgagaggaatactcagaataaacccacagtttagtaagaaaaagtaccaaaatcaactaacagtatctgttacaggtcaggaggttccgagtggggcacttggacccatatttaatgtctccgacgggaggtttgtgattacctgtgcagtccattaggaaggatgcacaggttgctcacggtgaaagtagcctacaggagacaaacttactcccggggccctgtgccagggagtggtgcaagcactaaacagagcagatacgaaatcagagaggatgagaagagatctcatcagaatctcagagatcagagggtaagattggtcaatgttgttaatgtcaacaaaaacactctaatcctcactgtccttattcttttcctttatgtgtcatctgggcctttacgtaaactgccccatttcctgttagaagtaggtcaagtatgtacagaacatacataaacaaatagcgaacattagaatagagaagaaaaagatatctatatgagatctgaacaaaataggagaattaggagcagatggcttcttaaactctaagtcttgattgaagctgatcagactgatctctcatttagaggttcattgtttcagaaattcaaaataggaaacctatgcaaaagaaaggtgactaacacctttctgatttctaaaactgtctctctgacccctcttgcctctcttccaaacatttaaacaccctcaccgagtctgaatgtggaaattgttggtggttccggtatgctcgtagtcatggatggcagctgagaagattatagcaaagatctccagctccgtcagccagttctgaaaggagattacagagcaatcagataatctgtttctttctcaaagtcttcagcttgctgacaacacacccacagtgctgcctttctaccctgcagctggtaagctattgccaaacacaagttttctgagagacagaaataagttattttcctgtgaagagacttggagacttgtgatttgttaacaatgtgttcagcaaggttgaataagctaagtagtagttttatctttttcaagaaatcaaagagaatgaacatgaagacttgaaaagccctcattgcatcctcccccaacttccaaataaagttcctaggtagacacacacacacacacacacacacacacacacacacacataaaaaaattagaaatttgaatgcaataccaagaatgaagagtaatagaaaacctaacgtctgattataggaggatatccactaggaagtgggtagagacagatggaaaaatactggctttctgctctatgcatgctgatgatgtttgaaaggacttctccccatccacaccatcaacattggctgtgggtcagtggttcacaaaatgtgttccttggacatgcagatggtgtcagctgggagcttgttagaaatgctggcaaattcttcagccccaccccaatctcactggatcagaaacgctaggttgtggcccagcaatctgtgctttaccaagccatctagatagttctgatgcacactagagtttgaaaactactgctgtgtttcaagcttccttaactgacttccatttaacggactctgtggatttacttcctatcgcttctgtaaaccatcctgccccatgctcacacgacagaatatgcctgactcaggccaccttctcatatcctttgctcacttttgctactagttaaattcatgcctacatgattcagtatgatttattctaaaccacattttaataaattgtatttgttattataattatgtaattaaatatgacacaaaccaataaaatatggacacaaaattggagttgttatttctgtagaacctaagtttaatgctttggacagtcactaaaagaactgctatcaaaatatgtgtgacaactgtgaaagagcagaacacatttatagaaaagttagagagcttctgcactcagtttgcttcatgcacatctttaagttcccacttaactttaaagagatgagactagaaatcttagataggggcagggttgatgtaagacaaatgtgagtatccaaactggtgaactcataaaagccctgtggtctgaattaaagatcagtgcataaaatagattcatatgatttaagttaacgcaaaatgagttaaaatgaacatttaagtgtttctaatttcccacttaagccatatctttcaattaactactaattttggagaattattgccttctttaaaaattggtaaggggaaaataaacaaatgacatagaacttatgaaaaatacttcagagtgagcataaacataactcatgaaaaaataaaccactatacttttgaaaatgattcctaacagaatccagcatgaaatgtcaggaagctttctggcatcttcaataatatacctcaaaaacacaaattgaggtacacggaacagaaagtcaaagagaaaacagactaagatgaaaatcaacaaaatgagatgaaaaaaagatgggcaagataaggaaagattgcaagaaaaatcaaagctgcaaaaccccttgtaaaggcagcaaagagcctcctcatcagcctcttcattgtctcggggggccccccatgtggcaggcactatgctaggtgcttttatatagaaacttatataactctcacagctctgtaatcataggtactgttgctatccccacttgacagataaggaaacaagccaggggtaggtgcaggactcactcaaggtcacacagccagtcatctgacaagccacacaccacgcctgcagaattctcactcataatcttacattgtattttctttggatcattgttcatgtgtttattcaattttgcataaaattatataggcataaatttatattgcacatttttcttgatattatccatacatatattacatatgcagttttttttccattttggcattgtctttcttttcttccccaatattttgtccccacccatctgtccctggttccctctacctcctctcccacatatatctcttattctaaggtcacgtaaagttaatttcactttttaaaataagattatgaatgggagacagtgtaacatctcaacgaatcctagtcacagaacatcagcccaggcagcagaaagcatctaaataacagtataattacagttctcacattacaaccatagtgatgcttccctccttacccaaataattgaacaaaatcctatcttagatataacctacttctattaaaccaaaaacaatgaatggttaaacaggcattcaacaacaacaacaataaaaaacaaaaccattgtctttaaaactcattttaccaccttagtttttcaacaaacgccatgcatgcttagaatcagttatgctgctttggggataagaagaaagaaaagtagtatctgggagaaacagcttcacagaggagagatgtttaagatgggccttgaaaatttgacagagaaagaaatgaaggtgggcattttcagaagaatgaactaaatgagcaagtcccagcagcaaaagcatgtccacctcaggtaagaaaatgatgcccttgactggagcgggagagaaggctgattgaggccctatgaggtcaggcattagaaaacacagtgagcgaggaatgtaaaccagattcagcaggcagtgaagttcacacgcaagagagtcatgccatcagctccccacttcaggaaggatatttggacaggaggagagaagggagataaaaagcagggtttttttgttttcgttttgtttttgtttttgtttttttttaaacagggtctcactctgttgtccgggctggagtatagtggtgcaatcttggctcactgcaacctctgcccccagggctcaagcaaacctcccacctcagcctcccaagtaagggctgggaccataggcacccactgccatgcccagctatttttttttttttttttttgtatttttagtagagatgggagtctcaccatgtcgcccaggctggtctctaacttctgagctcaagcaatccaccaatctgggcctcccaaaattctgggattataggcgtgagcaactgtgcctggctaaaagctgtatttttagattgaaaagttcatataggatgtacagacagtgtggaggtagaagccatatgacttagcaattatctgaattttggaagtggtaggaggaccagatgaggttgcagttaaggagaacaatatgttagatgacctcaacactcctagcctcactgagtggctaataaacccctcaggtgatattagatagcatcattaacagaaacagagaaagtgggagaagctattttggaggaaattgaacttcctattttaatatacctcagatttccttgcctcttccaaattaactactgtgaacccagaaggttttatgtcaacccataagaagtcagaaattaaagtcccactggtattttattccagaattaccaattggtggcaaggtacaagtcacagatgctatcagtattttcctatctacaaaatatgagtgtcacaactagttcatttgaaaggatgctttgacaagtggtaattggggaccttgagttttgctgtgtatgactcaagaaagcaagccacttgttcccgcatataggggcagatgaggagacatggggtacaacagagcagaggaaacctgaagggaaaggacatggccaatttctcattgttagaggagatactacaagcaagttgtgacttttctatgtgaatgatagagtttctttagtaatctgttagttttccatgctaccttaacaaatgctcagtcttggaggcttaaagaacacttccgggcctggcgaggtgcctcatgcttataatcccagcactttgggaggccaaggtgggtggatcacctgaggtcaggagttcaagaccagactggcaaacattgtgaaaccccatctctactgaaaatacaaaaatcagccgggtgtgctggcgggtgcctgtaatctcagctactcaggaggctgaggcaggagaatcacttgaacccaggaggcggaggttgcagtgagctgagatcacaccactgcactccagcctgggtgacagagcgagactccctctgtctaaaaaaaaaaaaaaaaaaaaaacttccgtttattggcacgcagttctgccagtcagaagcccaggccagtgtggatgggttctctggtcagggtatcccaaggctgacatcaaggttgggaaaggtttcctttctggtggctctgggggaaaatctgctcccaagagtattcagggcattggcagaattcatttccttctaaccttttccacagtttccctcttcaccttcaagctggcaatgactgttgggtccttctcacacttcaaacctctgactttggccatatctccttgactttgatgaacttgtgtgattacattgggcccacctggaaaatccaggctaatctccctatttaaattcttctgattgttagccttaattgcatctgcaaaatctcttttataatccaatgtaacatattaataaacacatgtgacaccagagaacaaaggttgcaggagccaaatgtctaccaataacaaccccaataaaattatttggcactcttcaaacaaaatgtaattttgatatccttagtctttcctgttaatacattgatattatgtattaatatgttaataatatgacattatggtaatgtcataaacgaccaaaaaaataaaaaataaaataaataaaaaataaaaataaaaaaataaaaaataaataataaataaaaaataaataaaaataagatatgcagcttctcctttctggaaaaaaaaaaaaaaaaagacaaagggaaaattactggcaccttgcttgacaaaagcaaggaaaatggccaagggatagctttggagtttgaaatcttttcacctaaatcaaaagtacactagagcttagaatctaatgaacatctattcaatcaatagatagctcttcaatttatttctgtctaaggattttctcttggaaatgagcaaaataattctgaaaggatccaagtatcttctaggcacttaagttaaacaataatgagtaatacaaacagattacaatgttttacatttacaaagtatcactgttgatgttgaagcccagacaccactttatcaatgggttgttttgattctctacgtgtcttacaatttataacactgaaatgatttaaagcgttttctccctcttggtttgtaatgaaaggttagagtaacagtatgttctccattcatcagaatgctccccactgtttttgtaagctcacaatgaaagaagtttgttttgagctgcatttcaaagagagagtaggtaggaaatagtttctatatttaagaatcattctaaatatggtctgaatcgatcacggaaattcaacggcaaatgagaaatgagctcatttaagaaagcatgcagtaaatcatgatcactgctatgatacaacatttatgttaatgataacttgtattggcataaatgctgggtgtttttggtgagagttgaagaagctgtgcatgattcacttttatgtccccagagtacactctgcacaataggtgtgttgaatagatgagttcaaagtgcatttttgcatccattttcatcctcatcacaatacgtggaagtaagtgcacatgaggatactgaggtgtaagaatataagaggctttttttttttttttttgccaaaggcatattgtagaagcatgcctaatatttaaatgcatggcctctgaagtcagagctgggaccgaattctggctcccgtactgtactcagttgctcgggctgccataacaaaataacacgggctgcgtggcttaaacaacggaaatttattttctcacgtttctggaggagaaaagtccaaaatcaaggtgtcagcaggactgttttctcctgagacctctctccttgccttgcagacagctatattctctctgtatcctcacaatggacccttctacctgcaagtgcatgtctgtgttctaatctcctctttctctaagaacaccagtcataatggattagagcccatccatacaactttattttaccttaatacctcttcaaaggccatctctccaaatacagtcccattctgaggtcctggggactaggatgtcaatatatgaatcaatgagaaatacaatttagcccatatagctactttgtaatagaataattttaatttctatgaattagagatttatcttccttaaaataagaataatattacttgtaatgggaatcacttttgattgcccaactgccctttttttccttactaacaatgtctctgattttgtttgagatggcagtgtgtcagacttccctatatatcgcagtggccatgagacacagttctggccaataaaacagaagtgaaagttgctggttcggatttctggatagctctttaaaagtgggcagatttatttggtttccaacttttgtgctttgtattctgccttatcttcttacctggatttgcaaaggtacatcagccattttacaagcataaggacaagagctacagtcaaagaggtgggaaggacactgagaagactgttgctgatgaagagctgccatgccctccctagaagtctctctggacagaccacacaaacacagaggacacccacacccctgacccatctaacccacctggacattcacttacaaatatgttccaacaaccaaacttcactagacattttgagggaaaaaagccaatagtgtaagaagattctcataaacaaatagcatattccccatcagttaaaagagataattctgtttttaaaaagacttttaaaggaagttttcaaaacgtgtaggtacattcataaatatgtaagtttgctaagacaatagcacattcaaagggcaaaaaaagaggagttcctgaaattaaaaatattgctaactaaaaatgttaaataaacaggttgaataactagaaggacatatcggaaggccaaactgataatgtggaagaaagagttgaggacatctctcaggaggtatcattaaaataccgaaagactggaaaacatgggagaagctaagaggtatgaagatgcattcagaaggtctaagagaagtgccagaagcagacagaagagaaaacagacagggagaaataaataaataacagagagtgtttggctttcttctttccaagcatatagtaggattagactttctggcccctttatggttgggagggactgtgtgagtcattttggccagtgagttgtgagcagaagtgatgagcagagtttctgagccatagaatttaaatacagatataggaaaaccagagcccctttctctctaccataatgcctgacaacactcaggagggtggctgtttagaaaacctaggcccttggagtgagaatgacacaggcagattctttaacttactgttacgggaagtgaaaaaaagcagatattatttctaaaccattgagatttggggattgtttgatcctgtagcaaaatacagcctaccctaaggaaaacactccaaatgaatgaaacccttaggagtgaagaagatgcattctcccactaatatgttaccttatgttatttttaagaaagtctatatataaggtcatacaattaaaaggcaatcacaagttttgaaatatttcacatatatgacaagtgttgctagtcatgattacttatgtttagtaataataataactatcatttactaatattctactgtatgctaggcattaggtaatcatttttattaagaatactgagaaattcaaacattttctcagcaaaatattaagttctcaggaatggagatgttataaccaaagaaaataaaagtggttaatacataaggaaaatgtttaatttactagtattaacaataaaaagtaaaaacacacacatatgaaactttagtgggaaaatattgctatgcaaggaggctaaccagaatatcatttacagtagtgaaaaaaaattttaactgtttaagtgatagaataacccaataatgaactattaagattttcttataataaatatataatgacatagggaaactatcataatatatgatgtattgactatatatatatactatatatatagactatatgtatattgactattgactatgtacatttatgatttattgactatatatagactatatatatatgtaaacagcctatatacatatagagagagtgagagagagtcaggatcacagtattagagacttatttatcctgtttgtttcaataaatcccagtattatagacttatttatcctatttgtttcaataaataggacattggccatatatatagccaatggtacaataatgtacaatgtacagtaatggcacaatatcctatataatatagaatatattatatatcctataactttaataatataaataatataaagttatatcataggatatatgatataatataatgttacaatagcctgtaatgttatatccaatatcctaaaatgttcacagctcactttacctaagtaatggtctcatagagaagtaattttacaaataacatttaaacaatgtttaactgtttaagtgataggatgacccaataagggtccataagatgatcccactactgggatgacccactagtgttaacaaacaaaaacttcaaacaatacagatataaagttccctttggccattacttcaggatgagaatctccccagaggtaaccactatcttcaatttactgtttatctttttagatgtttttcaatatactttcatatatatctatgtgtatatacatgtgctatgtttaataatatacatcatgtagaacatatttttctacaactttttaaactgaataatacatcttgaattttagtcatagaaatctatggtattccagagttctaactccctattgataggtatatactccgtaattgttcactatggcaaacattgctacaatgaacctgattgtataggcctccctgagtacacttggaagtgctggaggattggtatgtatatttttccttatagtaatcactgcaaaattgttttcttatatgactataccaatttaccctcagatgagcagtatatgagaacataatttcttctcaatcagtggttctcaacctgggacaattgcccctccaaccagtggtttatttggcaaggtctggagacattattggttgtcataactggagtggggagtagtgctactggcatctcgtgactacaggtcaggcatactgctacactacaatgcatagaaaagcaacaaagaattatctggccccaaacgtcaatagtgctgaggttgagaaaccctgctctacatcctaaccaacagttaatattatcacactttcaacatttttacccatatgtatataatggattaaaactgtataagtttatatatccttagatactaatgaatggtgcatcttttcatatttcttttattgattaaatgtattaccttttctgttaattgcctgctcatactgtttgactgaatttgtgtcattttcctgattcatttatacaatctggatcttaatctatgttctctatgtattttctccaaatgcttacttcattaatttgtttatgatgctttttatcctacaaaagcttttaactttaatgtattcaaattaatcaatattttgttgtataacttttgtgtttaaaagcttaattttaaaaagaatgtcttttttcaaggccataaacatattctcattttttcttctaatatgatcaaatttttacttttgtacttacatctttaattcatttgtcagattttttgggggtgaatgactcgaagtagagtgaaagcattctcttttttctaaataaataactgtagccaaaacattttttaaactgggtgattttccctattaagttgtctatagtcatgtcttcatgttctcacctgcaattttttttcttcattatactctagtcagtgttccattctcaccaaaccactgagatgactcatgtcaaggtcaacaatgacttccatgttgccagagtgaatggtcatttctctgtccttatcttacttgaccatcggcatgtcccatgcaatgcaccactctcttcttgaagcattctctttccatggcttccatggccccaaactcccttggtttataccccatgtcactggccactcttttttagtttctattgttggctctaattctttgccttcattttgatctttggagtgttccaggactcacttcagagccccttctaactatctattcactctgtctttagataatctcatctagttccatgtcttcttatactattgatatgtccaagactacctaatctacatgtttatccctgatctcccctggaactctagcaccctttttctttctgcttggcctctgtaaatggatgtctactacggatcttaaactctacatgtctaaatcagaattcttgatcccctttcctccaaaacttggtttgccaccaggcattcttgtcaactgtttatcaaaccaagaatctaagatgtattctcgattcccctctttaatgttccaaatcctattcaccacagcagtcctttgaactctgtctcagaaacagcactttcttctctccatcccagcagcatccttcctagtccaaactatcagcatctcttcactagacttctgcagaattttcctagcaggctgccttaaaatccattcaccacagtaatcctttttgaatctttatcaggtcacatcacttccctgtctaaaaccctgtagtggcttcctactgactgcacttaggataaaattggaactcattagcgtggcctgtaaagccagacctgatctagctcctgcttcttcctcagcctcataatgcaccactgtccccatcatgtgctgttcccactaggcttgccttacttctgctccttgaatgtagcaaagttattctcttacaggactcttgtactaaaaccctgcactaactctgtggtcacactcttctttcactcttagcatggctgaagccaaaaaacacaattatctcagcttaaatactatctccagagagagtcctttcctgactatgtaataaaacacccagctttccctgggtaggtcctctattttaattctctacagagtattaataacattttcttgattgcttcccattggtctcttctatctgtaacttcacaccagaatgttaagttctacaagagtactgataccctcttaacttgtccattatcttagtccatttgggtagctgtaactgaatgctataggctgggtgacttataaacaacagaaatttatttctcacagttctggaggctaggaagcttaagatactgaatgccataggccgggtgacttataaacaacagaaatttatttctcacagttctggaggctaggaagcttaagatcaaggcgctggtagatttggcatctggtgagggcctgcttctggatttatagatgactgtgtcctcacatggcagaagagggaagggaactcatttttataaaggcactaatcccattcacgacagctccatgctcatgacctggtcacctcccctaggccccactacctaataccatcacattggaagttaggatttcagcagaggaatttgggagaacacaaacattcagtctatagtatcccataataaaggacccagcatataagttctcaatacacatttgggtttattttttgaaactctaatcaattctattgatatatttgcctattttttcacaagcagcacatgctcagcttcagtatgtattgtaatatctaagagagtaagaactattccctattagattgttcttttacaaaattgtcttttctaaggttgtgaaatacctattttacatgaatttcagattcagattatcatgtttcatattaaaatccttgaaactttgaatagtattgctttgaatttatagattactttgagggaaactgacatctatatagtactgaggtttcactcacattaaaaacatgatgccttttccatttatttaaagatcatttttgtgccctttgatttaattttagtttcctttttattgtttttgaggctctttataggtgatttatatactttttaaaaactgctgggaatgtacatttttctattacactcgttaatttccagtgcataggagagctcttttgtctagacctatcgaggtattttatttgatctaaaagggctttattttctaaaggagatgatcacattatttcacagaatatatcttcaacttttgaagatatcatattgcatactgcattcttgaggctgagacttccagaaaaatgccaagtaggaatattaatgtgggtatccctgtcttgctccatgtattcacggaaccatcattcaatatgatgcttgctctaaatgtttggtaaaaatcttttattgagttaaaaatgttccctttataatcttgttataactttaaagatagtgttttaaatactatttttaagaaatcagctttataataaggaagaactgaaaaaatgatcataggttttacaaaaattctgcaacgttttaacaataatgcctaattgttgagcttcctttatgaggcagagtacttaatatttttgatactttattctaaccatcagagcacttctacaaagtggaatatttttcaccattttaaaaaaatgaggaagttttcgctcagagactcaagtaatttatcataggtcacaatatctagtaagcaattaggcagggatttatagccactgtatctagctccaaagcccacaatcctcccacatattccatttttaattcagtgagatattaggccaagtctttcaacagtcactggaggaaaagataacaaatgtgccctggatttatgggataattgataactatacccaaagtatgtctatcttaatgccaattctaaaggagatttcgaagtaaaaattcatacagacctgtttttgcctttaatggctatatctttttaaatgaatggcttacatcaaggaaaaaaagaaaaaagcaaagacaaccaagttgagcaggtcagtaaacacagaacacagattcaaaaacaactgaagatggtgcacgcccatagtcccagctactcagcagcctgtgatagcaggaccacttgagcccaggagttcgaggctgcagtgagctatgatctcaccattgcactccagcctgggtgatagactgagatttccatgtcttaaaaaaaaatttttaaagcaaaaccaaaaacatctaaagcgctaaaatgttgggccaaaagaagcaaggaacatttcaaatggttagaagtaaagatttaccattaggttaaaataatgaaaggcatacaaataggatgtgaataactatagtccctgtgaaaaagacttagtggcttaaaccaaaagctaactttgcgtaacacggttgccaagtacattgaatacaatttcagtatacatgaatatcattgttattgaccatagcaaaaggttaacagtaccactctccatatctagaaatacatatttagttgtagtctttatatttaaattggttataacccagtgaagacgcaaatcactactaggtatttatctcatcaggctcaggatggagaaaatttcagaggcaacggagaactccaagactttccatattggttagattactcctgggaaacaggaagtccataaaacaatgcatgactcgtggcctccacctcatcagaattggaacagtcaccattaaaaactcatccttacatcttttggggaacctaagagttcctatccctacttaccgccactcctgtcttatagaggaggtaatgcactgtctgtgtaacatcggcagcgtgcattaagttatggtaaggatttttgtgcttgctgtatcccacttccagggcctccacaaatgagacaagtgcagaaatggggatctgaaagagagcagtaaggttaattaactagtgacttcactgctttcaatggagacacagaagtctaaggcaccaggactgctttttctctgaaggcataacacatgaggaaattggaacttacacagttaataaaaattactgacaaaattatcagataatttgaaaatctaacaggaagtccttggttgagaaatagcctgccttgtaaatttttctttgttgctcattttagaatccctgagaaatgacatctgatcattttaagatacttagttttagtaacatgtaaagcagtaatttttaatacacacatagaaaactgagttgttggtgactatgttaattttctgtatttccttgtcctcctctactcttaaatacccttcccctctaaccctaagggaaaaaaagatgctacataggacaccaaacaatgttgtaaataacactgaggaattcaaaaataatactaataattagtaaccatttgtggaatcattcactatttgtaatgtagtatcagtagaatgaaatcttccaaattccaagtcactaacaataaattgccaagtaacaaacataagaacatagcctgtttctgttcccatatataacagactatcgcattttggttttgagttttgtttttgcttggttttgggttttgattttgttttgtttttcttatgtgtccaatgtatataaccactcctttcaaagggcattgttttcaggcagtttatatttgttttgcaataattttataacttaagatttttgtgcactttgttttcctacaaatgagatatgctgcatagtatgtattcatttatttctcaacgaataaaatacttcagtctttatttgcaactaccagtcactcagaatatttccaattagattaattgttttgtcgtctgaaatatgtataatatacatgccttccttttctatgtaacagcgaagaacattgcaaaatgcatatacaaaataagggcatccagaaaactttcattgtattagttttctggatccattccatggttcagggtaaattatacaatataaggctaggggaaaaggagaggatatgtcttcctgaggattaacaattacatttgtgaaaaaaaaataaggaaaatgctaagttaatactcctgagattccataatctgttctcccttggtcatattcttccattttaccatttgcagaattttaaaaattaaaatacaacctttaagaggtcagagatgaattcattaccatttttaaaaataaagatccaatgaacctgggctccttgggttgtttcacagagatctaagagtcgctgaaagggctgtgtgtgtgcacaggaactttgttccaaggaaagtctccagcatcctctccagcatccacaagattttcatacagatttccgatgcaaagaaaaattaaggacctaaggaccatggccatgaagtatttgtggtcatgtaaagacatatttcctcagtgggaggggcttcaagatggctaactataggcatctggcactcacctcctccacaaaaaagaaccaaaatagcaagtagataatcacatttcaaatagattatccaacactagaattcaacagagaagtaagaggaaacacctaaagcaaggaaggagagagaatcaaggcatggattggctggaatcctggagaggctatctctccagcgaaaagaaaggtaagtgagtgatggctagcagtccacattcccaccttggactcctgtatcctagccaccagaaagcccctaaaccctggcagaccctgagactaagacagggagctgtctggagatcacatgaagacattgctccatacagggagctcatgctgggtcccacacatcccctaaccccctacccagctacagcaaggcaccatattgagagcccagcccccaccagactgcatactacctgggggctcaatagtccttgtatccccataactctggagccccattgacattctctgcctgcagccacaactgtggctggctgttgcctccagggatgaagtatgaaccatcagcaaagactgcactgcccccaggaacaaacccaccatgcaagttcatgcaccctaaggacaaaaccccccacctgcagcagcttccatggagggctgctgcagccatgaccaaagcacaagtgaagtgcatgctccccagccacccgtatacagctgctgccactgaaagcaacaataccctccacagtagcagggctgcagatccaacaggcccagttccacaccttccagtgcctcaacacaccatctgggggcctgaggatagcccagtccagtccactactattgggaactgagtactcatctcaagcacctgaggtcaggcccactcaaactgatgctgcatcacagctggcacccacctatacatgccacctgtgagcctggagactggcccacctagcctgttgtagccacctctatgatgcttggaactgaggggttagtctcaccactgctacttccaatgctcatgccatgcctactgttcaggggactgagaagcccccaatccacttggcccactgctgccaccactggctcctgagcaagccacctggaagcccaagaatcaggcctcttggatctgctaacaccagtgcaagtgtagaactccctggggcccaaggcatgggacaggcatgcttggcccaccactgccactactggggcccaaggtcaggcccaactggcatcccatctccagtgaaacttcaccacagcctccactaacaattacactctaagctactgaagaaatcacgtacactgctgacacggtttacagccaaaggaatcatacaaagactgcactactacacacagccagaattaaagccaaagttctctactcaaccaacatcatagatacttcttcaggaaaaagtcttcccatgtgaaagcaaattttaaaaatggaaataagtgactgtttaacaagatgcaaagatattgacacaaggacacaataaacatttataaagcaaggaaatatgacacttccaaatgattgactaattacccagcaagagaccccaatcaaaatgaaatttacgaagtcttggataaataattcaaattattgattctaaagaagctcagtgatatacaagagaatacataaaaataatacaaagaaatcaagaaaacaattcaggatattaatgataaatttaccaaagagatagctatcatacaaattagcaaagagaaattatggaatggaagaattcatttaatgaaatacaaaatacatttgaaaccttcaacagtagactagaccaagcaagaagaaaaaagttcagaactagaagacaggtcttcacaaaaaatgcagtctggcaaaaataaagaaaaaagaataaacaaagcctatgtggcgaatggaccaccattaaacaaccaaatatttgcattttcagggtccccaaaagcaaagaggaaacaaaagagtcagaaaacctatttaacaaaatactagtggaaaaattcccaaacgtagcaatagacttagacacccagacacaggaagctcaaagattcccaaacagatacaattcaaaaagatctccacagcacattagagccaaactgtcaaaatcaaagacaaaaaattctaaaaacagcaagagaaaaacatgtagtcacttataaggaaaccttcatcagatgaacagaaaatatctcattagaaaccctacaggcaaaaagataatgggataatacagtcaaagtcctaaaagaaaaaaaaaaaagccaaccaaggatgctatattgagcaaaggtatgcttcattaatgaaggagaaataaagcctttcccacacaagcaaatgcagagggaattccttattacttgaccagacctacagtgaatgcttaagggagtcttacgcctggaaacagagaaacaacatctaccatcatgaaaatgcaaaaggaaaaaactcactggtaaagcaaatacacaaatgaggaagagaaaagacccaaatgttaccactacagaaaaccaccaaaccacaattataaataataagaatgtaagaaaggacatacaacacaatctgaaattaattaataaaatgactggaataagtcctcacatatcaatagcaaccttgaatgtacatcaattaaacttcccactcaaaaaatagactagctaaatggattaaaaataaatccatgacccaactatatgtcgcctataagaaactcttttcacctgtaaagacacatgtagactgaaaagaaaaagacataaaaaatattccatgcaaatggaaatcaaaagcaagcaggagtagctatacttatatcagataaaacagactttaagtcaaaaatggtaaaaagagacaaagaaagtcatggtataatgaaaaaggaatcaattcagccagaggatataacatttctaaacatacacacacccaaaagtgaagcacccagatgtataaagcaaatattactagacctaaagaagagagagactctaatacaataatagtttgagacttcagcactctatcatagcatcaaacagaacatctatacagaaaatcaacaaagttggatttaaacttcacattagaccaaatggacctaatagacacttacagaacattttatccaacagctacagaacacaaatttttctcaccaacacaaagaacattttccagcctagaccatatgttaggacacaaaataagtctcaaaaaattaaaaatcaaaataatatcaagtgtcttctcagatcacagtaaaataaaactagaaatcaataacaagaggaaatttggaaactgaacaaatacacggaaattaaacatgttcctgatttaccattggattaagaaagaaattaaggagaaaataaaaatatttttaaggcaaatgaaaatctaaacatatcaaatgctatggaatactgcaaaagcagtgctaaaagggaaattttagcaataaatgtgtacatccaaaaagtagaaaaattccaaataaacaatctaacactgtacctcaatgaaaaagaaagcaatatcaaaccaaactgaaattagtaaaaaaacaaaataatgaagatcagagcagaattaaatgaaatagagactaacaaaacaatgcaatggagcaatgaaatgagaaaagttgtttttttgaaaagacaaacaaaataaataaattgctagctagactaacaaagaaaaaaaagagaagatccaaataaacaacatcagaagtgaaaagggagatattacaactgataccacagaaacacaaaaggtcatcagagactattatgaacaactatgtactaacaaactggaaaacttagaggaaatggataagttcctggacacatacaacttaccaaaattgaatcatgaggaaattgaaaacctggacagaccaataatgagtaatgagtttgaatcagtaatacaaattctcctgaaaaagagaagtctaggaccagatggcttcactatcaaattcctccaaactttcaaagaaggactaacatcagttctcctcaaactattccaaaaaattgaggggcaatttctccttctccctaactaattttacattgccagcatttccctgataccaaaactggacaaggatgcaacaacaataaatcaaaattacaggccactatccttgatcacactacataaattcaaaatatgttacaaggctatagtaaccaaaacactatatattattttatggtattagtataaaatagtattttatggtattagtataaaatagtatttttagtatacttttatgctaatagtatatttttatactattagtataaaaaatagtattttctggtattagtataaaaacagacacacagtccaatggaatagaataagaaacccataaataaatccacgtatttgcagctaactgatttttgacaaaggcaccaaaaacttacagaaaggaccccttcttcaagaaataactctgggaaaattgaatatccatatatagaagaataaaactagacatccatctctcatcatatacaaaaatcaactcaaaatctattacggacttaaacataatactcaaaactataaaactacaagagaataaaacacttcaggaaattggtctaggcaaagattttatggctaacacctcaaaaacacaggcaataaaaacaaaaatagacaaatgggactatattaaactaaaaatcttctgcacaggaaacaatcaacagagtaaagagacaacctgttaaacaggagaaatatctgcaaaatattcatctgacaagggactaatacccaaaatgtacaggaaactcaaacaacttggtaaaaataacaaataatcccattaaaaagtgggcaaagatatagacatttctcaaatgaagacatataatggacaatgggtacatgaaaaaaatgctcattatcactaatcatcagggaaatgaaaatcaaaagcaaaatgagatatcatcttaccccagtaagaatggctgttatggttaaaaaaaaaaaaaagatgcactggtgaggatgtagagaaaagggaacacttctacaacgttggtgggaatgtaaattggtacagtcactatggaaaacagtgtgcggatttctcaaaaaaaaaattctaaaagtagaactaccatgcaatccagcaatctcactactgggtatttattaaaaaagaaagaaagaaagaaagaaatcagtgtatcaaagagatatctgcaccctcatttttattgcagtactattcacaatagctaagatatagaatcaagctaagtgtccaccagtggatgaatggataaggaaaacttggtatacaaccataatggaatactattcggccataaaaaagatgaaatcatgtcatttgcagcaacatggatagaattggaagttattacattaagtgaaataatccaagcatggaaagacaaacagcacatgttctcactcacatgtgagagctaaaatttgatcttatgcagtcagagagtagaatgatagatactggaggctgggatgtgtgtgggggtatagggggttggtgataaagagggattggttaatgggtacgaacatacagttagatagaaggattaaagtctaatgttcagtagcagaatagggtgactacagttaacaagaatgtattgtgcatttcaaaatagctagaagagaggacttgaaatgttcccaacacatagaaatgataaataatgcgggtaatggacaccccaaaaaccctgacttgatcattacatagtctatgcgtgtaacaaaatatcacatgtaccctataaatatatacaatatttgtaccaattaaaaaacagatacctctccaaatacacagtccctaggagaaaataaagaaccacatctccggagaaatcaatatgtggtacagaaaaagacttgtgttttccagaggctcatccctttgatgagggaagtcagaggagcttgataccatagatgttggcagatgactacatcaactccctgaggatctgaccccacctcgagagtctacagtattagaaggctgtagggagttgaacactggaaatgattcaagttctttatgtaaagttgaagaatcaatttgaagcatgaatggctggaaaataccaatgacctgtcacagatgataagtgatagtatttgtctgaatgagccaagtggtgggaaaaaaaaaagtttacagagacagcagatgttcactctgtctccactactgcccctctgacagcgttggtcaataggacacaaagtcatgtggaaatgagacctttgggcagagcctgaaagggagcttggttattacaggctttgggttgtacttccaggaagaccagaatctaaatgggtctctcctgtctctcccatgccgctgagacccaccagcaagggcgcaatcaaaatcaccctccacagaggaattcacagcagtggctatccgaaggatgcttcctcagtcgcctggagcagttttcattccgcatattaaaatagtctgaacccaaaagtcatatgaggataaacatatgcatgtagtttatttattttttctttttaaagaggtactgaccttgaaacggctgatcagatcataacgtgtgagtagttcatagaaaataaatttcagtgcatgatccccactggcctcattgagggaaaagacgtcaaaggaccacttgtccacatcctgcaggacagggtggggagaaagaacacattagcccacagacacttacacacctaccagtctcctcactttcaagtccgcctgcagccctcactggagatttcacagtgtgacactcaaacagactttccactctcaaactttttccaatctggctagtctacatagtatctactgttaaaaaaattaaatagtcttattactaatacaaatagccataatttattgagtacctactgtatgacaggcattatggttggtgataaatatgtaaattatcctgaaaacaactctaagtgatagatattagtcgcattttatggataagaaaactgataaattacctaatttccctaacacccaaggtgcgtaagtgctagagatacaggcagggccagaacacaaacataggttggatgcctaagatcagttgctttccattaagccctgcagctgctactgtttaattcactacagcctacgatgcttctcttctctgaacttctctgcaatcccttgacactatccaatgacttcctctaagtttacagttaagaatgttaactcatttagaagtgttcagaaacatgcatgatgtagaacacaaaacaatatgccacatcaatcgaaactgctgagctgaaaccaaaaagaaagcattcatttcatatgacagaaaaatgctaccatttctggagtcactagtctgggatcttgtcctcaaatctgttagtcactttactgaaaaaaagtaaaaggaaaaactaaactgaacacacaccttatataccatccctgaagttcaaagtctttgcctgtaaatagctactccaaaatatatgtaaatacagtctgttgagctttggcttatcataaccaacttcttgtggatgtagtaaacaaagatttatttaagcaatggttaaagcaacagtcatttggcttttcacagcaccaaaatctcacttcccgtggttaggtgaagcatattcacttgagcttgacagcaaggattcacatgagaccacactgcctacaggcaaggtgtcagatggtacactggcagagaccttggttctcatgagtgactctcaccccagccctcactgaattccaacataatccatccatcctaattttgttcctgaccaaacattccaactgtcaaattcatcccaaggccatcaagggtctccctcctggatgctaataaactgttttcagggaaaatagaattgcatataggaaaatcagacttttccagaggggtttaaattgaattgttccaattcacacttagtggtaacctcacttaagtcttcaataactgcccctccattaaaataaccaaagaaatagtgacaggcacatttctgtgagcacattttctgtgctaggcacagtgtgagtgtttacacgcatttgcaaaacctcgcaagtctagagataggtgttactttctccagttttatagatggcaacctcagagagattaattgaaatgtctagtgccataaggtagcagagccaggtaataacctcaccaatgacccttaatgatctcactgccaacagatgaaattgtaaatgccatgaatatgtgctgtgacccaggcctcatccctttaatatcccactagggcgcaggctatagacagcaaggacacttaagattaacctaagacctaaagctttaccttggttactatcattggcactgccatgagtcacatacattgtcttatctttagtcctaaggaaaaagtcactgacaactgagtaggctggaaaatgctgtgtcacttctgacaatttttaatcctagtgtccagaaaggaaagggctctctatcactagaaataaagagattatcatgataaaaagccaagatttattctgaatatcaggacttagagaacaaagaggatgagcaaatagagacagtgagacggatgtcctctttggtccctcatgttagggaaggcttagctgtaattctcagtctaatgttcttcagaaccagttgaggggcttggccaaaatatggaccctccagtggggactccagagaatcctgctgtggggcctggaatccgcatttttaacaagtacccagtttaactgccttcaaccattcttcctcattcaccaaattttgcccaaggacacttcctgtagagaaattgcaggaacttcctgttagtctaacacaaaggaagcgtgaacctcctcatctcctcccactttaagcctggagtctttccaaggtgtcacttcctgagtcacaaaacagatgcccttctaaagaagagcacacagctacatttccattaggctaatctcagaagacaagaggtagaacacctcaagttagaagcttacatctatatatatatatatatatatatatatatatatatatatataatggaaaaagtaaaataacataatgcaacatgtttcaaatttagagactgattcattactatcttacttaaatatcattttatgtcatgttcttacgttaaccacaaaggttaacatgacagtagcataagggttattttagggaattgtattctctcagtctttagggaaaatttctgtaataaaagaaagcagtaatgattccatatgaacttctggcaatgaagtggaaataatcttttttctaacatgtagtacataaagaaagaaacaaaagagtctatatctgtgatcgctccaactcattgcaaacaaaatcagcctctggagaagtggaaaaaacattacattgtaaaaagctttgaacttccccagtaaacaggggacatagccaagagaaatagcagcttcagctttaatgcacatatcaacaatatatgtgaggagaagtagcaatttatttagagagctagtaggtcttccttatctgaataatctaagtacctgtcccctcagacaacatgtgtgcatctgagattttcttttctctaagtataaaataacaattcatgcacatcacagtttgttccaattctttctcagttattctgcatagaaaagaggcttcaatttggatagaaaagaggcttcaatttggaagaaacattttcgtaaatgtcttggtaccagtataccctcttgtatttatgttcccgataaaggaaaaaattaaagacaataatgatgcttttaatgtttctaagagtttgattgaacattcaggttcaattatgaaaattaatacaacttcatagtggatgttaagaaatatcagatttcctgaagtgatttcactgattaaaatgggaaatatcactgtacattacactgaagtattgggcatcagattaggggttaaagaggaatgggagaaaagatacatcttcttgctgggtccttcctgagtatccttcctgcttttaagattaggtaagaagagacggaaagggtagagacaaacaaaggagaaatgagaatctgtgtatatatggtctctcaaattcagctagtaaatgtctctgagacaagagaaaggcctatgaatacataatcaagattgtcccaaggggctctttcttgacattaaattaatcaagaagcactccccaccccctaactccatgaataggtaatttagcttctgaaaatatcacctttttcaggttttggagaaagaaaacaatggctttagcaaaggtcaaaatgctacaatgtccctaagcacatggcccaagtccatacatagacaacatgtgatgtcaacaaactcagtgatcttgggctacaggatcagcaacacattggaatccagaagccaaatcaagtttagcaaatctcaaataccctcagaccaatgccttcaggaatgcatctgctttggggctgctggagatattctatacaattccaagaacttgcctgactagaggtaattctgcaggatttagcccatttaaactcaagcatttgtatgacttccatgggaacatttggctcagtgagagtctttggaaaacaatgggctatatagatgggacaaaggctctcaggccatacgttcatgcagtaaaacattactaagagcttaccatgtgctgaaaactctgatatcaaacattagctctgtctctaattaactctttttttttaaatcttgctgagtctcggtttcttcatctataaaatggacttggagtaggtaatcagataatgggacaattgcaaatactgaagatcctcctaatgctgaatacttacagccataacatatttgatctcgtatggcaaaatcagataactctcataatgacagatcactgtataaaatctaaactactctagagtactagaaagaaatgaaacccacacagagtttgattgtttttaaattgggaagatgaagggtgaaaagacagtgatactgttagaacaaataataaaaagataatgaaagaataaagtcaggaataactggaaaagtaactgtaaatgaaagcctcttattttctaacaaatttaactctactttttattaggtaccatgtacattgtaaaatcttttcactcgtattacctttaatgcctcaataacagctggtggatagctcagtccaaccatgtttgatgtccgtctatacattctgaaaagccaaaagggaaaaatgcaacatgatatcttataaagtaggatttgtaatccacagactcataccaagtattgacaaataataagaagtcaagtggggtgatccaaagaacctaaaattcattttttgacatttttaatattcactcaggtggtctaagtgttaaattcaaaagaaattaaagcaatcccaaacatatgaaccatgggggaaaaaaaacctaactctataggccccagactggaaattgaattattaaatgggtcacttcttccgccagagtgaattatagtacagaatagacagtaagcagagtagtaatttagcctgaatgaagaactcctatgggtaacccatttagaatagcttgttctttagaactgtcaaaaacaagaaggaaaaatgtcccaggtaatctttaaacttaccgtggtgtttctaaaatgtataattacactataaggattataggaagaatatatctatttctggaatctattgctgggtaaggaggtcaatttgatttcaaagagtaaaatagctaataaaactgaagtgtcttggggacttcaaaccactgaaatgaactgtcttccctgggccagcaacctcaaagcatcccagatctgtttcaaatggagacatcatccacctatttcaaaagatgatagatgagatgatttcctgctttaaaaattagagactgaactcaaactaaatcttctctggtaaacaaaaaaattctgagcaaaagcaaaagcttttcctaatgatgctacagagattaaaatagatatgtttttgccatttctcattcaagactatctgtttctacccacaattttcagtatttataaagataggaaaactacattaaagcaaagcttccagttattggaaacgtgttgctttggctgctttagtcactaaatgacaatgaatgacatctttacctctccacaaatatcccagcctgcactgcgtgaacgatgctcttgaaccggggcttctcgtcgctcctcctgagcatcatccccatctgccgcgtgaaggtggaggccagccagtctcggacctcagaaggcacagcatctgactgaatgtcactgagctcatcctctgtatccaggagtctcctgaacacaagaaacagaatcagcacactgagattaaatctgaagttggagctctctgttcaaagcagctgctcctctctgcctcacctgcatgttaggtgcaaagaaaccaaattaaattggccacaaaaaatacagtgcctttttggtaaggcttatgtaagctcgccatgtgtgtttcgcgatggtcttggcttccactgatatttcaggatggttctctctaccagactggacaaaggaactggtccattgtacccagaagcactctgtggcatttgagtgaaatttaaaccttctatttaaaaatgccttcacagggagccttgtattatttcatagatggaccatgtgacgttattttgtttaaaaatataaatggatacttaagagactttgcaaagtatttaccaaatcacagcaacccagtcctctgaagtagtgatcctaagtgatgacaattaagattctttccaggttgctaccaaaatttaaatgtctaaattcaaggaaaattttcaaaataatgcagttctttatttgcgcacaatgatttaatcatctaatagctgtgttttgctgatttttcaaacttgttcataggtcagaccactagaatcgaacacaaagagcaatgttaaaataaaacctaaaatagcatgtcatatttacagtaaacccaactaaaaatcatcagtaaaagtagctgccaatgtaaaggtgtttggattttttttttcctttagacttaccaattggggtggaggtaagcggaggaaacataacatttggaaaaaagctatgatatcgaatttccttaaattagaaaccaagtgtgtcagcaaaataataataatagtaaaccatacaaatcttagattactgtgaaatactttcagattggaatttggcaaataaaagacatcacaaatactgacagagaagcctgtctaaattagggggaaaaaaaaccacacctttcgtattcaacatttcaacatttttcaaaagaaatgcaattttataactttcaaacgtatgtagtaactgaaaccgctttaatacgtttagataattcaagtggaataaacctgctaagtaaatcagcgacatacgtaagactgaagagggaatgctgggtgcttaagagaacacatgcttctcgatcacttcaggagcctccatttactaatggacattatgaattaaaacataaactcaatttttagactaacactaaaaacatacaataattacaatggagctctatatctgatttttaaaatcttagtggatttttaaaaattcgtttttctcctctttcatgatctcacttccttgtcatggcggccatatgagatttgttctattagctccttttatagatgaggcggtacagagagtaagtgacttgtccaaatctatcctctttgtttgtggaaactaaaactcaaagatgagtaatttgaatgtcaccccattcctggcatgggggacaatttcagaaaagccatttaagagaaaatttactatcactatactaatctcttttgttatttttagcttaccttgtttcatcaatatacacagattcaagcactgtggctgcatattccaaattcttcttaagatctaccactgaagcttcccctctctctaattgtttgaccaaagaccgtaatctagaaaaataaaaagacataatttcattagaatagaggaaacaaagaataatcctacaactatggtgatacattttacagtcatcgaatattctcacttattctgatacatctgaaaggaaaataattatgggaccaaaggagcaggtaataaaataaatgtatacatttttgccattgtgaagtaagaagaaaaaatttctctccaaccaggcactgaccatactttctagctagcttttatctttatgaatcctaaattatcaatgattttgctttttctcaaattttcatcttttttgttctatgtggatgtagtaaagcctgaccagcagcaaaatcaccaaatacctcttgagattctgctctgttgaaggcacttggtccagcagtggccccagataatggcagccccatgacccaggcatgtcccaagacagatgaaaacatataaaccactgagaaccacaagagggctacagaaggaatagatgaaagtaaattgttttactggacagaaaaaatcactctgagaggagataaataccctagttaaaaaagaaaagaaaatatgaggattgattttaaaccgaggaattccagactatacaagagaagcaataaaacatgttttttctgttatttatatgaacattatctgcacagaggacttagtattcatgagaacaataaaatgactacagatgatcaacatgcggtaactgagaatactgtaaataccacagagatttggagattgggcaactcttcaggctgtttgataaccagcaatgaaaagagtagagactttgaagacgaactggggtttgaagctcacttcataacttattagctgtgcaaccctaggtaagttatgtaacatctttgagtgttatcttaatgaagagcaaagtatgaaatttctaaagttgacctaaagattaaatgaaattgatatagagtatgtgactcggttgttctttgaaaaggcaatcgttatagctattgtcattattcaatgactttgatcaccacagataaccaaatgagaaaaattctagcaagatatttaaaatgattgtcaaatctccacttcccgttggtatacgcaatctgttctcaccttcctgacatcaaaatatcctcaaataggttgccttcatggcaaggtatagactactcccttcctgatttgcatgaaaatgacccacaataaagaatgagaaaaaatcttggatcaaccttaaaaagtaagcaagagggtcaaccataaaataatttccaggagtttcaatgatataaaatacaaataacattagattcaggtagtatctacctgaattacgaatctgcaatatatcaaacggaaatatgcaaaggaaatcagcagaggcccctgcaggcttggaggtgaaggtcagccttggcaatgccattagcagcactgggaagagttctgaatttcagaggcagcacgagacagggagttggcagggaagggcatgccagtcactcacacagaaggatagccagcctgccaaagaatggggagacagcagcagggagctctgactgctgctccaaataaggattggaagctctttagcaaaacacattcctggctaagtctgcctccagttctgattctcacctcaaggtgcccagctatcccctaggctgtttggactcccaaacgaaaaaatgagagtaaaattaaacttttcaaagtttagtctcaaaaatgaaagtaaaattagactttttaaagtttactctcaaacataagagtaaaattaaacttcttaaaaatgcctctctccatttggggcttacaggttctatcaggaactgacatgtaactctagtagaatccatctcaattctagaacctaagaggaaatgacaaaaaccaagaaaatgatgagaaaaattataagagtaatagaagtaaaagccagaagatcctatctacctataatagaacttccctaggaaataaacaacagaagcagctttaattgaataagttttcctaggctaaagtaaaacctgtataagcagatgaaaagggatcaaatacaattttttaaaagtaaatgaaaacatcaaatgtatgctactgtaatttttgatttcaaagaataaagaaacaaacttgaaaatctttgagaaaatgaaatataatacttacaaagtaacaaaaaattgtcctggccatctacttctatcatgtcaaacatcaaaaagcaatttaataacagtaccaatttttgagaataatatgggaaacttcaagacatttatatctacatctacagagttaccaagtacataagaagccaataaatacattctcaggtgtcaacaacttcaaaatttatcattcatatcctttccagaaaacaaaacaaaaacaaaaactttaagcacagtggtcttccaagggagtgaattcgtgagtctccagttaaatggattgttgattcatgacctagatttaactaactcaaactgtaccaaatggacaagtaatttaaaaagattctggaaagaagagacagataaaataaaatgctgataatacaaggacaactaaacatgaaaatgagctgacacgtctccttttactaggacaatctcctatttctcatacaaacacttcctctcccacttttacaaactaaaagctaattctcatcagttgaaaaataattggaattattaaggacattatatggactatggatgtatagccactaatttttaacaattcccactcctgggaaagcacagtattgagagaatcaagtcatgaaggggcctcatatcaccttgtgatcagggggctgggaccccagggccagaagaggagtggggccttcagggaaagcttcacttagaatctcactcagctgttccaatgagtagcactgaaatcggctccatcagggagacccaggctttgtgccacaattagcagaaaatcagccattcagaggcttctccctgatgtagtcaccagtggtgccaggcagacattaggcagtcacatttatgcattcagtgtgaagttctgacccaacaggaagctgtaaatagaaagcaaaaccctagccaagtggtttcaacagatccagagaggaaatgacacagaaataatgcaccttttggatgcgtgggaggcactagaaatttatatgtaaccctgtctttccagcttatgagatgagcagaagattcaatcaacttcctggcagacagtgagggaacctagaacaacccgtcactctgtttatggaagaacacccagctgacattcacctttctttactcaaggatgatgaaacagaaaaaaaattcatgaagagatgcagcaataaagacagaagaaaatacagcattcaaaatgtgaaaggattcacttttgaaaaaaaaaatcactaatggaaacagaagtgaattttagggagcatctgctgtgtgttcaatacaattcaaaaaaaacccatagatctctgaaacaaaggtaaaagcccaaatcaacacaataagaagtttctttaaaaagaaaaaaacatgacaatagaaagactacaagaacttattgttaaaaagagttaagtggtgaccagctttgtatatacccatctcctgtttgggtgtcacccatgtcagatacaagctgcagctgccaactttctgctttatgtagctgccacacaaagcctagtgattccagatgcccctttcaaattctgttgagctttagcatagtgttcaggtgcttatgctccataggcccctcagcccacctttctctagctctttatccattccatttggaatatccagccctgccctgccatatcctacctacctcttggtgaaatggctattctttgggcaaaagagtttcaaattagctcttttatcattggccaatttaagttcatgagaataaggacccctctctatttgtcattatagtgaaggtattccttagatcttaatctatcttaagaagggttgtctgaaaattagccaggatctttcatacccatgtcataaagtatttttgttcaactggaaaagactagctgaggccagagggctcaactgctcttctttgttttcctagtaaagttgtctagatgcttttcatgtgaatccattccatctaaaaggcaaatgtcctcagaggccaggtcccatggtatgctgcagcctatattttgggaaagatggagatctggtgttttaatactacccaggggaatttttggtctggacacctaaggggaatttatttcatgagcatttgaaataaatttacaaggaaggaagataaagaagtaggaaaatatacaaataataataatattaataagatttctcttctgagagaatgaatgttcatagtttccagcactccatccatttctgtcactgcagctgccagataatagttccagtatagaagtgcaacaccattttaggaagtgcttatgccttccaactttggcaagatgcctttcagttaagacagtgtgcaatttcattgtggatgagccattgcatcttttcatgactcttgcatttcttggcgtaaactgtttgctttctgtatgcttcttacctgcaaggcatatgatgagatactgaatctcttcagttccctgtgccctcagatccagagcgagccctggatgctgacttcccctgaccccacaccaatcaacatgtgggatgcacaaaggtgttggaagaggggaactatgtgaggaaaggccagagcactgtattttgtaatttaaaaggatgttagggaggagagatatttcttttttttccacaaagataattcctaggaccaatggagtgagcttcattaaaaagcaacttattggttcaactttataatttagaaaactgccttatactggactaggcattattccccaccccagtgaggtcgcagaaagccctataaccctatgccttgaaaacatatacatttgttgagcattagaccctactagaatttcattcttttgcacaaataaaaatgaactataaaaagaagctatggaaacatactttctcatgtttgtctattctgcccaaggttattccctctgaggatgggggggcagctcctaaaatgccagtgtaaccaacaagtactgctgtctcagaaaggctttgttttgtttgaaaggatatgagagagaactggatcttttacagtactttctctacatgtcccaatggatcatgagccctaaaaactcatttgaattaaaaaaacttcatttcagttcatcacacccatgtattcgaacagcatactcatctctgtgtccttttcatacacctgcctcctccatgtcactcctgtcctctgccacttacctaaatgccataggaaataacttaaaacaactcttccaaatgggatgccccaacatgacttttagtcttatgctttaatgccatccaatgatgtcacccaagcatttttctggccattgtttgtttctataattaatgacagctgattaagatggccacacttgaaaaacattcaacattgggtgtcttttgtgtgcaggcactgggagagataggctctaggaatacaaagtggggaaatgcagtgccttctctcaggtagggaagacagaaagctaaccagcacccacaatgcagtactgtaagcgaaatggcagaggtgtgatgggggctaagaaagcacagaggagaggaatcttctaataacaaagccctccccagtggagttgaccagagccattttgaaggccacgtaggggtcagccaggcacagaggatgggatagggaaacggcagactctgcatggagagagcagactgaaggcagtgatctattcagatctattcagaatagatcttttcggatcttttcagaatagatcttttcggatcttttcagaatagatcttttcggatcttttcagaatagatctattcggatctattcaggggcgtgtcaaaagataaaacagaagaaggtaggaactacaccacagtagacttagaatctcaagctaaagaaatgtaattttctcctggagataatggggaacccctggagaatgttaaaatggaggaacagaatgatgagattggcattttagaaagatcaatctagcagctgagtagaggagcacacatagtgagtgagatggaaaattctatgtttccattgtaatcaggctggtctgatactctgaacagcacagtgtgaatactctctctcacatgatggaaatttgatagagtgatgcgtgagtttagtggtagtatggatggttgcttttaagaatttctgggaaagacattgttttggggcatgcggtttcctcattgagtgaacatcaaaccaaaaacaagaacagtgccaacaaaaattatgactggcaagaatagcctacttatgtagcttttaccttttgttaatgctataaataaaagagaattttacttctacagtttctaattacatctgcttaaagcagatgcacacatggattgaaataaattactggactccagttactttttcacttaagaaaaataattagtacctaggtgcatacttatgtttctatacttttatatgcctcactacataacttgttaactaaaaaaaaattagtaatgttatagaagattttgaataacgtcatgaacaaaattgacctagttggcatggaccggacactgcactaaattgctgcagaatgcaccattcttttcaagtgtacatgtaatagtaatcaaaactgaccatgtgcagggtcacagagactctcaataaatttcaagtaattgaactcagacagataatgttctgtgacaacaatgaaacacaattttgttattgattagaacccaaaacaaaaaatggctagaaatatttcaagtgtatggaaatttagaaatagatttctaaataacccataggtcaaaggttaaatcacaaaataattctaactgaacaataacatacagccttgtagtatgcagctaaagcagtgtttagaggaaaatgtgcagccttaaataaatatattagaaaaggagaagtctagcctgtaatcccagcactttgggaggccaaggcaggtggatcacgaggtcaggagatcatactggctaacatggtgaaaccctgtctctactaaaaatacaaaaaaaattagccgagtgtggtggcaggtgcctgtagtcccagctacttgggaggctgaggtaggagaatggtgtgaacctgggaggcagagcttgcagtgagccgagattgtgccactgcactccagcctgggtgacagagcgagactcagtctcaaaaaaaaaaaaaaaaaaaaaaaagaaaaggagaagtctaaaaataagtgatctcgttatgcacctcaagaagttagaagaacaagttactccaaagacagtaggcaatagcaaaaaataagcacaaaaccaaaacttaagtagcaacaaactcacagcagaaataattagcaaagccaaaacctgggtctttgaaatgcttaataaaatggataggtcaagcaagactgatcaagaaaaaagagaaatgatataaataaccaatatcaaggataaaaagagactattactacagattctgtggacatttagaaaggtaaaaggatatcataaattcctttctgaagatacatttaaaaatttagatgaaattttaaaattccataaaatattaatttatcaaaattgacataagaaaaaggtaaactattaataattctgtatcagaataatgatacagaattgtatcagagtaattgatctactgaatattgtatgggaagtcttcaccagttcaacaaagaaagaagaaataatagacataggactggaaaaaaataatatctttaaaaagcagcaaataagttattctaattaagaggtgaatttagcaatgccacttgataaacagcaataaacaattagaaaatggtaccattcacagaaacatcaaaacgaaacagtttctaggaataaatcttacaaaatatataaaatcatctacatggaaaatggtaagatattattgagagaagtttaaatgacctaaataatggaagaagaatccatgctcatgaattttaacactcaacatttagaaatatgaattctccctaaattcacctgtagattaaattacaaacaaattcaccacaagtcatttggtggaaaccgattctaaaatttacttagaaatgtgaagaatgaaatatagttgatgtggtaaaacaacaaaactgttgttactatcctacatatcaagacttattataaagcatttaattctggtcccatgtccctctaccacttcactattccaactctcttcctttcaacatccagctggtatgtgtgaggatgtgcatatgtatttttatattcatataagcacaacataagtggacaagaaaacatgctacaagaaaaaagaaaacaggcaatgtaagttgtttttgaactatcctattctacatgtgattgttccattccacatgcagggacccactctttggatacccagtcaagggcatcactgcatactctgtcttggttgccatggattttctgatgaatatttccattcctttggttttcgtgaagctatgccacagaggagccctgcatgctcagtctcctccttgttctgctctacagagtgaatctcctttggggatatatgtttgtgggtgtgagagtatgtgggcaactgtgtgtccaaagtgagtgtgtcagctcactgcatgggaacaccagccaaaatgcactgtcaagtccaaaagaagccttctattcttatggtactctagaaggtgttacgactcagggttaaagttttaatccattttgagcaataatattgactttgttcctttgcacttcttatcaaatgcagtactttagaaaggagctccctaacagtcattcttggccttataaataagtgtttcttaaaaaccagtttatcccctgtttttattgccaatcaactcacacattttgttaaaaggacatagcggatttttttttagagtaagattccaaattatgctaagaaaatctttcgtgaaggtaaacattctctctccaaagtttgtaggcgagcagaccttattgggaaaggatgttattatgaaaacccacttgttcttctgggtgaagaaataaaaaagaatgaaaaatacaacccagagcatcattcagaatccaccccaggccatgctggggactggggagagggaagcagttaagatcctgacagactaccaagaggtaagttccagaagccagtgttcatttgcagctattcatgtggaaagaatcactgtcacttctgcctgctgataaacatgccacttcaacatctgtcttaatagaccaaagaaatgagaagaactaaaaacatctttgaatggcactaatgagaacaggaagctgagcagaaatgagaagcaagtttgcaggaagatttaggaaggttgcaacccatgcctagacacgtcaagacacatctttccatgtcttcatagtcaacccggtcccgtgactcctttgctttccttttctgaatttagttcctcattcaacctcaattgcatcatgttggtatgattatccagaggagctaaagctccctcagccagcaaaatcacaggaattctaccatactacaaatataagttttggtaagataaacctaaggttacatttttctcatttctacttcttttttcttttataataacagaaataaataaattaattcatagattaaaaaccttcaaataatggctaacaagatgctgaattggcacagttccctttcttaagattaactcaagaaaaattataggaaaaaaacctcaaagaaaaccgtgagaaacctctaaggtgacctgaggctgccgctttgaatgtgtgtgtgaagacagtgcatcttcttggtctgggacaggaggcagccccaccacactggggaggaaatgatgggaaaggaactgttggagtctgctattgtttccctccactccacttcctccaggcgcacagtagctgctcccacacctcctgtgactcagaactctaaatgtcaagaaatcctggagagctaaataggggttgtctgtcccaccttgtggctcctctaagttcaccatgggtttccaagattgtcacagaaggaaaagggatgcaaaaggacatgtgcgagaggtttttatgaaccagactggaactggaactgattgctcctggtcacttccaattgtccagaagccatagtcacctaactacgtctttccaagagagaagctggaaaacacagtcctgtggtaggctcaagaggaagaggtggtggttttagtggagatccagccaatctctgccccacctagaaaatgcaatcctatcaccaatacttgttttttcctttaaacctttactttctgctcctttgaaagagtcaaatggaatgttgtatattaaagatactttctaactttaaaatcctttaaaactaagaaacgtaatcatcctaattatcagataatctcccaagcattttgacaaaaatgagacagttctcatgggaattatgttgagtgaagaaagccaatcccaaaaggttatatactatatgattccatttatgtaatattcttaaaatggaggacaagattaggggtttacagggattggagagaagggagaggaagagggagacacgtgtaagaagggcaacaaagggaacctactggtgaactattctataccttgactgtggtggtggttgtacaaacctacacttgcaattatgttgcacagaaccaaatgcattcatacacacacacacacacacacacacacacacacacgtgagtacaataaaactggagggctctgaataagattggtagattatgctaatatcagtatcttgggttgtgaaattgtcctgtagtttttcaaaatgtttccattggaagaaaatgggtaaagggtacatgggaattcctctgtattatttcttacaataatgtgactctacaattatctcaaaattaaacatttagttttaaaaagtgggacacagttatccagctcaatggaatattgatgacaaaaggctggacatagttgtcctttccccagctggttttataagtgtctctctgttcttaaatagtggtctacttagtgtcctccagatccttcggcttggcctcagcagcagtaagagagttaggggtaaatgttcaccagtgagctactaactgtgtctgatgactttggagagcatccagtgagggctataatcagtgatgcttggagcttggtgagaaccagactcatgccttgaggaaaccctgggaaagacaaatggaggttctcaggatcaactgaagaaactcagatgctagcaaatggtcaccacactaaaacggtgagagaaaaagaatcccagtgactttactaaaggctcactaattacacctctactggcagtgatcccctgggactctaagatatgaagcacgatttgcatcttccctctcctttttcagttcattctcagaagtttgtttcaatttgagggtggcttcactatggcaggctggccatgaaggggttgtaaagaatgaaattaatatacacacccacacccaacctctagtaaccaccattctatgttctgcttctaaaagtttgatttttttttagatcctgaatatgagaacatgtggtatttgtctttctgtgtctggcttatttcacttagcataatgtcctctagggagtgaacagggaaaggagagatgttaatcaaagggtacaaagttccagttacacagaaggaataagttctggtaatctgttgcacagcatggtgactatagtgaagaataatatattatgtatttcaaaattgctaaaagggtagattttaaatgttctcaccataaaaaatgagaagtatgtgaggtaattgttatgttaattagattgatttaatcactccacaatctatataggtattgaaacatcacattgtaccccataaatatatacaattattgtcagcttataataaaagtaaattttaaaaataaataagagtcgattccataaaaaaatgaaaggaatgaaatctagagctagctatggactaagggagtgagggagtgagggtagacaagttggggtgtgaaaacacaggtcacggagacggtgttttgttgtatagtcatttccaataagtaggaaaacaatttgcatattattaacatttcaagtttgtattcaatgtaattaccattcaatttccttccaactatacatcattttgtaatagctttggggtgggataaggggagggatctgaaccagtaattcattgtcgtttgtggtcagctccagtatattctaataactgaacgtgtcaaaagcctaaagctttttcattttgtgctatatttaatagaaaaagaaaagaagaattgggaagacttacttatgcagtcccatctcacttgccagcaccacctccctttctttgtagatgaagaatgggactcctttcacttttagttctattaaaatagctctggctttctctgtggttaaaaatatgagcttgatatcgctcaggtagtgacacaaggtaaacgctaatacaggaccaactcccatagctatttagaaaaaaaaatcctcctctgttagctatttctatcacaatttacaaggagagttgatttacagaagaattagcagtaatagccacaaacactgttgaatcaatctggacaaagcactccacttgccccaaacaacccctcattgttcacggtggtaatctgttcattttaaaagtattatctagtgctttggagtttgtccctcaagaacagcatgagcctccactgtaccaggacttcctcgcttagcatttctaaaacctcttaaatctgggaacatactttgtaagatttgttttaaatgatatttgaacctacatggtgtcataatatattctatcattgtgtgtaaaaagaagaattcttttccaatgagctttattgagctttagactctgacttggggactggaaagaggaagaaacaattcctttaaatgattctctcttaaagtaaaaagagacaacaagggaatcatagaatgttcaacatttgctactgactctctcaaagtgtacgtgagaatttttaaagctccagaggtggtgttcacagctacgctatcgatcgagtgtttcttgagagggagtcttcttttctccataccaggtgatgctccgtgctctggggtcacaggagaggggcatctgccctgtccacagcctgacagagccaaaggcaagctcagacagctgtgacacctaattatgggtcttcccatgaagtctgaaaaatggctgaacttggtccagccctagtgtaaatagaacaaaataagcatatttgctggaagtgaggctggtctttaaaattcataatcacacatatggctccatgaaccatctgcaccaagccatgtctgtgtgtgacttttggctctgggctatttgctattacttgctgtggaccaggtgcagattccttctttctctctcagcccccacattcacatatttctcagaaaagaaattccattggaatcagaggtgaaaagctaaaacctgtggcctgggtgatctaccattttgacttctgtcacctaaaaccctagttccgcctagtgcagagatttttaccacttgaatgcactgatgtgtgacagagaagagtatgttgtgtttatatttcccccataccccctgccaacagccattcccaccacgagaacccccagggagcagtggaaagaggaatctcaggaaagtggtgtctatgaagtacatcagagttctggggcaaagtcctgaggcaagagattgttagacagggcaaggagagaatggatagctggggaatttagccccatttccttttcttaaactcagtaaagagatgacctccaaggtgactcccaggacacccttacacaaacccaagatggttacatcagattaaaaacagctgcatctgagatagaggaaggccacagttcagaccacctgcatcttcctcagctcctaggcaggaaggaggaagatttcagaggtcccctgtgccctgcaaagggacaggaagcagctgatagtgctgactggagggattattaggggcactgccatggatgagggacagagggtcagggatcaaataggtgctacagccagacctcagctggatccatagtgccaggaggagctgaacagggacaagctggtggggagaaaggcagtcccagacattagctagagatgtcactaagacttcctgtgaccaagcagacaagagatatcaccatggagtcaagaggaaccagaggacaatacaagaccctgctgtcttggagagtaacagcgagcagaataaagaaatctcaaagtctaagcatttacatttttttaagtgagttacctaaaaagaatgtttaaattgctagattgggtggtttcatgaattggattattattagtttctctcttttctctctctctctctctctctctctctcactctgtctctctgatatggtttggctgtgtccccacccaatctcaccttgaattgtagctcccataatccccacatgtcaagggagggacctcgcaagaggtaattgactcatgggggctggttttcccgtgctgttctcgtgacagtgaataagtctcatgaacaccgatgattttataaagagcagttcccctgcacatgctctcttgcctgctgccatgtaagacatgtctttgctcctcttttgccttctgccatgattgtgaggcctccccagccatgtggaactgtgagtccattaaacctctttttctttataaattacccagtgtcagctatatatttattagcagcatgagaacagactaatacactctcccttacatacatacatacatacatacatacatacacacacaaacacacacacaaactgccccatcacccagcagggtgagctcatgaaggtcaggtcatacataggaagtaaagaaacctcagtttctctgcacatctgaataaatctggccctgctatatgtacagcactcagcaactccttagtggcaggcagggcatagtggaagcagagatgggcacaactgttgtagtttggaggtccctgctggaagggtgaagggtgtctgccccaggaccaaagggaggaatataggggtagaaacaggacctgtacagaaaatgcacagtagttgggaagacatgagacatgaggtcaccaaactacgtgaatttattaccagaaataaagattcctactctcggacttctgtctgttcactcctactagctcttttgatctacttggtaaggatttattcccaccactgttacttaaaactgacagctagccttgttgaatatactccccagaaagctttctttagccttcttgtggtatattcacctccgtagcagccagtcagcaggcactgataaagagataagaataggaaaaaaagacagaagatctcttgaagaagtaagatattggtgatactattggcattgttctaaatccagtgcaatgattcccaaagccaacattgcattctaatttcctgggaatattttttaaagtacagaaaccaaggtctgactttagaccagagtgtgaaatggcataacaattgatggtaattctgaccttgtggggtgggacaacactttcagccaagtaattggaataattaagctaccttgtcatggtgttaattgtcttaataattaaacgaccttgttatggtttgaattatcctgacaagtgctttctaaactgtataccacaggacatctagcccacaggatgttaacatgcattgctggagagaagatttctgttgcacaaatatttgagaaatccaggttaaactaagttaagcaaagtttgtttggtcttcaccagctcagagctttttacactgatgtgcgcttagactctccacgatgaagcaattgtgtacgtcatttccctcctagatctgacaaggtcttgtatttttcttgtaaatcccccaggattagagggttttattgcatgggatttggcgagtgctgctctggagtgctgtcacagggctctacttccctgctgatgcaggtgcagtcagggaaggcatggattcaatgaacttgacatgaagtgatgattgtaaatttaaaacgagacagtttttttgtcacgcaaggaaagtgtcctattacaaattaagatacaaaggtaatgggcagaaaacatgtaagattatacattcgtggacttaaaatagcaaatcatggcatacagctatctttgaaaccagtttttctattttatgaatatttcaatcacttctttggttttctctcatatccaattttgtggcattattacattatgaacctatgatctcataaattaaacaggctcagataatttgacatacttcacttttacctcacaatgacgagagcatatttttaaacatctctcccccttttgtctctgaatactacttttctctaatattgttttctgtctctctctggacactctctgaggaccagttaacgtcatgtcaaggacaaatgggtgcatcattatgactgccaaatctcaagggtcctgttacatatttggattgtttttcctgaataaagcatagaatctccaacgctcattaattcttctatattcacatgcttttggttagaagaacttctgctcaagactacaaaccaatgggtttttttaaatatatatattttttcctttcttatagtcagaaaaccaacaataatttgtttactcaccacagaacattctcaattacaatgctggtatatattttttctcaggttttatttaatacttttcctaacacttcctaagtaacagaagggtttggtttctttgtgtgtgtgtgtgtgtgtgtgtgtgtgtgtgtgtgtgtgtttactatactgaaaaatgtgagatacaaataaagttttaattcatgttcttttaaaagagaataattgaaataagtatttcacaaatacctatcattagaaattcctttcatagtctcccacaaattttcttaaattttaaaaacctttgctttatttgtatttttaaaagaatctatggttattgtgggaaatttataaaatacctattagaaaataaaatcacataaaattgtaccacctagggattacaactattaacataaaatgtttatataattattatattgtatcatgtatccatagagtttaaacttctctacaaaatttatttgatagtatgctttaacacttaatgtattataaacactttcccttgttattaagagtttttctctgatataattttaataacagcatagtttgtctctaaatatacatatcataatttataaaatccactattgcaggacatttaggttgtttctgatttttgctgtcataaactgtattaaaatgaaagttttgtaactacatttttgtacacttttgttattttggcttttatttgattaagacaaaattcagaagtccaatcaggattaaaggagagaaatatttctaaatttgttgatgcttattgctaagcatctaaacacttatagcaacctcctctttttctccagcagaacgtgagcgtggctacctctcccagtaatcacagaaacctggtaagactgtttggaaggcaatggaaatatatgtgcaaaaatgttttttgtctcatttttgtaatccttggattttcaatggaaattttggaaagggcagaaataaagggcttgagataagatgaccatctttcactagcgtggcttcctccattgcaactagatttcaactggaagaagttatttatatttctaatataaaagagtaaagaagttacctgctcccctccctgcctctgtctgaagcgctccataattcatgcagcctggcatcctgtcagtgcccttagtggactgttgcttttagtactgatccttaccaagagcatgggcagtcccacttttttttttttttttttttttttgagacggagtcttgctctgtcgcccaggctgcagtgcagtggcgcactcttggctcactgcaagctccgcctacctggttcacaccattctcctgcgtcagtctcccgagtagctgggactacaggtgcctgccaccacgcctggctaatttttttgtattttagtagagacggggtttcaccgtgttagccaggattgtctcgatctcctgacctcatgatccaccctccttggcctcccaaagtgctgggattacaggcgtaagtaagccactgcgcccggccggacagtcccgtttctacaactcagtcttgcctataggtcacaatgcagtgaaaagcggcagctgatagtgtaagccccgggagatcccaaatgcccggttattaacaagtgttatatatttttaaaaagcaatacagattttacatcatatatgagaagggtgttgaaatcaagggaagaataagagacagggtggaaaaaaggaggcttccacgtgcgggagacagagaaggacaaaggcaggtacagtaatgaaaagaatgtgtaaacccttagtatgagcaggcctatgtaaatagcagattaatctattacccagttcattttgcccaaaggctttctttaaacggatccttgaatatgttccccattatagtctcatggtaagggagtgattctcaaggggggttgcaattctgtcccccaccggaaattagcaatgtctgaagacatttcggttgttaacaacaggaaggtgctactggcatctaataggtatgcagggatgctgctaaacattccacaatacacaggacagccccacagcaaaaaattatctggctcaaaatgtcagttacgccaagaaacctcactccaagaaaagcgaaagtgtagtattttttcatattggaaaagagcaataccattggctaaatgtctctttaattaaaaattaaaacccacaaaaagaaatgttcaaaagtagaaaaagaaaaatccctagcctatcacagatactctctacttatataataattgttttataagtctttccaattttatttcatattctctctcatcatatcaacccatttgtattaaatgtctgttgcataattacaaatacacaataaattattttatcaaatgcttattgttccttatatgaaatacgccattctaaaagttacaccttctagaaaacaagaaaaagaactaagtaacattcattatctttttattcctggctaccttttttttttttactgtaatatacaatcctttattgaaagttgtgaaagtactaccaaaatattaggttagagatggtttatcttttatattaacagtaagttaaaatttactacacaaacataatgactatcaattaataaatatggaaacaaaacagctgtcaaaaatgtactagatatccaatatcccatataatatttatgtgaagaaaaaagctcggtaattttatacatattcatatatagcaatatatattcatatattgcagctatatcacaacaaaataaggttgttgtctatgaagccctattgacttcttgagtatcctagaattttctgtttcagagtgtggttttcagctttaaaaatctaaaaattaaactttttcagtgttgtcattgtttaataagttcttcagattcatgctaccaagaatggttcaatattttaaaatctatttatataatgtaccaaataaataagttcacaaaagtctatatgatctttttgacagatactaaaaaaaaatttgatgcagttcaatatttttcttgatttaaacaattacatagtaaaccaggaatttaatgacttttttaaatgataaagaatacatatttggaaacaatagccaggattatatttactgaacaaacaataaaaggattctattaaggactggaataaggcaaggatgccctctagtagcattatttacaaaaaaaaaaaaaaatggttacgaattatagtcaatgaaataagaccaaaaaagtaggtagaaggaatgaaaaattgaacaaaaatttcattacttttagattataaaaagttcaataaattttaaagccattagaacacataatgaaatattatatagtaagtgattaccaaacagatacacaaaaataagtatcttcccattaaaggttcaataacatttaaaaatataaagaaagctattctattcaatataacagccaaagtatatatctaggaaaaaatgtaaaaagaaattctctaattccatgtgaagaaaactataaagttctactaagggatataaaatgaatattgaagaaagtgagatccacatcatatttttggatggaaaagcttaccattttaaagatataaatttctcctcaaattaaattctaaactatggatttgttgcaaaatttgagaacttattatataatttaacatagaaggctaaacttttaaacatagccaagtaatttctaaacaaaaaggaattcaaaagagaagtaattttatgtcttgtcctaccatctataaaaatataaattttaaaaataaaaacaatacagcactattgtcaatattgagaaaacaatctgatagaataaatagaatttccaggaaaaaatactaagtcacaggataggacttatatatgataaatttatttcataacagtaaaaaagtctgaattattgaacaaatagtatataacgtttgtcaagtatagctgtaaaaataattaatgcatttttaacaacttaccccaaaatattttccaaatggaaaagatttaaagatttaaatgtagaaaagtaaactcatacaaatacttaaaataaatgtaagatatatattgtatttatataatttgtgagtggaaaaggtttctctaagcatggcatcaaagcttgaaagcagaaaagaccaatagagcaaacaaactaataacaacttataattgtaaaagatttaaaattatattaggacatgagaaaaaatctatttactacatattataacaaagtatcatttctaagagacttgtgaaatcaataaaaacacaaatatgctttttacggaaaatataaaaaggaaatgaaaaagcaattcacagaagaactataaatgtccaataagcctagaagaattcatgagcctcagaaatgcaattaaaatttcactgggatttcattttatttattaaattggctaggatcataaacaatagtaaaactctgtgctaagcagcacaggaaaaaatggttgcttttgtaaattgctgatgggtctataaattagtatgatcttcttggtaggcatttggcaatatttgccagaaacttgaaaaatgtaggtatcctttgatttaaaaatttctcttctagttattcatctaataaaataaataagcatatcctgaaatattcatttacagacattcatcactgttctggctatggcagcaaagatggaaaacagcaaagtttccactaacagggaattgattaaaaacattattgtaatatcacacgatgaaaaaatcttcaatttttatagctatcattatcattataacacatgcaatttagaattatgtaatatatagtataattataatattgatatactatttataatatcgattaacattaaaaagttcataatatattgagtgaaatgggtaggtacacttacttatcagttacctgatagagtctacataatagatctgtcctagtcttcctaaaccaaatgctgagattatcaaacaagtatgtcttatttctgaaatcagaatgttttgttttctgttacatatcagaatattttataactgcatatttcatttgaacaaataaacttcacatgctaacttatggtaaggcaaaagctgtactactctttcctaaggaaataatcattaactagacttaaggcattaaataatgaatagtgattttataaaaccattctatttctaatgaaaatattaaaatattttcaggaaaaatgagatttctgaaagaaaattaaaaattttgcaaatgggagtcatgggatactacataatattgttttaaaatgctaaaccaaatcttgtcatataaatcagaaaaatatctgaagttgtatggaatgctcaaaacttttagtaaattataatttattttctgctagaaattaaagtcaagagatcctatttttacaaaaagtcataaaatacaaggaagaactttttataaccttaagaacaatgctaataataaagatattcaactggtgaaaaattctaaagaaccaacttttcatacatcagtaccctggtgaattgtaaatgtcactcaaataccacaaggtcagattcttagatcaattcctgcattaatacttcttgtataacctgccaaccttcaagtactatatactctagtcagcctggaatgttgtattataataacttaaaaattaaatatcaggatagtctattcttttcccaaagcttcaaagtgaggagcccaaaatgggaagactgattccttaagagagatttctccaaagatgagaaagatttgcctgagtcaaataggaagtcacttggtcaaacccatttattattacaatctaattatgttttacagctgctcatgagatgtctaggaaattacatttgcaactttagtcaaaggaccaatattaatgcttatttaataatcagttctttgggtatctctattattgagataaatatgattgagacatgataggaagtggtcatttctctcataaacttattctgaccttcaacgttggtgtataattgcacatttatacaaatgtatgtcatttataattgcacatatgtatgtagaacagtgaactttggctggtgggaaaattcagagtgaagattttgaagattttcttggtttcatgactaatcatccttatccacaagaacagagagtgctatatgcagcctttcggaaaatgcctgtcctttcagctacacaccacattaggacagaagctggaatccagcctgaattgacacaggactgggcaataggaagataaaacattctaactcttcgtttggttctcattagagctaacagtgaatccagatctagagacactgctattataacacaaaatttgcgagcaaatcacccaaaataaaaaaaaaatctatatacaatttttaaaacttctcttagatttagagtcctaaaacaattgttaattttgcagattcttcagattctcctgaatggaggtatcacatctccactcacttaaaaaaaaaaatctaaatccactgtgtccaaatatttaaatatggagcaagttttatgtataagtattactctactgatccctgctacatactacttcgactcactatagaaatggctaagaacaactaagaacttttttccagcatttacaggtggtccatcatttctctaaagaaaaaaaaaacactaaataaagatcttattaaaactcccatctcaattgcaagtaaaattaatattttaattgtaaattatgcatcctatcctctatgtttcatgcctataactgattaactttaaatggcttatggaaaaaggtttggatcctctgtcaatcaaccatatttgttgatgaaataattttatcatcataaattaagagcattttatccagtagttgaatgtgttacctagttattattcaactaataaacatggtaaaaagtatgctagatttttttaatttttacattcttttatatattggctgaacatacttactatgggctggatactatattagatactgtggagaatacaggtgaagctgacatggaccttggcctcatacagctcacagcctaatagtatgaattcactatgaaataccaaatgattagttccatttaatataatgaacacttaaagattatcattgtgccatacagtattctagacccaagaaataaaaagcaaacaagtcacaaattgataatattccacttggtttcaaacataagagagaacatctgtattgttgtggattcttatagaacatctctatttttatagattatttaagtatcatcactctaatatataattagatgtcagtagacctggactttgttatcttggcttcctgaaaaacaaaatactggattaaaaaaaatgttatgccatctatttttacaaaacttttagagatgaaaatgtctatttgaaaagattataccttttcttgcaggattatcttgtataaagaatcagtaaaataaatcccttctacactttagagccaaaaaacaatttcccacgttaactggacaatggaaactatacaatttaatgtgcacaaatttttatcttcttttaaagcccctgtggtcaaaatttcctttatattgctatgagcatagtggacattgaataaataggttagatgaataatgaacaccaaaccaaatatttcactttagacacactttcttgtgctcaagttgatacaaaattggttagtagctgataaggtttggctgtgtccctacccaaatcttatcttgaattgtagttcccataatccccatgtgttaagggaggaacctggtaggaggtaatcgaatcatgtgggtggttacccccatgctattgttctcatgatagtgagttctcacaagatctgatggttttaaacgggacttttccccctcttgctgggcacttcttgctgcaagaaggagaattgggcacgtctccttgcttctgtgaataaggacatgtttgcttccccttcccccatgattgtaagtttcctggggcttccccagccatgctgaactgtgagtcaattatacctctttcctttataaattacccagtctcaggtatgtctttattagcagcatgagaatagactaatacactagcagtttcttcgaaaatcttcacatttgaaaccattatctaacgataaccttcttctctttatgttaaacattctcaagtcatgtcctcacaaacacccatgtttaacaccttaaatcatctcacttattcttacatcatgcttctagtttctccagggccttttaaaagtgttaataacatgagatccaattagttattatctctcaaatgtcaacttctcctaataattctcaagagcatgttaactttttgtattacagtagaagcttacacttagactaaagtcaatctgtgattcctgaattttaactttgctttaaataaatgaagtgtagagtgaggtacatttcctttgggttggtcttgatacaggatgatattcagatcagaaatccccatgcttttggccacgtgtactgttgagtcaacaacatttttgttggtgccaagtcaatggcaggtgttatataggctacaaagagaagggattcaggaaccttcaagttgggtgagagggaaaggcattcactcatgcagcagtgagcgaataaaagaagggctagcccaggagtctagcatgtgacctttagagtataatgccttccattccaaagcctggcttttgcatttactagttgtatgaccttgaacaagctttttaaatacccaatatttccatttcttctttggtaaaataggaataagagtatcttcctcatagatttgatgattacacataaaataatgtatgtagagaggttaacaccacgcttttaagccttcagtagctgctatgtgtgcacgaatgcacgtgtgtatatactttgtgccaggtactctgctgggtacataaataactatgatgcaaggcagaatgaaagagagaaactgaagagcaagaataggacttgagaatgagccaaccatttcttgatatgtggggtgtgtgtgtgtgtgtgtgtgtgtgtgtttcttacctcagggccagaactaatttcagatgatgggaaattctgaccctataggtaaatgcaaaataaatttccttgttcaaggatgccgagagcaagaaaagtgccatccaagacatattacgtaaaaattaagtctcattctctgcattcctgtgcatgatttcctccttcccaaaacatgcaagcctgcctaggtaagatcaactctgagttataactcagtctatacagagattatcaccaagaaaaatcagcaagtataaaagatttttaataaattagaacctgtaaaactttatgagaagcaggtgtctgagtcccattttataaaccatgagcctaacagagttatatgaactactgtgaggttgttctgtctgtgagcaacgatgggaatgtaatcacatgccccacaaactggactatgataagcatccttttgttagggtaataccatttatacatttatttataattttatattcctccctttcatttcattctttgttgaaagcaaatgtattgcaactcattggcaggcaatttatttcagggcgaaaagtaatctaaatacaaaataataaaatatgtgaatgtgaaaaaaatcccaaagatataagcagatttattatacatagctggaaaatatctcgtatatgaagccattcataaagtgagttaacttctctgtgcagaagttctttgggaatatgcttgtacagagtaatttactttcagtgttagaaattacctggaaagaggtgaaaattactcattcaagtcaagaagtatttacatgccaccaaataactaaggtgaaataaaaccttataggagaaatagaagaacagaatgaaaaaaaagggaggggcagggtgagataaataaataaaaagctaaagaaaaagttaaaatccacccagtatttacacaatgattgaataataggacaacttttatcttgacttcatttaaatgttttcagtaggaaagcttgacaaaagtgacattcagtcattagtaatattgctaaaaaagtgaaattcagtcatcagtaatgactgaaagtggcattcagtcattagtaatatgtcattagtaatattgctgtataaactagaaattgttcttttgaatctttaaatggtgaaaacagtcaatagtgttttcttttttaaattgttgcttcttgatagaatcacagtttctcttttattgcatcatttaatctcaatgccaagttttgaaggtggtgccaaagttcactatctgtctgggtagcagatgaccaaaacgcccctccacagtaagggtgcgtgagtactctggttccagcgtatgctccacacatcccaccactgcagggcgcatccaggtgtgctgtcatggtcagtttgaatgcctttatcagtgactgtgccatgccacatatataaagatggaaagtcaagtccatgacctccaggaatacatattctgactttgcactgataacctcatttagtccacaaaacacagatatgacgtagttaatgttattattcctgtttcagaaacgaggaaactggctaaaatactttatgtgactttcagcagggtcacacacctaaaaagtgatggcactcgactcaaacattgcagtgatatatgtccacttggctaggttatatgtccacttggctaggttacagcctgcagttattcaatcaaacactaatctaggtattgacgtgaaggtattttgtaaatgttattaaaatccataatcacttgactttaaataaaggagattgtgctacataatctgggtggaaaggccttaaagcataactgaggcgtctctgaaaaagaataaattctgcctgtggacagcatcttcaaccttgcctgagagtttcaggatgcccttcctaatggtctcccctgcagatttcagatttacctagtcagccctcacaatcaaatcaggcttttgcttgcaagaagtctcttattatgtatctcctactggctctactttctggttgaactccgactgaggcaattactcctgtcctcttacgtggtaaagggttgtggttattctagtcagttcatcgggctctactcaagaaacacacagggtctggaagcaatataaaacttagcaccaactgggacttcctacaagctttctaacgaaaaacaattttaaaaattacaagacataaatatgtggatttttaataaagaccctcttagtcatctttacatacttaataggtgcttgacaaacgcctaacaagtgaatgaatgagggaatgaatgactaacttggtttggctggagtcctcttgtgctttatctctcagattcatcactgcaatgatcgggacgcacagcatagaaatatatacatatatatatttatttaattcctccaaactctatgagatgtcatgccagagattatcaattctgagatgcattcatttcctcattttaatatttctgaaatagagatgcattgtacaaaacatagaatatcataacttatttggcattggtttgcctttcttggtagttcataaaatgaaggtatactttatgattgacagcattttattttaattgaaatatagtattatcaccatgttcatttttcagatgagttcttcaggcacaaaggctaagtacctttcccaaggtcacaaaattagtaaatggcaagtcagggtttgaacccaggctgtctggcactaaagcaggagtttccgcaaattggcaccattaacattttggactagataactctttgttgtgggggctgtcccatgcagtgtagcatgtttaacaatatccctggtctctacccacgagatgccagtagcatccacccccaagttgtgacaactaaaaatgtttccagactctgccaaatgcctcctgggaggtcaaatctctcctaattgagaaccactattctagggtatgtttaatcactatgcaatatatatttttccctaaaaatggaaacacgcccagggtgacttctactgcagccagaagcaagttgggtccaccccagaaagcaggaatacttttccctgaagatggtccttttccccaatttcttccttgactcttactcttctcttactgccctctcctctttttcaactttgcacagttcttcaggcagtattctttccaactgcttgccaggtcccacatctgttcattttgttggcacttaatttgggactgctctggaggtgctgacagcattagtactcctgttcctccaactgctgaacaatcttaattgagctgtccctgtctccttggtgctgtcttgtaccagctccaccccatactccagaagacgggtgacaggcactatctacttgctccagctttgaccaaataaagaaaccaagaagagacttttcaaaagctagtagcacagtgaaactcaggaaactaatgaacatgatttgactgtaataggttcttattcaagaatacatctgttctcacgagcctgtaagttaagaggccatgtatgtggtggatgagtccatggcctctaaagccaaatggcctgggtttcaatcccagctctgcctgcttctcagtaactgtgtgagcttgagctactcaatttttctctgcctcagtttcctcctctgtcaagggggaaaatagcagctttatctaatgtagttggtgtgaggagtaagtttataatgcatttaagagggcctggcccacgtaaacaccagaagagtgtttgcaattattagtggctcaacttcaaaacaattgtggtgcacttttggcttaattcgataggctggatttgaatttttaggttcattttttaaaacggaatactcatgttgaaatactgaacctaaaactagcaaaaatatgtaagtcaattgcttacatatattcagaacaggatatcattttagatttagtttatacacacacatacatgcaaactagtaaattccagtgatggtaaaattattagtgttttaacaacaatcactcctgactatctgatatactatatgatggtacatattggttattataacatatagctatagatataaaacaatgatctcaaatcctgaagttctatctgaatcaacaaaattaaataataactaggatgttttaatattaatattaatatgcttgattagattttaatcctttgaaaattgagagaggcctatatgatatttgtggtgctacttgtggcctttctacctgatgtgtaacttccaggaaaaggacaatctgaaggggctcagtactgaagtaacctctgagcttttcctacacggcccctcctcacatttactacagcattctgtattagccaccaaaactgagcaaacctcattccgttagctagtctccaaagaaggtagcacctgttactaatccccctgctaatctccccagcacaccctggatcttcacttctgcccatcacatgagatgtgcagcctgggaggcttccctttgggtccctctagaattagaagtcattcccatttactataagccaggtgtgcatcatttcactgaaaactgtcaccaccatcctatgagccagatgctttcattatgtccattttacaaatggaaaaactgaggctgagagaaggtaaataaatttcccccaagtcagttagaaaatctgtgcaaataccctattgcctgtatctcaaccagccactgagattccttgtttacttctttgaaagtgtgctgcctgttgtccatacctcctaaggaagcaaaattgagttcactctcccattgcccattggagaatcaccaccccatagctttctatccaaagcattacaggagctttcatattctctgttgtgctgcttcaggcaggtggtattttcagtgtgttaattttttaaatcataagttaaatccattggttcgagggcaaaaagggttactctacagaggcagaagtgatgttaacagaccaaattatatatatgtacaggtcaccatgatcagtaaggaggagaaaagtcaatgaaacctattagttctgaaacaatagataagaagagagaattctacttcaaatcaagttaaccttacaatctcacagttttattgtcatatagttattaccataaatattcagaatattttgacttaacatacagatgtcttttcatttgctcaaaaccatgcttctgaaatgagattgactttgggagaggaagtactatttttatatcatggtgtattaaaacatagataaaaggccgggtgtggtggctcatgcctataatcccagtactttgggaggccgagacaggtggaatccttgagcccaggtgtttgagatcagcctggacaccaaggtgaaatcccacctatagaaaaaatacaaaaaatgagccaggtgtggtggtgcacagctgtagtcctaactacttcagaggctgaggtgggaggatcacctgagccagggaggttgacgctgcagtgagctatgatcatgccactgcactctagcctgggtgacaaagtgagaccttgtctcaaaaaatatatatatataaaataaaaaattattttggcttgtggcatggggaattagttccctgtaattcagcaagatgcatccaagagggctgttttctttaaaaaagacaacagagttagctggctagaaattatttggaaaatagattttttttttggacacagaaatgtatttcaaagacaataaatgaagattattttatttcatatattagtactcaatgtttgcccacatagttgaactaatttttgtcttcttgaccttaaatgtctggctagaccaagcactttttcatattttaacctatagtaatatttcatattttaacctgtagttttggtgatcaagagacactagagctcagaaacagatgtcttccaagctctgttgattcaccatatcagtctgaggactccagcatcctgaacctcagcttgcatccctgaaatggagtggtggtacaggttcattatcatcacaaagaaaggatgctagcctttaaggctacactttcttccatgttatttacaactcaaagggcctgtttcaagttccattttagctccctgtgtagtacactgccaagcacatgaattttcaatgaaaatgttggaatgaaatttcagcatttcttaacagagaagtaatcaccaagatacgagttaatgctttacggaggttatgtctggctccattctattacagaatgaatcaaggtgaaaaaaaaaacataaataatgaattgtgtcctatttgggtcatgtaggaagggaggttattggtagcaatcaacactgggtcagaaagacaaagccagaacctggagccagaagggcaggcagcaggtgtgaaattagagatgtgatgatggaaaaacttagaaacagcagacaaaagacacaaaaatctgaataagacaagtggtggggtgatttcatcatttaaggcaactcaagtgatcaagtctgagagctgtggtctgggactaagacaagagcagtctagagaaatttaaagagatgctgtgtcatcccctttgaaggaccaagtgcaaacttatatttgtccttaaacagagttctccaatcccagcctcacaaaaccggttcagctatagctactgaacggcatctgtgtgctggctttccatctctgctcttgagcacaaagaacaaagtttttcaaaaggaacttgcacagtccacttcataaatctcccttcagcttgctaccttccgcccacatctcagggttgtatgccagctagatctacagcagttatatttttaaaccagcaattatcctcattcctgctcactgacatgccatacagttaatctggtttaggtccaaggtaaaaaaagggaaaatatataaattcacataaacataattcacattggctcaaaattactcaaatggttttcaagcaactccaatctgaattacaggtcagtttcaaagtcaattttatatcaaacatgcatcaattacaaaatttttccaaaacaactgtaaaagaagtcaaagtccaagatcttaattaaaatatagtttactttagagaaggtaaagattatcatgggaaaactctatcacatcaagacaaatataatagcttgaattacatgtataaaattaacagactggaagggaaagctttatgacaagaagttccgagaagaacttagtgattctacatccaactttattcatctatatccaaatgttaacatataccttgatttttctctttgttaattaaatatgaatgcttaccccagctataataagaggaatctagtgaaagcaaatagcagacctaacataatccctttccctttagctatagtcaactcactctaagtgtttccaaggcaaggatatgtagattaggtaaattgattccttttttcctattatcagttgtcttcttcagttatcacaaaggttgaacattaagctaccaaatatataagacattgcctcaagaacaacttgggtaaaagatacccatgccacacagacaattataacatgattatcttgaattttttcttctattttaaatgctgccttgtaccatttataatagcaaaaattgctgtccaattaaaaagtgtttggaagagaagactccagtttaattatgaagggcatcattactataaagcaatgacagggtatgctcaggaatgaatccattatcacagaaggaccacttatgcgacaatgatgttttctcatctgcccccaatatctccatttcgtctagttcctcctacttatcctcaccacaaggtaaggtatctgaaagtgctgaacacaccgcctgatgtaaagcaggtatgcaatgatattcattcatttatttcaaatattcactcatcccatcatccctctggaaccaatccatttgctacccaggatagaatttaaggtactttaagtatctaatcgcaagtaagccttactgctgtccactctggtctgtgggccatgagtctgtatcctttaataaattcctgcttcacacagtaagaactgtgctttcctatcccaatctctgcctaatagcccaacctaaatgcgttccagcagccccagccccatgcctggcctccagtatttccaacactcaaggctcagcttatgcatcacagtccttcaacctgggtcttgtcaagatgtggctgtatcttcctaaaaatccctgcctagccaggagggtggcagcctgccaccaaataacctcactgtgaaaatctgcccaaatgccagtgttaatattgacaaaattggcctagactgatgctacttaagcatttttctgtattaatgatatatgcatgtactttgtatttcactgaatccagagaatttttatctgggtttagttagccttaaacagctacactaacttctctgtgtcttggttttctaacccgtgaaaggcaataatattaggatccaccacagaggttactgtgataatttttatatattagcaacttagagaactgtctggtagataacacatgcttatgtaaatgttattgtttgtatttgtgggggaaaaggaaagattaacaagaggaaagcatacacatttatttaacataagttttatgtgacatgagggcctttgaaaatgaaaacccaaagatacaagtagacttgtatttttttatgattaggtttgacgaagaatgaacagttgtgcagaagtatattgggggacaaaaaggtatgatctaatagtaataaacggggaaaacttagcaaggcctgtctgttcagattttctctgtgctccatgtcttcagagataaggaagttactttctgccaggtatggggggggcacctctcaaatgagggtctcatgacctgcctcagaggagaagtgtgagggaaagccagagagcaaccttcctatgtttgccattttctcaaatgccaaggtaccagatttgggggggtatcatgtactgaaccttgttatattattaatactattactattgacttcctctagtgagtaagctaccagatgcatgaagataaaaactgtctgtttcattcttaaaacccctcaaacctacatggtgatttgcacatctcaggctgtaagtgattgtcaaataaaattgaattactgagtactttaaaaagatatctggaaatatcatgataactatgatatagctgtagaaagtaagaccacagaaaccaaactgtcttcttaagaacagaaaatcactaaaagagccaggaatgcaagtcagtcataagcccatgctgctggttcatggacaatcttcatatgacaccattttcctggtgtgagaacagatgcatttattctgaccttacgtcatgcaaatttacttatccctgggcaaggacaggttacggggtagctttggcattgctcattcattcctgtatttatcaggtaaccctgcaccaggtcctgctttaggtgtcaggagactacagtaaatcaaacaaaccgcattggctcaaaaactgacatttgggagagctagacaaaacaaaatactagtttatattaaattatgataagtgtgaagcataatattgaggggctgctccatcagatcacctatcatgacagtatcagttcctggcacatttattggcacccctttctggaggcaatggactggaggtccccaccacttggtcaatgaagtgaaatgtatggatttgatgctgagaggggtttgacattgctattcttctatcaatcctggtgtaaaaaatatacactgtattccatagcccatctagggaagaatcctactaccaggcatggacagaaacttaagtggctcaagaagacccagcagctcaaaatgaggcagtacccctggatgggaaaggtatacctcctatccagccacaggtagagagacacccgcctataggtaaatggtcccaatcctgactccatcccaaatatcaccacaagataaacagagttaattacggtagggttaaatttcttttcgcagatagaagataggttacattagatgatgtgctctaaattcccagagattattttacaggaaaagaaaatttttacagctatcaacttcactttaaggttttcgagggcccttcaagattttatgtcctctcacaaatgccacaagcacaaataaatattgctctttaaaacaaattaatgtcaacctgagtataaatgagtcagacctatgagtctccaagcattatgtttcattaccctgccaaaaccaagcctttctagactagtcttaaggctctggttctgtgaataggcctgctgaagaaatatttcacctaataacatcaactgtcttaagattcactttggataaattgctttttcttatagcaactgaatgaaaaaaaaaactgaactaacaagagaaacacgaaaaaccacagaatcaatcaataatgcttccctgtccccaattattacattaaactgcattaagagcctggccagctattggtccatgcttcataatccttcatgtttcttccaaataatcacactcttcaaagtaagatattcctatataatcatgatgcttgatcaacttgccttatcaaatgacttgcaaaaaatatctatacctctgctctgggaaagcccctgtgagaaataacatattgaatagtttagattcaaatcactgccctgatttaagccctatggaaaaaataacactagagtaaataatattgagtgctacccacaaccccatatatcaaagactgtcaaggacatttagtattgaaggccattccagtactaagccccaggagatttacaagaggtcggggtgattaggtctccttaattagaatgtaaatttatttattgatttattgtatcagacagatcaattagtagctaccaatttttttaacatgttcattttctatttcaatgatagatatcaattaaatattaatcagaatctcccacctcacctgtagtttcaatgttctgagctcaagttaagcatgacagggacattctatgttccaattttattccatcctggcttcaaagttttggaaacagaatacctcacactacacgaataaaatttgcaacaaactgctaactgaggcaaaatagtattcatttgtgtgtaggtatatgtcacgcatgtaccctcaggccagctctgtaaccccacgaagacccaagtgatttctccttcatcccagagcaaagagggagaaagagctgcttagctgtgcacgttgaggaggtgatctggaaatctgcttgttcctctgaagactatgaaccattcgttcagagcttcctcaggcctccagctcctgagtctttctgctgttctgcagcacaaatgagcttccctcttgctgcattccttctctgtaggctttctgcttttatagtctgctaagtcagttactagtccatatcatttccagctttcaattttttgttgacatctattttcttctgtcatttctgcttcccttttgttcttgtgcatttataccttcgtcattgccttgctgtcacataaaacggtttcatgaaagagtagaggaaaatccatgtatttaatctgccctgcgtagccagaagcctctactatactatgtgataccactccactccaagctaaatctatctgagccaagatggctaagttccctggtgggacagactaatgtaaaacaaactgaatggcattgcttttcttctttcctgtttcttcattgccatggatcaggttacgtgcaaataataataataatcagcaatgctataaataaatcatattaaggcagggcttacagataaatcccaaagttcaaatgtaagtatcttgccaattgtttactaacttgtcaagatattaaaaatagaaaactaacactcaagacaacagaaatagttgagccatggtgccagggcataacccaagaactcggactagacagtacaagcatatcaaataaatatttagcttaggtatcagagcactgtcattaagagcacagggccaggaaccaggctgcctgggttcaaataccacctctgccactgacgagatgcataactttagacaagttacttaacctcgatgtgtctcagttactgtatctgaaaatgggagtgataataataagaaagcctcatatggtggtatgaggagtaaacaaattaaaacttgttaagtacttagaataccctctgacacatagtaactactacacaagtattgagaaaggtagttgaggaaatgaataagtgaaaataatatggattcttctggtcaagagagaaaaaaaagaccctaacctcaagccaccattttaaactagaacttaacctgtattacccttaaaaaaacgagggcaaaccaacacgtaaaaagaaaccaaaaaagcaagatcttcacttttgagcttccaggaaatcaggcctcaagatttataaacactgtgtcttaatgggaatttttcagctgcaccaggctttaccttaaatgcttgcctaggggaaaatccagtccacctgttagaggctggccctgcaagggtaagtgttgaaaccccaggttgcttggtgacatctgggcatccacgcctgtggtgctcccaacctaccctccacttggcaggtgtaggttgcgttttctggctcctctgagcagcctcattgcctgggagccaggctgtgctgcactctccctgcctgtcttaaggaagattcctgtgaagcccctaaatctgcactcatgctcatcctctccactattcctctttccttttctacccctatttcttaggtggaatctgcctgaaaagcccaaagcctgacctggagatcaaccaatcttctgggcatccattcagacaagggctagggttggcagcctgtgggctcaacgtcctacccatacactgagtccctgcttccctttaactccctggtactagtactgtctcctgtttgctaccagtataccataggacaggagtcaatcctaaccatctggacacacagatatctccaggatgctccccaaaagtttccttgacatcttgtctctttttcccctccccctaaatctacactattctggacatccattctgctcctgtctctccagcaaagccaccctcctcagaaccagctgctccctgcaacctccaatccctgggcagaggagacatatgctcttcatggggtgaggttggggtggcctggggagaactctcctgagatagtaaaagacagaaaaagccaaaggagactgatctcagggtatagccaccttgttaagtcttttttttatcaccatttttattaagaaatattttacacatataatatgaagatctatggagttgtaaaaaataataaaattatcacatgttcctacaagccagcttaagaaataggatacacaaataattaattaaaagatcctttcccaattgtatactcccctggctccctcgaagttgatcactgtccttgattagctcttattgagcccaacgtgaggaaaacagcatggcctctccagaaaatgtggtatgactattttctgattccagctattcatcctattttcctttacatcctgtccaccagaaaactcgtagtcaagtctccatcctaacagtttaacccttctaatatgcctgatttcttaccaccattcattctattaacccttatgtgcatgtatatccatgactgagttttcagtagaagagggaatcactcaaggaatcaaagccattcagaaatgctccctcaaagcctaaagcaaactcaggctactgaaaaatcaatgtccaaatgataaggtaggttgactctcatctggcacctactctaacccttgtctggtgcatctttaggatggcacaggctagaaaacataaagtacactttctatccattcttgaaactagagttctagatgtgacttagtttcctccaagcagtcattattgcataatacttgaattcaaaactgagttaagaggagatagaacaggtctcatgcagattgtttgggagtgagagagatgggcatgaacacagcggacactgtgcattcttgtagttagcgattctgaaaggagtttctagtctgtagagagtaagtaaatgatgcgatcctaaggtcagaagttgggacactggctccccaatttctcaccttccaggatgcggcagggggagacattcccttaatggtcagttctatatggtgttatttcaggattcattcctggaaaccaagtcaagaaccttctcctccagttcttccagtgattttgtaaacatttaactcctcatatcaaatcatctcctgctgaaaataaccaaagggtttactgctgttggcaatttaattctggctaatatgtggaatagagagagagaagttgacagagtaaagcttgataataaaaaaacaccagctcatgcttttatcaagaaaataaggcataaccagatatctatttttaaataaaattgcttacttttaattttatataatgcttttactgttattaataactttttttagcatggccatgttatcaattatcaataataataaaacataattatttgcagaacattgatgttgtatcaagcactacataagtattttatacacttagctcatttaagctttacaagtctatgagatacgtatttgtatccattctataggtgagaaaattagagttaagagaggttaattagtaattttccaaggtcaaacagctgataggtggtagagataaaatccgaaacctgtcagcctccaaaactcacctcttaaactctttattatactatctctgtaagcttatgaaattcacggcatgaagaatgaaaaaggagtctgccttgataatatccgactcttctttaagtatcctcttgtgtgatatccttggcccctcttacaaattcttcagattgttttgtgtagactctatttaacaatcttcaggaaatactttggaaacactaatggaattgaactgttaaaatataaaatctcattgcccctagcaagaattctctctaaaattagagccaggttttgcttataatttaacagtcttttccccatcatttgcatagtgatagagcttttatagttttaattctgaatttatattccagaaatgtcaatctggaggctgtaatcctactaacttttctgcatgcctatttttctgaatatgtataaatgtttattttctttaagcagcacatttcagaggtaaaatgtatttggaagactttaatctatgcacaagccatcattaaacttccctggcatatctttctcttacagttaaccaaattacatttgggtatttgaagcaaatgaggatataacaaagtgatttgggtggacaaaatgtatgaactgcatcctgtttatgcaacatttttacaattgtataagctgacagctatgcttagagaaacagtggaagaaacaaaatcgttcactcagtggtttataagaaaaagaaaaaaatgtcaattttcaagataaaagtgtggagtcaagaatgagttttattttttttaaaaattctcattacaaagtccttgaaagaatgtcaagaacaacacagtttatgactattgggaaagtggatctcctcttagaattggaagcctctatcctttctttctgcgtctctctatataaagatgtttctgtcagcttgggtgcattttcatcaaatttggagtatgcatttgggaagctaggactaaacatagagcagtgacatatgttgaatcaacttgggcagggagagctggggggactccgagtggctgatgctgaaacactgcagggaggcctctaaccagagaaaacatacagaggtcttcattgagggctccagaatcaatcattccaatggcagatactctaaactgctcttctgattttggactgagttgcttctcacctggaccacacaacataactcagatgcactgattttcaaccccagctgcatgttagaatcacttggagaacttttaaagactgtgggtgcccaggtcccagccagactagatcaactggaacctgggggtgggaggtgggaggaggacaggacaagtggccccaagacacctgcatttttaaaagctccccaggtgagtctaaggtatagccagagttgaaaaccactggttcagggtgaatagcagctggaatttatataatcatggttaatgattctcttatgagtaacatggaggaggccagctagtattatacaaagttaaaatgacattttgcttaggaataattggaaatattttttgtcaagtgtttatgtctgtgtctgacaacacacttacaagaaagcttagacactgaaaagttagaagcctatgggagctcagaagtgagatttgggttgtgcaccgtggctcatgcctataatcccatgttggagaggcagacatgggaggattgcctgagcccaggagtttgagaccaccctgggcaacaaagtgagacctgatttctaaattaaataataataataaatttttaacataataaaagaagtgggatttgctctcagcagagccaagctcagctatatccaagtcctctgcttatacaaagatatcctctagacataggtgttataatttctacttcctaagatgaactttttttctattcagcttttttctattcaagatctcattcctgtgtagctctggtttgaaaccaatagaaacttgagttttaaaatcctgatgtgaggtttctatcattttggctagcactgttcatttagagtaacttaacttcagtagaggaggataaattaggatctcccaaaaaactttaaagggacctgctctttttttaagagtttttcctaagcatcctgtatggatttccttcattctctttaagactgaatggaattttactgtatatatgatctagtgtcttccctcatacctcacacaggacagacaatcaatatttgttgacttaacaaattaaatatttaactattctcccaaatgatgggtaggggcatctggttgacaataacagacatattcaaggaaataatttgtagcaaagctgagtagaagattcctctgagctgacaagcatttcccatgtctcccatgcaatcagctttgaattccaacttcagggacagaaggcacttgcttgttgccttataggcatcatgactggcacaaataaatctcttccttgcagcattttagacaagtgtgatcaaccaatcaatgaaagctacaggcacctcgaaagagccttttctttccaatgtcatttcctccagcagctgctccttccttttgggaacccccgagtttatatataagcagggttcagaaggaagacaacgttttactcgatgcctctctcattcaagtaaatgggcactggcccatgctctgttctgctgctggaaccaactggagagtccaaagcatcacatttttcccagagggaaaactgatggaaaaaaaagatggaacttcaatgttcaatcaatcccaaccaatcaagaagctttcaatgctgcttcatttacataaaagtagagctaacagccaaaaagcagtctttaattcaggtatcaatgtataattctcaaatatatggctcaatctcaaatatatggctcaacctgccagagttatagaaatgacctggtagaaaatgtattcctatccttgaaggagctaaaagtagacatttctgtgtgtgtgtgtgtgtgtgtgtgtgtgtgtgtgtgtgtgtgtgtgtgtgtgcatgcgcatgagtgtgtgtgagagagagatgagagagacagattcatcactatcaagataagagctgaagaatttctttaaacagagcccccactgttaagtggactccaaaggataaaggtttctctcactgacttgaacctcattattaattatatttattattagttcctttccttgaatatgtctgttatcatcagccagatgcccctacccatcagtggggagaatagttaaatatttaatttgttaagtcaacaaatattgattgtctgtcatatgtgaggcactagggaagacagtggttcacacatacaataaagttccattcagtctttaaagagaatgaaggaaattgatacaggatgcttaggaaaaactcttaaaaaaaagaaaagatgtccaatgtgtatagtatcttgcatttgtgttttaaaaagtatttacatttatatttatatgttcacataattacatcgaaatcttttggtgctatacacaagaaaccactgacaaactctgaagactagggtgtctctagggtggaagggagacaatttgcatcataatgtttgccattttttacatgtacatttgttattttaataaaaaataaaatgtctaagtcatgagcagtattttctagagtagaaagattatttacactgagaatgaagagtgatttcaaagaatcatgaattttcctaattttccccaattttaaatcttaaaactatgaattttccaataaaattagtattcataaaataattaggggtttggcaaatatgcaagttgtgtctgtcagcatagtccactcaccccgatttccatgtatgcatatgtgcacactccatgtcccgtttttaatccctttctcttcctgcccaccccaacccagccccacacaatctcaaacagtctatgctgtaggacacaggtatacctgtgatcatacattacagtttgtaaacagaatattatgctttatattcacaatggatggataggatatattctatttaccctacacacgtctgtacatacacacacacacacacaattatacacacacgcatattgcctggtattcatgtatttttcaactgtgtgtcctgaaacgatttttctttttcagtgagtcattcattggcctgtgaaataaaatgttttcctactcagagatttgtaatgccaatgttcaaacctacatagtgtactgtcatgagaattaaataaactgaagcatgtgacagttcctcacccagatcctagcacaaagcagtcactcaataaatgtttgtggaatataagtgcattaaatatgtgttgaatgtgaacgcaaacctatgaatattttagcaaataacctctaacagatagaaccatgttagaaaactaccagttggatggccaaataggaacagctccggtctgcagctcccagcaagaccaaggcagaaggtgggtgattcctgcatttccagctgaggtacctggcttatctcaccgggactggttagacagcgggtgcagcccatagtgggccagcagaagcagggtggggcatcgcctcacctgggaaagtgcaaggagtcagggaactccctcctctagccaagggaagctgctagggactgtgctgtgagggactgtgctctccagcccagatgctatgcttttcccatggcttttgcaacggcagaccaggagattcctggtctcatgtgcctacaccaccaggaccctggatttcaagcacaaaactatgtggtcatttgggcagacaccaagctagctgcaggagtttttttgttttgttttgttttgttttgtaccccagtggcgcctagaacaccagcaagacagaaccgttcactcccctggaaagggggttgaagctagggagccaagtgttctcactcagtgggttccacttccatgaagcccagcaagctaagaaccagtggcttgaaattctcactgccagcacagcaatctgaagttgacctgggacgattgagcttggtgtggggaggtgcatctgccattactgagacctgagtaggtggttaaacccctcacagtgttaactctgactgtgtggaactcaccgcagtgtggcaaaggtcctggggctggactgcctctctaaatcctactcacttggcaggacatctctgaaagaaaggcggcagcctcagtcaggggcttatagataaaactcccatctccctgggacagagcacttgggggtaggggcagttgtgggtgcggcttttagtggacttaatgttcctgcctgccggctctgaagagagcagtggatttaccagcacagccctagagctctgctaagggacagactgcctcctcaagtgggtccctgacacccatgcctcctgactgggagatacctcccagcaggggtcaacagacacctcatacaggaaagctccagctggtatcagacaggtgtccctctgggacaaagcttccagaggaagaagcaggcagcaatctttgcttttctgcagcctccgctggtgatacccaggcaaacagggtctggagtggacctccagcaaactccagcagacctgcagaagagagtcctgttagaactaacaaacagaaagcaataacatcaacatccacaaaaaggacacccacagaaaaaccccatccaaaggccatcagcatcaaagatcaaaggtatataaatccacgaagatgaggaaaaaccagtgcaaaaatgctgaaaattccaaaaaccagaatacctcatctcctccaaatgattgcaattcctctccaacaagggcacacaactggatggagaatgagtttgacgaattaacagaagtaggcttcagaaggtgggtaataacaagctccactgagctaaaggagcatgttctaacccaatgcaaggaagctaagaaccttgataaaaggttacaggaactgctaactagaataaccagtttagggaagaacataaatgacctgatggagctgaaaaacacagcacgagaacttcatgaagcatacacaatatcaatggctgaattgatcaagcggaagaaaggatatcagagattgaatatcaacttaatgaaatgaagagtgaagacaagattagagaaaaaagaatgaaaaggaacaaataaagcctccaagaaatatgggactatgtgaaaagaccaaagctatgattgtacctgaaagtgacagggagaatggaaccaagttggaaaacacactttaggatgttatccaggagaatttccccaacctagcaagacagccaaacattcaacttcaggaaatacagagaacaccactaagatactccttaagaagagtaaccccaagaaacataaccatcagattctccaaggttgaaacaaaggaaaaaatgttaagggcagccagacagaaaggtcaggttacttacaaagggatgcccatctaactaacagtggatctctcagaagaaaccctacaacccagaagagagtgggggccaatattcaacattcttaaagaaaagaattttcaacccagaattttatatccagccaaaaactaagcttcataagcaaaggagaaataaaatcctttacagacaagcaaatgctaagggattttatcaccaccagcctgcctcacaagagctcctgaaggaagcactaaatatggaaaggaaaaactggtaccagccactgcaaaaacataccaaattataaagaccaatgacactatgaagaaactgcatcaactaatgtgcaaaatgatcagctagcatcatgatgacaggatcaaattcacacacaacaatattaaccttaaatgtaaatgggctaaataccccaattaagagacacagactggcaaattggataaagagtcaagacccattggtgtgctgtattcaggagacccatctcatgtgcaaagacacatataggctcaaaataaagggatggaggaatatttaccaagcaaatggaaagcaaaaaaaaaaagcaggggttgcaatcctagtctctgataaaacagactttaaaccaacaaggatcaaaaaagacaaaaaagggcattacataatggtaaagggatcaatgcaacaagaagagctaactatcctaaatatatatgcacctaatacaggagctcccagattcataaagcaagttcttagagacctacaaagagacttagactcccacacaataatagtgggagactttaacaccccactgtcaatatcagacagatcgatgagacagaaaattaacaaggatattcaggacttgaactcagctctggaccaagcagacctaatagacatctacaaaactctccaccacaaatcaacagaatatacattcttcttagcaccacatagcaattatcctaaaatcgaccatatatttggaagtaaaacactcctcagcaaatgcaaaagaatggaaaacataacagtctctcagacaacagtgcaatcaaattagaactcaggattaagaaactcactcaaaaccacacaactacatggaaatggaacaaacctgctcctgaataactactgagtaaataacgaaattaaggcagaaataaataagttctttgaaaccaatgagaaccaagacacaacgtatcagaatctctggcacacggctaaagcaatgtttagaggaaaatttatagcactaaatgcccacaacagaaagtgggaaagatttaatatcacaattaaaagaactagagaagcaagagcaaacaaattcaaaagctagcagaagacaaaaataactaagatcagagcagaactgaaggagacacagacatgaaaaactcttccaaaaatcaaggaatccaggagctgtttttttgaaaagattaacaaaatagaccactagccagactaataaagaagagagaagaatcaaatagacacaataaaaaatgataaaggggatatcaccactgatcccacagaaatacaaactaccattagagaatactataaacacctctacacaaatcaactagaaaaatctagaagaaatggataaattcctggacacatacaccctcccaggactaaaacaggaggaagtccctgaatagaccaataacaagttctgaaattgaggcagtaattaatagactaccaaccaaaaagaagtccaggaccagatgaattcacagccaaattccaccagaggtacaaagaggagctggtattattccttctgaaactattccaaacaatagaaaaagagggactcctccctaactcattttataaggccagcatcatcctgataccaaaacctggcagagacacaacaaaaaatgaaaatttcaggccaatatttctgatgaacattgatgcaaaaatcctcaataaaatactggcaaactgaaaccagcagcatatcaaaaagcttatccaggccaggcgtggtggctcacgcctgtaatcccagcaccttggaaggccaaggcaggcggatcacgaggtcaggagatcgagaccatcctggctaacacagtgaaacctcatctctactaaaaatacaaaataataataataatagccaggcatggtggtacacacctgtagtcccagctacttgggaggctgaggcaggagaatcacttgaacctgggaggcggaggctgtagtgagccgagatcatgccactgcagtccagcctgggcaacagagcaagactctgtctcaaaaaaaaaaaaaaaaaaaaaaaaaaaagcttatccaccactatcaagttggcttcatccctgggatggaaggcttgttcaacatatgaaaatcaataaacgtaatccatcacataaacagaaccaatgacaataaaccacatgattatctcaatagacgcagaaaaggccttcagtaaaattcaacatcccttcatgctaaaagcactcaacaaactaggtattgatggaatgtatctcaaaataataagagttatttatgacaaagccatagccgatatcatactgactgggtaaaagctggaagcattccctttgaaaactggcacaagacaaggatgccctctctcaccactccttttcaacatagtattggaaggtctggtcagggcaatcaagcaagagaaagaaagaaagtgtattcaaataggaagacagaaggtcaaattgtctctgtttgcagatgacatgattgtatatttagaaaactgcattgtctcagcccaaaaactccttaagctgataagccacttcagcaaagtctcaggaaacaacatcaatgtgcaaaaatcataagcaatcctatacaccaatagcagacaaacagagagccaaatcatgagtgaactcccattcacaattgctacaaagaaaataaaatacctaggaatacaacttacaaacgaagtgaaggacctcttcaaggagaactacaaaccactgttcaaggaaataagagagcacacaaacaaatggaaaaacattccatgctcatggataggaagaatcaatatcgtgaaaatggccatactgcccaaagtaatttatagattcaatgctattcccattaagctaacattgactttctccacagaaccaggaaaaaatactttaaatttcatatggaaccaaaagagagcccatatagccaagacaatccaaaggaaaatgaacaaacctgaaggcatcacactacctgacttcaaactatactacaaggctacagtaaccaaaacagatacatagaccaatggaacagaacggaggtctcacaaataacaccacacacctacaaccatctgatctttgagaaacctgacaaaaacaagctatggggaaaggattccctatttaataaatggtgctgggcaaactggctagtcatatgcagaaaactgaaactggaccccttcattacaccttatacaaaaattaactcaagatggattaaagactaaaatgtaaaacctaaaacaataaaaaccctagaagaaaacctaggcaataccattcaggacataggcatgggcaaagacttcatgactaaaacaacgaaagcaatggcaacagaagccaaaattgacaaataggatctaattaaactaaagagcttctgcacagcaaaagaaactatcatcagagtgaacagacaacctacagaatgggagaaaatttttgcaatctatccatctgacaaagatctaatatccagaatctacaaggaacttaaacaaatttacaagaaaaaagaaaacgaccccatcaaaaagtgggtgaaggatatgagcagacgtttctcaaaagaagacatttatgtggccaaaaaacatgaaaaaagctcaccatcagtggtcattagagaaatgaaaattaaaaccacaatgagataccatctcataccagttagaatggtgatcattaaaaagtcagcaaacaacagatgcgggtgaggatgtggagaaataggaatgcttttatactgttggtgggaatgtaaattagttcaaccagtgtggaagacagtgtggcaattcctcaaggatctagaatcagaaataccatttgatccagcaatcccattactgggtatatgcccaaaggattataagtcattctaccataaagacacatgcgcacatatgtttactgcagtgctattcacaatagcaaagacttggaaccaacctaaatgcccatcagtgatagactagataaagaaaatgtggcacatatacaccatggaatactatgcagccataaagaagaatgagttcatgttctttgcaaggacgtggatgaaactggaaaccatctttctcagcaaactaacacaggaacagaaaaccaaacaccacatgttcccactcataagtgggagttgaataatgagaatgaacgggcacagggaagggaacatcacacactgggatctgtcaggggttaaggggcaagcagagggaaagcattaggacaaatacctaatgcatacagggcttaaaacctagatgatgggttgatgggtgcagcaagccaccatggtacatgtatacctatgtaacaaacctgcatgttctgcacatgtaacccagaacttaaagtttaatttaaaaaaaaagaaaactactagatgtttttctctttaattagagaaaacaataaatatatcaatatgtcaatatagtattttcaattcattgcaacatgaccagggtaaacacctaagtatttatttctggaagtgatgctacagtaaacattgaaattgaagaataatgtctaatacaattttccagaatagaggagccttttgtttttcaacaccaattattgtattggaagaaactttctatttaaataacaggtttttacaccaaccacagctaatagggcccattgcataaacaagtgcattgtgtaacagttttaggatgacacttgatatacagtctggatactcgtccctgcccagctctcatgttgaattgtaatcctcagtattggaggtggggactggtgggaggtgtttgggtcatgggggcagataccttatgaatgacttgggccaaccccattggtgatagtgagctctcactctaagctcatgagagatctgttggtttaaaagtgtgtggcacctccccactgccttgctcatgcttctgccatgggacatgcaagctcccacttcttctgccttgaatgaaagttttctgaggcttcaccagaagctatgtttcccacacaacctgcagaaccatgagccaattaaacctcttttctttataaattacccagtctcaggtttttctttatagcaatgtgagaatggcctaatacacttaagaaaataataccctaaaaatgaatttcactttttcaaggcatttgaacatgcgctattccacttcatgcttttccacaattatatgaattcaagatggtatgaaaagaaacagggaattgtcttgaatagttaagtgcttcatccaagtctctgccaagagacttcatatccttgtaccttctggtggccacgattgctaagacaccatcaaatgaatgtaggactcctctcacttaagaatagcttttcagagtaagaaaagagatgctatatttgatgtacatctctgctctgataagtacactgattcaaaaaatgattcagttttttaaaatgtgcccactagaattcaaactttatgacatagctaaggttcttagccttagtttattaatgacatttttgttcataagtgtaattcagacaataacacgatattaatgtaatccttgtcattcattccagtggcaactttctctgtgtaacatgctttgcactgaaactagtttatgctcctggcacagcatctttaaagtagaaaatttattacataaacatttccagcaaattcaattagcaccaccaatacaaaaaaaaaaaaaatcacactagcttacgtgagttgatactggtctgatttatacggcaaaactgtctgactcttgcctcataatctaaaatttcatagtaggaacactgtaaagttatctgatttgtggtacgtttgaggaagggtaatctcctcttatgccatcattctcctaaatgcccagaaattttactcaaggtcagttggagcactgaatgctctgtgagtcactgatgctcaggcttgcctgccgttcttttataggatctctgtgggccagaaaatcatgaaaatatagttctacaaaaaaataaattcctccaacactgaattctctttccaatattacaatttcatggggagaaaatggaagaaaatgagtgattatgttccaatttcattttaaaactacagtgatagtgctacattgttaaactaatctcatttctagaacatacatgtaaggacaaaaatatcaagttaacaaattgtttttatcttataaccttccattatgacaaaagcaacaaaaactcgaatgccttctctagtaagagaacatggatagtgctagcgttgatacaggggtctatccattctaaaatgtcaagacacagaaatagtgaagagaaggcagcctgagtagatgaaaacgataaaaactttctcatattgacacaacattcctttgttcaactgaaatcagtgcttttgaaaacccacttggctgacagccctgagcctggggcattctccatttcctttacaaattaagtcagttatttcaactctgccccttgccccaggcctgcacttcccttttacagaacctccctcctattgacttcagggcacaagttcatccttctctaactcttgcttttcacactaaagttcatacacctgaaaggaaaacctataaataagctctcaggacaaataaaaatccatcaatgcgaaggtcagggagagctttcaatgatacaagcgcacattcattcaattattcattcattcatttgccagcacccactctgcagcaggcccaatgctaggcctggagacacgcataataataaaataagactcagtcccttgtctcagaggtgtttacaatccggtcagcgtaactaacataaattaaagttaggatgcatgtgctaagagtagtataaataaaatgctatgggggaccgaagaatgacccttgcactaaagtctctttgcctctgggtcctcttatttatcagggtctaacgtcaccaagcagcagctgaaaggaaaggaagacaatgctagcagtagcagcagcctcagcagtgctcctgacactgagtgggaactggggaggggtggagctcacaagacttattacccagcttcttacattttgataaagggaggaaacttccctccacttcccacaggggaacataggagggaatgccgtctgtaagatattcacagcaacctctatcaaagtttcagccatttcccacttttactccaaaagtgaccatattctgcaatccaaaaattgggacatgggatctgacaaataagtttttttccaatcaaaaagtatatttttataaagatctaaagacggaatcacacatggctatatactcaacatttgttgagtcattattaagcagggaatggtccataaaacctatcatgtgggttgggatagacagtaacatgtatccatgtctttgcttctaccacacccaaactgcattgatgctgatgctacaaaaagccaatggaaaggattgttttttcccaattcctgagaaaacaaactcaacaatatgcccttacaacacacacctgtggtattctaagctcattccttccagggagaagaaaaaaaaaaaaaactctaaaaagttataacacctcatttatcccaaacttacaggcatcagacacacatctatgagcaagcatgcgagcaggacgtgccaatagcatcccccactaaggacatgtactaaaccttatgaacatgatgatatcaaacaggacatttagaacttcaaggatcctattaattcttattttgcatacaagtgtagtcactttgcttttctggtttaatgactcatcacagattagaaaccaggaattttaaaggggtagagagaagaagtattgaagttaggcatacaaagagttctggcacactataaatatttgttctataaaccaaaaaggatctgaggcatgtctcaatcagtttagaggtttattttgccaaggttaagagccagcccacgacagagcctcaggaggtcctgagaatatgtgcacaaggtgtggttgagttacagcttgcttttatacattttagggagacagaagttacaggtaaagacatacgtcaacacacgtaagctatcactggtttgcccatctccaaatgggcaggttgggaggggtgcttccaggtcataggtaaattcaaagatttattgactggcaattgtagaaacagttgaagtcagcctgagttaagataggggggattgtggaagccaaggttcttgttatgtagacaaagcctccctgtagaaggcttcagagagaatagatggtgactgtctcttatcagaccttaaaagacatcagactctggaaaaaaactagtaatggaaggagagtctctatagaacgcaaattcccccgacaagaaacagctttgcaggaccatttcaaaatatgtcaaagaaatatattgtggggtaaaatacttttatttctttcaggacctgctgtgttatgtggtactataccagagtcaggttggaatttggtatcttactgctacaaaaagtctgttttgtcagtcataagagttctgttttcatgttaatgctgatcaattgtgtctaaactccaaagagaggagagtataaacaggcatgtcctggtgctcccttcccatcatggctggaactagttcttcaggtttctttgggatccctttggccaagaggaagatccattcttttggctaggggtgcctagaattttattttgggtttacagttccacgaatgaaggaatgagaaaacaagtcacatcaaatagacttgcaataaaaagacaatgttttaaagtctgttcaaaagacatccaggactattcattgcctttaaaattttctatacagatcagttatgcttactactatttgccaattctaatgatactcaccattaagaaactcacattttattcagcatattatgctgaaggagccataaacatgaaaactacacattcaaggtttttcactacaaaatagtttccacaaaaagcttctgaagtggcgagcttcagtttttgtaaaatttgttaacatgggcactccattcccaaacaatgcaagataaatagagtgtttactttgccttgaaaagtacattatttatagaggtatgttatactcatttaaaataaacccacttaagatgaagagaaagcccttgtctttaatcatccagactgagatctatactgattgagctttctgtataattactcacatgtacatttcacactgtgtagatacaatctagggcctactgtaggaattgcaagcaatttggggattttgcaataatgtcattttggaagatggatgcatttctgattcaacaatggttattaatctagtagcctaggaaaaaattaacaggcatctaaaaatttctaaaattggtttgcaaaggtctagaatatgcagtttcccaaaccattcacatatttgggtaattccaaataatttatctgcagcttttatcttgtaaagtatctcaaaagagagcaggcaaaccagataagctggaaggggtggggggctgggagggaggagtcagaccaaattgtttaaagtcatattcaatattattggtagaaagttctttttacctgatatttactcttagaatactttccttttaatcatgtatgcaatactataagtatctacctctattcaaaaacgataaaaacattgatcaaagtttactgtgaaactttacaaaaatttatgttgaatcatctttattcataatagctcctagcacataaaactattcaataattcacaaatttttgttgaatgaataactgaatgacacacagctcctagcacataaaactattcaataattcacaaatttttgttgaatgaataactgaatgacacatagctcctagcacataaaactactcaataattcacaaatttttgttgaatgaataactgacacttgcatgtctcaatgacacaatggcaaattgtatctttttaaccttaattatagctacagtgcactaatgacacagcatcattgtcaagagctcagcaccctcaccacctccagcaccaaagcacttttagctcccagtggcatgttctaggtattgcacaggacaattcagaagcataatccaagtccttcaggaagtccaaatttaaaaagctcaagcgctggcaaaaattttaatttaaaattattactctagcagtgcgaggacaaaactaggtggttggtctaatttgtattttttcaagtcagttgctatggttttaaaaattcatgtagaagaatctctctgttaaacacacagagagagagacagaagaagaagaaggaggaggaggaggagaaggaggagaaagaggaggagcagcaaaatcatttacatggttattcagttcagtgtaactgacttgggtgagcaatgaatagaccacaccgctgagtcttcaaggttgtatccaaatgctctcatttgacaagagttaaaaggaacacacgagtttaagataaaccctgcctttgtttttaatatttagtgatatgattttggttgaagtctgggagggtcactatatcatcagaaaacacagaagggatattgacaagcatcttatgagacaaataagaagttaatctgagagttgagaaaaatataaatgaaaacaaaggatttttaaggagaagaaattgataagagatgaggaatataaataaatattttaaaagcagcttcagaacatccaagaacagttctcactttacttgactcatcaagacctgcttaggaaagaagatagtcactaactcttctttaccaaaaagaccaatgaattatgatagaaactgatcaagataatacaaagaaaggaagggataaaactcaagagagcatgtaacaaaggtcaatacacaatgaagtcatctagaaagataaagaatattggcaactcccaaaaagcagtacagtcagggccaactgagagtcttagaaaaaggaggcatgtttggctgcccacagcctggagaaagagtgagtatccaccatcacagagagatgtgcagtgcagaatctgggaaactaggaaatctccccaaactagagcaaaatgtcagattaatggcatccagctctggctgcacattagaatcaccgggggaagtttttagaaatcgcaaatgctcaagccccacctggagagactgattcattttatttaggttggatctgggtttagaaactattttaaagtagtaattagcagagacagaatttgaactcatatctatctgactccaaatcccaggcttttcctattgtgccacaatgtctccttctagccctacccaaccaagcggtattggaggggtggagttgcctgtgctgtagtttctcctctgacatactctcaggtgctcaggcttagctgtctgagatgaaagcagaggcagtagctgtaaaagcagatggtcaagacttgagtctgttttctccctgaatgattttccagtttttctctgcaaggtagagttcatgattcatcctcttttaggctagaagaaaactacagaagcctgaagtccaaagaatggagccccagaatacaaacaggccagtgttgctggcccagggaagggaggaagatgcacagggcaggagaagtaaaagggacaaaggagtctggggacctcccagaacccatagggatgggtgccctgaggcatttagaagagtgattatgaggcagagcttccctgaagggcaacaagccccctgtgtctgaacagaaacccatctatgtgcagattggttcatcattggtcctcatgcactgataattaattctggtaaggaataatgaatggcaagatgaatgaaacccagccacgctctgtgagcaggtggatccagtttcactctgagcatcctgactgggcctcctccctccacacacacagacccttcaagtcattgccatccttgccccatctccaggtccctttgctctgcccacctcagcccttacaagaacagaccaagtgtacaccttccaactcacacctccacacacaaataggaaatctatcccagttaagcctcatttctgcacatgacagattaaaataaacaaaacaccagtcttctaagtggaaacatggatatttcaaaacaccaagcagctagctacctaagctgttcacccaaagcacaaggtaaatatcccacagtaaagcaaaagtgatctgagctctggctaccctaaagctttggaaacaaggtcctaacaaacacactctttgagcaaaacaccaaagacaataatggtgagcaagcagagatggcagcaagagggaagcccctgactggagggacctgttcaccaacactgtcttcaccctagggtcaagtccatcagccctagaaccagctaatcttcctgcagaagatataagcacaaactccaatggtgcgagaccctcagaagttgtactagatgatgacagaaatctttttgccaaagccacagaagtttctgtggacagtctagaaagggaacctaccctctccttgtaaccttctcctgcaatcaccctatcacccctactacagttattgctgccagaattgaatcaaagagtgtgtctgctcctgtgttctttgacagatccaggaagggggtacagaataatgtttgtactctaaattaatatggcaataacaagtatttagttatcctcccaacatccacttcccgttattcctaattgagtcctttcagacattttaggaactgaacattggactaaaggagtcagggaatctggcttctaattttatctctactgttctttaatccagtggcctgggcacatcccttaccttcttaagacaaagagtttgtcacttgtgatattatgacaagaatgtgagcccctcagggttcctatgctggtcaaacaagataacgtatgaaagtcttttgaaaactgttaatcctaacaaagtggcattttgagtcactttatttgattcaattatacaataaatactgtagggatatttttaagcaaaagatgcacaaaacaaaggataatacttctaacaacaccataaatgagatatcattctgtgaaacaggtacctactcacatgaatatatggaggaagggaggaaatctttctttctgggttttcttttttcattcgcctctaaagacagtcactaaatgtcttcctaagagcagcatggggaaacctcaggaataagggctgtgtgctccataagttccggagtttgtggaggccttgtttcaaagctcagggcagaaatcaaaagctgtatgaagtaccctgttttgtgtccatctgaatcatgaattcttctaaagctctccaggaaaagtatcagtttcagggtcactagctcccatattatgcccctaaactgccttttatcatcactcagctacttcatgctgcccttagttaccccaaagaagggtggattttaaaacttaggaccctcagtaatctatgaacctggcaggatgttgttgaagctatttgaattcccagaagaaatataccctagagatgacatgaatttaaactaatccaaggagtattaaaatggttgtgtgctgccctttgtctcacaggttataactgatgcagtacaagcaagtgggaatgaaaaacatgagaaaaatctaagacagtaactgcagaccattcttcttggaagttattcatttcaagaagcaggtgataattactttctagagacagtaataagaaaatatagtcttgtctggattaaatctatcttgatggttgattgctatccttgggacacgttccaatgagaaaagcaaacaaaatctgtattgtcttcatataaatttcatccagttgagccgattcacatatatgaaaacaagatttcttcattcactgagggaaatatttttctgctgataagtcaaagaatcttgtttctatcactaagatcctttttaaaaatagtaccacatgggctactagagaagcaggtgtcaataacacttaaaaatatagatggctatgactagtggagtgtgaatggctatagctgctgaggtgagcccagcccaggaccccaggagaaaggaaccctggaaattttctatgctggatagcatgcaaattccccatactaggggtacctcctggttaggccatcccccaaaaagaccttgtcctttggcagtttggaaacctttgagcttcagggtacaggttgcatgtgtaagagctataaatgcagaacaagtgccacaggattagttcatgtaaggtgataattaagagccatatgcctatcacataggaccaacttcaaaaggatatgtgaggtatagcccagggaggctcagaacacatgagattggcccttgtcctgcagtcactgctcaccagacacctgggggccactagcctggcatggccactccagagaattggttctactggaagttttgttcaataaaaagatatcctgattgttgatccatattctatttttttatgcaataatcaagcagatttattttgtattgcccatggtagtatacctagaggttttagagtcctcattttcttccaacctaacattgttactcaaagattaaggtggaagcaagttcaccaacagtagtcctataaatatcaatgaccaggagtataaacccatgaacaatgactaattcttcaaaggtatctaattcattctccccaaatttctgtatactaagggatcttcttttcagaggcatgtgagtgaggatctcctgccaaggaatctaaaactctgcattttattggattcagatcagaatttcagatactgggatcaaaaccaattagaggaatttgttgaatccccaccaatgaaaaaacggccagttcagaactatggcagaatctttaaaatataatttcttaaacatattaatagctagatgttaaaaaataaagaatctcatcaggcaaaaccaagtaagacaaaattcatatttgttgacgcccctagtcttcacaagtgacttcaatcccagtctaactgtaggcaagcagagctctccagcagaagctgccaacaccattctcagtacaattatctgccctcctggcccaagaccaacagcctcccctcgactaaaatgaactccttttcaccttgtcattaaaacttcacttagcccaaaccccacttttcaaatccccagcacaagacacaccctcgaccacacatgagttctttcagggtcgtcctcatcctactatgctctgtctggttttcctcccggttacattcgcactagagcactcacctgggccaagcttaataaatatactgcatgtggttgaacacccgcaatcctgagcacagaacagacattgtccaccattctggactcttcctcaaagagcctggatgatacttcaaggtccttctcccccaggctgccattcaaggcagctctcctgagggtgggcaggtgagagggatgatcggttagtaattggcccaccagtggatcttgcacctcacctaaccaacaactgccattctccacccttctctggcacaaaatgcaattcaacataagcctgatgggtgttctgttcccacatgggttaaatacaggccgacagccttataactttttgctcttacaaactgaaagaattttaaaacaccatatatccccttaaatttatgaagttgaaatctatattcttactttgcataagtttgaatagttttaagaacatatatttccagcatcttgtaaacatcgacaactaaaaattacatttttagtttaaccagtgaagtctaaataccacaatgtatccatgatatctaaaaaccgtaatgattaaataatcaccatcatctacttaaaaaatacaggaacaagctccttaacgtttttgaagaaacttttaattttagaataattttagatttacagaaaaattgcaaagaaaatacagagttctttcccctgctcttttcctgttgtttttcttccttgtctggttttaactagggattttatataatctcattttactttatcattttgattatacatctttttaaaaattttcgtggtgtccctagaatgtagtccatctaaattgaaatctatttcaaataacattccactcacatcacatgtgctccaaggaccttataacagagtattcccaataagctgctctcatcccataggacattgctgtcattcatttcacttattcatatgctatgataacccaaaacattgatatcattattgctttaaaaagttcttttgaatcaattaaaaaataagaaaaaaagattttattttatactcatttatttcttctctgatgttctttcttctttaaatagatctgagtctccaacctgtatcattgttctcctggcttttaacatctcttgaagaaaaagtcttctagaggtggattccctcagtttttctttgtctgaagaagcctttatttctccttcatttatgaaggataatttcactaaataaaaattctagatgggtaatttctttttctttcaatacttcaagtatttcattctactcttctcactcacatggcttctgaggagaagtctgatgtaattcttatccatgttcctctaagaggaagattgaatatgataagcctaaatggtggtggattttttggcatttatcctacttggcactctctgagcttcccagatctatagtttcatatatgtcattagttttaaaacgttctcagctattattacttcaaatatttcttctactccattctctttcctctccttcagaattccaatattgcttatgttacatcttttgaaatagtctcacagttctagggtgttttgttccatttttttccattctttttctttttcctttgcatttcagtttgagaagattctattgacccattttaagtttactgattctttccttggatagttgatttcactttgaactccaaagacattcttcatttctcttactgtattctttatttctagcatctccttttgattctttctcatttccatctctctgcttacattgcccatctattattgcatgttgtctactttttccactagagctcttcatatatcaatcatagttatttttttactccctatctgaagatcccaacatctgtgtaatatttgagtttgggtctaatgattgttttgtttctttatgttggggaaaagctgagttttgggaaaaaagctgaggcagggcttgcatctctgacataatgtaaaagagtcttggaacatgtcgggggtccagggtctgaaacccctcatggtctttggaacaacaagctctgtgccaaagggtggaaggctgccctgccacaccataatctaagcccagggcataaaacccctcgtggcttggatggaatccagggctcagggcataaaacccctcatggcctctggaatgtgtctagacttactggctccttgcttctagcattcccaggcttataaaatgattgtatcttaaactagaagaacatgttccccattatctcaagtaccagaatatgttccatatgcttcaaaggaaatgctaaaccatcacagctatagcttatgcacttgatgcaccacttcctttcaaccctcatatcctcaccacctgcttctttgttggattaccaataaatagcatgggctcccagagctcggagccttcacaacctccacactagtgttggccccctggtcccactttatgcactcttaaacttgtcttttctcattcttttgactccaccggactttgtcgcccccatggcctggtgttgggtccagctgccccaacatctctaaagtgtgtgtgtgatttttttccttgctatttggcatgtcctatcattttctgttgaaggcagaacacactgtatcaggcaggaggaactgaagtaaacgagccttcattgtgtgtgaggatttatattaatctggctaggagttgagctatataattgttgcgtagttacagatgccagaggtctgaaaattcctctggtggtctttgtttttgtctcacttcttgactttgggcttccttaagtatctcctcttcagacatggcctgtgtctttcagcaatttcagccataatccactgttataataatggagccgtgttggtgtgataataaggtgtgcaggaggtggagtattctatattctcccaatcaaagaatggattgggtacaaagactgaatatgagacccatctgtagcttggagagtaatccactttactcaaagtctactgacttaaatgttaatctcatctaaaaataccttcatggcaacatctaaataatgtttgaccaaatgtctgggtactctagcctagacaagtttacaaataaaattaaacatcatagcatgtgttcatgttatatttgactgagtcatgatttatctctataaaattaatacttaaaagccagcaggcctttggggccaagttaggctgggtcctttttatttccaaaggctggctatgcccttccaaagtcagccaggccttccctataggagcagcccccatcattcactgctgctaagcaaagaaccccaagtattattttacagagtagcatcgtgaacttcatgtatgtacagtcaccaacagcaaatattttcatagttcctgtaccaaagaagcttttacaaagttaattcagcagtcactcaaaatattgattgaacatctattggactcaagtcattgtaggagacacaaggtcataaatacctcaaggagcttaaaactagttgcagaaacaagatacagtgcatcagttcaacatagatttttaaggagaggagttcaagttctgatactaggcagatttacctagaaaagtccactctagctatattactaaagaaaatgcagtaagatgtgcaggtgatggtggtaaaatctgacagatggcaagagatttacctctatttttaggattacaacaaatttcgaaagactaaacccaattctaaccaggtcagccatgaggtcctgttagatggtgctggttattccccttgtacagcacctacaacactgctagtcctcgatcacagcttctctctggaacttttaagcaactctgctcaccaagcaacaacttgacatcttttcaaacactcacattataaaaatgcattccaatttctctagagatggccattacagtgactcatgtgagagttcttgccttagcaatagagttatgtgtactttggacttgactaacagaaactctcttatgtggtaaacatagatatcttagctggttggcaaccaggaaaaggagctgtaaatgataaattgcacaggtatatagttcagcttccctttaacacaacagtttacacattggctgaagaaagtattatctgaagcttaaaaaacagttattttatagttgaaattcattttattgatctcatttggaaatgattcacatttttatactcacttagcttcatgaaggttacgaatcagtagagtaccaagagaaggtattcaaaatgaccactttttgatatcttctccgggcccttttcttcctcccaactttcttaattgtccctgtcattgatgtttccatcttacttatctttttgcggagatgggagttgttttctagggggaaagatttttggtgttggttttgggtgttttttgttccatcatcctaatacctagtactctttccccattatcaagatgacagatgttttgttaaagtgatagattatagtttaacagtaatcacaaatctggcaaccaagatccacaacaagccccaaactggggcacagcaaaaagaaagctttctaaaggcagtgaactaaaagttgtgcagtttgctggaaagtccctaatcttacagtaatcctaactttatataacagactgatttaccactcctgagcatattagaaatggcaaactttaggggtgggggtgaggctgacacactgtctccagtgagagattatattggccaggggaaaatctacaatgagcaaacaaattttctccacaaatgatgcctggggtcttttagactgatgaaaatatgcaacacttttttagtccaatatgttatctagttggggctaaaaaaacatgactaccagctgggcacagtgtctcatgcctgtaatcccaacactttgggaggccaaggtgggcagatcacctgaggtcaggagttcaagatcagcctggctaacatggtgaaacctcatttctactaaaaatgcaaaaaattagccagacatggtggcacacacctgtaatcccagctgctcgggaggctgaggcaggagaatcacttgaacctgggaggtgaaggttgcagtgagccaagatcctgccattgcactccagtttgggcaacaagagtgaaactccgtctcacaaaaaaataaataaataaaaaaataaatgactgccacttttcctctgttcttagatatatgttttcactttttatttctaaaattgaagtcaatcagaattgatgtgttcctttcatgtaatagtgtgtcttaaggaaatcagtaatggtagattttataatcaaatagaagaaatgaagtaattaatatgcagaaatagattgaattagattcactgtcctctggattgagagcttttgaatgttttacataaaatttcacccaaaataaagcatttttatttatgagtttgacttaatagggtaatctggaaaattagttatgtagagtgctacattccctgaagatgcctgataaatgaactagatacttaggcagatggagctcccgaaaaaagaagccaactgttatcataaacagttgctagtttactttcttcgtagattttctttttttctgattagctggttttcttattttcctgcttcttcaaagacctgctacagtgaagtttagagactttagatacttgcaagtataatttttcagctttcacagaagaagtacatatccttctattcttacttaataaagaaaagttataggcttgagcagacagtgtttttggccatttctcttgctttattttggtaacagttaattagcatagtcctcaagctatccctccacaagttaaaaaattaaaactcccatttgaatatttatcaaaactctttacgtggcaggcactgtgctcagtgggcactgtgtgtaaagataaagaagatgcaagctctactcccaatgggcttatgagggtgttgacatgaaaagcagaagtcttaggaaggactcaccaacaagcaatataatcctgtgaaacacactcttacagcccaccccaatatcaaccaaatgagcacacctccaaagaccatctcgatttcaataaactgaagcatacatactctcatggcaccccaatttccaagacatcctcaaaagtatgcagagtaggacagaactaaaatagttactgccacaacgctaaccacttatcagatacaggatctctgacagaggttttcagtatgtgtgagtgtgagtttaagtgtatgttctttcttgactccacttcctttctcttagtcattatatgtctgaaggagagttacagcaataaacttgaatccactcattaatttaagtaaaccgttcacaatctttatttttttagtagtaaaaaatgacttgtgacatctcacaagaccaatccacagtgaacattacccagagaatttagcataaattctacatataaaatcaaactaagattttagcttgaaattctattagagaaggttaaattttcaatgtcttcattcactaggtacagcatatcctgagtgtacgatatgtttgtctgctggggctgccatgataaaataccatagactgggtggcttaaacaacagaactcaattttctcatagttctggaggcggaaagtccaacatcaaggcatttctgggttgagtttctcctgatgcctctcttcttggcttgtagatggccaccttctcacggtgtcctcaaatggccttttctcttgcgtgtacatatccattcccagtgtctcttcctcttcttaaaaagacaccagtcccattcgatgaggatcctactctcatgacctcatttaaccttaattacttatttaaaggccttatcttcaaacatagtcacattgggtgttagggcttcaacatgtaaattttgtccatatttttcatttcagtctctaatacacggtaacctccaggagtttatctattattcctttaaaatgagaatcatctgacccagaaattatctacaaatagactcaaagaagagtaggttccaaacctatcacggcatgcctggtagttcagccactggctcctggcttcggccctcagtgaagctgtcttcccctcatcaaggggatttcaaactatctacagtttgctgtcagcagttcttggtagctaagtaggtctgagcaatcaggcaaaagagagatggtgaagctagttcttgatttgcaacagtacaattgccaggttaacttcctggctgtgggcatcccttagtggtctgggatttctccctcagagacaaccacacattgtcaggggcttcctttatccggcattctctaatgcatcttctccatggcgaagactttttgttttacttaacataacactgatcccaaagacagctacatctcccctcagtcttgaaagtcacccctgggtaaacccggtgtgtgggagaactgggtttccccacttcctgaacacagaacctcagcctctgtccctctgcctgctggaaaggttggtgtggatttcaactcttacacccccttccctcttccacaaggagataccagcttacagttccacttgccccaccactgttatgaattccataacaaatttagaatattaaaataaaagctacaaatttgtgagtgcttactatgtaccaggaactgtactaagtactttccttacattacttcataaatcctctcaatatatgcctgtaattacagaggggaaaattgagactcagtaatgttaacattactcccccagtatcatacatgtagtaagtggcagggttaatattctaatttccaatgctcaagttttatctaatagtctattcccacttgcctaagtataaattccctacccttcttaaggtagaagaatgtacctatattagagaactaccttttttttttccttttgacagagtcttgctctgttatttgggctggcatgtagtggcgtaatctcgactcactgcaacctctgtctcctgggttcaagcaattctccttcctcagcctcccaagaagctaggattacaggcataagctaccatgcccagctaatttttgtatttttagtagagacaggatttcaccatgttgcccaggctggtctcgaactcctggcctcaagcaattcaccagcctcggcctcccaaagtactggtattacaggcgtgagccactgcacccagtgagagttacccatttttagcaaaacgttactctatgaggaggaagagaggttttggatgctgcttagtcctgaattgtgcacactaggtattcccagtgggctacagccatgcctctctctgcttcaagttccacatctggaaaatggactaatgatacctgcttgtcacattgcaagggccacaaaaatagaaatgagatgccgcatgtgaatggagcttgaggaaaatcaatacaaatataaataaacttatttatatgagtcatacttcaaaaaagaataccatcatactgtccttcatggtatcacccttaacaagacaatgccaaccatctaagttccctcgccccatcagactcctttaatacactacatctagtattgtttaattttctacatgcatccatctagaaacatggatgagcctgtaagtaccttgatttgggagattatgttcattattcttaatatttcctgtagtgccctgcatgcttttccacagtaggtgttcaaaaaatatcatgttgttgggttgataataattatatatggccagagagctggcattaactggtagccatttaaaataagagattaaagttatttcataattaactgaatgtttactaattgtatctttaaccaaactacttgaacgtgtttgggcctacaaggacacaggtttgcgacggtgctgattcaattagtaaccccagcaggttctacccataacttggcttaatggactccaccatttatatcctactcatgctccactctgaaggcagaggggaaatcttgggagagaggagggaggctttggattcttcaatctcaaagtaaatacaaaatatttgcctccctatgtaatttgtcatggacaaatcctcagcaaaattactgaaattacagggagccacaagtagaaattgataactgtcagggtgcttgacagctctatacaggaacaccttcgctaggaagactctgcttgctggatttcctctataaaatcagattttgttttcacttcaaatcattctctccagagaaaatatctattcatcccaccaggcactttgacacaggagccccattctgagagaaatgcatgttgacagcagaattgcagtagaagctgtctcataggatcccatcaaagaggctcttggcaagcctctgttttgagatccacattaactcaaggcctgttccatggtctcttacgtgaaaaagtaaaccagaaaaagaaaggaaaaaagacaataagtcttgtcctgagttagtaaaatattaagaaaaaaaaaccagtatgagtagagctggagaaatagagtatcttggttccttgatccataatattttgataggaataatttaaaccgtgatgattggaaactttgccatttgaaattaagcaccactctgctcctttcaccacatatatcctccaattcaatcttctgctgtaagtaagcaaaactcatgaatatgaggtccataaggctaaaaagatcctatttgtgtagccaagtggctaatgatctaccaaaggttcatgctccctcttccatagtggggacttgttgctgggaattggctgcccaaatgggggctacattcccaacccctttgcattgaggtgagggcatgggactaattcttgagtggaagtgatgtgtgtcacttcgggaccaagaaccttatctctctcttccatcccattccccggcagaaggcaggggcttcggaggctgtagcagaaggcagtgccacaaaacagaaagagcctgagtacccaaatcaccagctggaaggccacccaccaggaacatgagagcaagaagtaaacatcaataatgctaagccactggtgtctggtgtttgctaaggtagcttgcattaccctagctaacccaatttgctttcatggtttcctttccattttacagcttttaattttgatgtgctttttaatggatctattcctctataactaacaattaattatctgatctattcctggattttatgtactgtgaagattgccaaggatctgtccctctggcttactggaatagttatctatctattcttttctccacttatctgtaacagcttggtttatcacacaaaaccaccataggttggtgcaaaagtgattgcggtttttgccattactcttcatgcagaatagcagtagaggctgtctcatatgatgccaccaaaaaggtttttgctattaaaagtaatgacaaaaaccgcaatcatttttcaccaacctaatactatttgatggaagtgattagaatagagttgtagtgtagtacacagatgtaagtttgaatgttgattctgggtaactggacaagttacttgctttcgtcaaggctcggttttctcatttgtaaaaggacaataacattttacctctgctttgatgtttcactctctagtctcaaaatgtgaataaataacttttcgctcagtcccaaacaattttatatatgtctctctctttgtactttgaatcaccgccccaacagacctggcaataattccagtactacagatattattttgcatagaagataagcagttcatccagaagcagccacagtgtgatcggatgtagggctgtttatcttgacaatcctccctgcccccgcttggattacattatgcacaattcaatgtggcttctggtttgtcacgtatgattaatcacactgatatctactatgcccatttcattaaatccttcccactgaagcaggatgcccatatatacccaaagtgtgttttcctctgccttattctggcagatagggaaataaggttaaggttttaccttcattggtaaagttaccctcaaatcaaaacaaaatgctgaaaccatcagttaaatatgagctaatcttataaagaacttaaaaagtttagtcttcaggaggcaatttccagagagtaggttcaataataggaatttccttgtgcccaaaatggggtggggcagtataaagtatactgattaattgtcttaaaatttaaaaattccaactcctagtaactagttgcagcactccaggttgaacatttaactcatggaagtacctagagaatattgccaggtccagatagcatcctacccaactatctcatttgaaacgtaaaaaaattgagggtccgggaaattaaatgatttgctcaggtcactgaaggaatatactgatttaccatgtggctcccacaagagtcccgcctgccagtgctacgtcactctggtatccaaagttcactgtctaagctgctcttctcttctgtctgcactgtcttccttcagaggcaacacagcttatgcttaagagtgttagggacatgaagctctgatttgagctgaatgacctggaggttttcggtgaccctctctgaagttccatgtcctcacaagtaaaatgggattaacaacagcacctgagtcaaagggcgatggtgaggaccagcagagcttctgtcctggcacttcatgtggcctcagcaagggtctactttttctccccgcttttttttttgagacagagtcgcccaggctggagtgcagtggtgcgatctcggctcactgcaacttccgcctcccaggttcaagtgattctcctgcctcagcctcccaagtagctgggactacaggcgtgcaccaccacgcccagctaattttcgtatttttagtagagatggggtttcaccatgttggccaggatggtcttgatctcttgacctcgtgatctgcctgccagggcctcccaaagtgctgggattacaggtgtgagccactgcacccagcccctttttctccctttatggcatccaggcagacagtctgtaacagtggggcaagctccttctgactcatctatttctttgatcattattgttcgttttgtttttttttttaatgctacaactcagatatatctggaagcattcctaagcaaacaggcagacgagccctgttcacagtaagaaaaaagccttctttagataggttacacagaagcaaatttcaggacagcctgaaattatccatgtctcctgcagccaccaagggcaacaacaaaaacaaaaaaaaaaccagaatgagtcaatcagcaaaaactcaaattaaaatctagctcacttgttttccaaaaataaaatactcaacacaaactaaaattcctaacttttaccacaactgtaagtctttcaaagtattcatagacatagaattgaacacaaattggttaaaatcatgggcagagaaacaggaggaccaatttatatttgtacaggtctcagctacctgtttataaattgggatgcttccgtatgcagaagagatttttcatcttgagtatataaatattcttcctaataaggctgcctcatttctctacaaaaagactataatctaaacatatgcaaacaccaggggtgaaattgactgacaatgagcaataaaaataggaaaattcattaattactctttttaaagaggtaaaaataattgctctgtattaaaaccactgtggtattcaaacagaaatttaaaaatacatatgatttcctccagtcttacatttcatactagatagccaagtcaattaaactgatataaatgtaaagaaggtttatgcaaccccacgttgacatttcaagcataagaataatgcatcagttttccactggttcctcctactgtgggcattagccagcttgtagctatcaggcacaaatataaaccctttcgctgtaaccctggcatcacccaattccctcattcaacagtttccatgtagtccttgaaaacagctgcagatgagaccccagtagagtctggattatctatcacctgtagaggatggaacaaacctcctcaccctcactgatgccttgggttcttacagtcaaaatacacagcaagggacaataggaagtgactcagcatttgaaaactgtgtcatcactggcaaacttagtttgcttctctgtaggatataacaagataattctttcttttttttatatatcaacagtgtcattttttaaaaatgggaaacactgggccatattagcacagtttttgtgcagcattgcatacactggtgttctcttcctgagtagcttagcagaaatgcattttctcagcaatttctttccagatgtggcgttggtattgctgggtggaatggggtcgggagggtgttaaaagacaagcaggtagaaaatatcatctgttgtgaagccactaagtagcaaccaggatctgatttgctttatattttttaacaagttaccatccaaaggctaaatgaccctgaaaatcaactgggttttattcaaaacacagtttccagccacaaatctccagtatgacacatatggaatgttgaatgtaccagtgagcagttggttttccactcgctaggagttctaaaccttaaatatactgaagtgattaaatgaaatgcttcttctggcttaaaaattattttacagctaacattacataaaaaatgttttttcatccaaacatctgcagagtaaattacctttcattcatgctagtgccaagttaagtgacacagacagaaaggtttgacctcagtttccgcttccaagcatgtgccgttttccagggctcgtcaattgaccctaatgagcctccaaccaacacccataatggtcttctttaaagattacaatcatatttagacatgtttctgcctttataaacacttgcttcaagcacagaggtgcatctgacattatgtggtcaaaatattcctaagcaactctctgtaaactgattatttttgtaaattgagcaattcaaattgcagttgagagtactctatttacagacactctatgactaattcttttgcaaagctgccttttgcaatctgaatatccagccttgatttatctgtcttgtaatttccaatcttcacatatcaagcatacctaaaaactgcctaccacagtgcctgtcgaacagtagtcattcaataaatgttctggtttaatgatcttgctgcagtttcaggaaatctgcaaaataatttattatatatcatagtgcacccagacacaattcaaaaaactaggtgctatatacacatttattactttggaatgatttaggcatattagatgactttccaaggaattttggaattctagagaagtctctggattggttaatcagcaaagaaatcttcccctggatccccctcatatcctggagctctgaaaggatactctgaagtgtatactatacagataattgtaaggaatacatttccagaccttgacttctatacgtagattttctcagaactttctacagctttctactttctagagctgaggcttcctgacacttcttcctatcacccctttccccagtacaaaaatctcaggagtgatgaatgaaaaccaacagaaaataagagtccccaaagcctaatcaaagagccataatcatcatctccctccattttattatgagatgtattgctagttttatgatttatatgtaataattgtttacaaaaaaatataattcattcacataattttggtcaatttgttttttgttttttgttttgttgtttgtttgtttgtttgtttgttttttgagacacagtctcactctgttgcccaggctggaatgcagtggctcaatctcggctcactgcagcctctgcctctcaggttcaagtgattctcctgcctcagcccccaccaagtagctaggattataagtgtgcacaactacgcccagctaatttttgtagtttttagtagagaaaaggcttcactatgatggccaggctggtcttaaactcctggcctcaagtgatccaccctcttcgggctcccaaagtgctggaattacaggcgtgagccactgcatcagtcctaattttggtcaattggatgctaacaataattataaagataatccaatccagaagaaaagaaattaatactaagactatggtgacaggaaattgatagagtttgattaatattcatattgtttgaggatatcatgatagggtgatcaataagagattttcaaacatagactagaatgaaaataaagtttccaattgtttaaagaactctgtccctattatgcttcttaaggaggagaataggtgccaaatcaaataaaatattccattgcatacactttaaggaatgatgtaaaagttccattttaaattatcaatatgtagaatgcactagaaacaatgtaattttcgacttgctaattttttttttttgagacagagtctcactctgtcacccaggctggagtgcaatggcatgatcttggctcactgcaacctctgcctcccgggttcaagcaatgctcctgcctcagcctcctatatagctgggattacaagcgcccaccatcacgcacagctattttttttttgtattgttagtagagacaaaccccatctttgccatgttggccagcctggtcttgaatccttgacctcaggtgatccacccaccttgacctcccaaagtgctgggatgacaggtgtgagccaccgcgcccggcctcaacttgctaaaattaaaattgtgactttacaatgaagaaaactgaagcgcactattttaacccagtgatcaaagtgaaaagcccaacaacgggacaactgacatcctgtgcctccctgtgtgttagacagagaaagacacaacatcatttctgtgatgttcctgccaaagatgcagagtctgaatttaatcatgaggcaatttctgacaaaccaaagttgagggatattctacaaaataactagtcttgacccttcaaattaccaaggtcatgaaagcaaagaaaggtgaaaaggagaagggaggatactgtgtataaagacaagtggtggaattttaatacaaactgtaaagtagataacagtattttatcattgtacagtgattatgttaagaaatgcatattgaaatatttaagagtaagagagtactgcttatctcaaatggttcaggaaaaaatagataatgatgaagcaaaactggtaaaatatgaacgattaataaatctgggtgaagagtgtataggagttcttttttctactcttgcaattcttcatgagtttgcaatgatttcaaaataaaaagtaagtaaaataaataaaatctaaatgtctaataagatatgggagtgactacataattttccaaaatctaacaggtgtatcagtcaaaatgatgcaaattctggattgtttctcttattctctccaggatctttgtcagtcatgcagtttctactctcctgagtgcctcctgttcatgcatttcccagcagcaagatctgtgtgttcaatttcatcatctcctctctcaatttggcctaacaaattgacacgttctgtctgccaccctctaaagaaatagtaaagaaagtgtcactttctgtttgataagcatgaactgctttgcctggagaagcaatgaattaattaagtttaaagatgaatgagctacaattaatctagcttagtttatattgtcagcatatggagaaaaaagaaaaatcttccagtagaaaacaaacaaaatgtatctactattaaatcactcgtacatgtatatgtatatgtatatatatatatatatacacacacacaggctattatacattatatacagtatgcacacatatatttacacacatatatacatatacaagattgagttcagagtatattgataaagttattctgaatatatctggtaaaatatataaagtataattgaaatttctctttaaaaggaatgaagtgagtctaaatgcatatttcatatttattttatatgtagtatcagagtgtgtgagatacactctctcatttattcctactctgttcctctgaggaaaagaggaaatgatcccatttgacagataagaacactggggcaacatgagacacaggtaaggagacgggttgattagactgagaaattagcctgcccagttgcctgtctatagttccatactggatcatgctgggatctgctagaattttccccttcccccacacacttagatgtctacaaacatacatacgtatgtataacattccatactatacattgtgttacatgaacatacatacataaatatataaacacatatcatttcacccaaactaaggcaaaaaccaacaccaataaaaatatctccagaaaccattttctttatgtccttatcaatgagaggagttaatggattgaacagaggaaagttgttattagcaaaaataaatcctgactcagattgctgagatgatccttaagccagagagttcaaatttccagcctcaagacaaaacttatagctagtgatctctgtaaaatctagagtaaatggcaaaagaaaactgatggtatactgttatctatctataatgtccagagtttcataactaaaaataaaactctggcttctaaatattcaagaaacttccagtatcttttctccaatagtacaaaaatgaagaaatactttgttcccactgatctcttgggcctctttctgaaagcaaaccagtaccaatgagagaaacccagagagcatttcaaagtattgctactgttaagacctctttaccttagaagcacctaagtgctaacatcttccaaaacaagttcactatgactgttcagtgccagccctggagtctgcacagaaaagtgagtcctttagtgctacttgcaacagttaaaaaccagtttggtatatgtcagaccatcaggacagaaaacagagtctgcaatgaacatgcttatggcccacactttccagtcaaagagaagtgagtcatttctgcttcaactgctatccctacaggcctagaaaaatggaaggactgggcaggaggggtcagagaaaggatagaagaagcatagaattggaactaaaactgtgtagccttaaagtgctctggcctgaaaatctagagaaggcttcagcaggagaaagcaggagaggacatggttattttcagtaagtcatagaagggaagatggctaacagaaatgaaatggacacagaacatcaccaaagtagcatgaaggtatcagatcccctgagataggtcttagccaaataattccactcctgcacattagagtttgacatctaaggcccctccatcttttttccagtcaagacctacacaaatgggtgagggcttgctacatgagaagtaagcaggaacaatacgagaaccaagacaagctacaagcaggacatgaacacatcaaaaggcttctgaaaagacacgtctacctagcctgtgaccaggtcaactccctcattaagtttagcccctttaaaaaatatatcttgtttatggtgcctttggtttctcccttttccttctaattaaaagcaatttttgttaacttcttaatacaaaagcaatgctttagaaaaattagaaaatacacatttttttaaaagccagatggtcaacataaacatcattaataaaaataaaagaactgcctatatttattgaccaattatcatatgccaggcactctactaagtattttacatatattatcttattcaatcctcacagtaagtcttatttaaaaaaaaggtgggaaattcattgtacgatgtttaacaccaaacgttatgctgaaacactagattattttgctcagcaaatatctgcttgtttgtttatatacttaaacatttatttagggatgaaatgattttcatcttaaaaaatgaagtcttcccactcagaagcatggactatttcccagtttattcagtctttatgtcccacagtaaaggactacaatgttcttcatataacttctgtccatatcttgctgagttactcttagaactatatttgtgatgcaattatgactggtattctttttctcccaatcatattattgcttgtatatttattctgaatttcctgtaatttttgagagtaatctgttacattttagaagaaaaccaaaaaagattttcttataaggattaaaagttgagggtagagggaggaacaactagaagtgaatttgaattggtttccttgcaagagacagaaataaacacagagtgcagtaaacatcaatcagcacctacttattaactcagtctggcattgaattaggctagagagggttatgaaagaattttataaccactgaccttgacctgaaagagttttacaaaatggttgggaggctgggagtcaatgtatgaaaatctgttagcacttatggagttagtaaatactaaatcatgaagcatgactttatctgtgttaggtgttaagaaaaaagtggggtggaggcaaggtggccaaataggaacagctgggagctatctacagctcccagtgtgagcgataaagaagacgggtgatttctgcatttccaactgaggtagcgggttcatctcactggggagtgccagaaagtggggcaagacagtgggtgcagcgcaccgtgcgtgagccaaagcacggcaaagcatcacctcacccgggaagtgcaagtggtcaaggaattccctttcctagtcaaagaaagggatgacagatggcacctggaaaatggggtcactcccaccctaatactgcgcttttccaatgggcttaacaaacggcacaccaggagattataccccacacctggcttggagggtcctatgcccacggagcctcgctcactgctagcacagcaatctgagatcaaactgcaaggcagcagtgaggctgggggaggggcgcctgccattgctgaggcttgagtaggtaaacaaagcagctgggaagctcaaactgggtggagaccaccacagctcaaggaggcctgcctgcctctgtaggctccacctttgagggcagggcacagacaaacaaaaggcagaagtaacctctgcagacttgaatgtccctgtctgtcagctttgaagagagtagtggttctcccagcacgcagctggagatctgagaacgggcagactgcctcctcaagtggttccctgacccccgagtagcctaactgggaggcaaccccccaataggggtggactgacacctcaaacggccaggtactcctctgagacaaaacttctagaggaacgatcaggcagcagcatttacagttcaccaatatatgctgttccgcagccaccgttgctgatacccaggcaaacagggtctggagtggacctccggcaaactccaacagacctacagctgagggtcctgactgttagaaggaaaactaacaaacagaaaggacatccacaccaaaaacccatctgtacatcaccatcatcaaagaccaaaggtagataaaaccacaaagatggggaaaaaaacagagcagaaaaactggaaactctaaaaatcagagtgcctctcctcctccaaaggaacgcagctcctcaccagcaacggaacaatgctggacggagaatgactttgacgagttgagagaagaaggcttcagaagatcaaactactccgagctaaaggaggaagttcgaaccaatggcaaagaagttaaaaaccttgaaaaaaaattagatgaatggctaactagaataaccaatgcagagaagtccttaaaggacctgatggagctgaaaactatggcacgagaactatgtgacgaacgcacaagcctcagtagccgatgcgatcaactggaagaaagggtatcagtgatggaagacgaaatgaatgaaatgtagtgagaagagaagtttagagaaaaaagaacaaaaagaaacaaacaaagcctccaagaaatatgggactatgtgaaaagaccaaatctacatctgattggtgtacctgaaagtgactgggagaatggaaccaagttaggaaacactctgcaggatattatccaggagaacttccccaatctagcaaggcaggccaacatccaaattcaggaaatacagagaaggccacaaagatactcctcgagaagagcaattccaagacacataattgtcagattcaccaaagatgaaatgaaagaaaaaatgttaagggcagccagagagaaaggtcgggttacccacaaagggaagcccatcagactaacagctgatctcttggcataaactctacaagccagaagagagtgggggcaaatatgcaacattcttaaagaaaataatttccaacccagaatttcatatccagccaaactaagcttcataagtgaaggagaaataaaatactttacagacaagcaaatgctgagagatttggtcaccaccaggcctgccctaaaagagctcctgaaggaagcactaaacatggaaaggaacgaccagtaccagccactgcaaaaacatgccaaattgtaaagatcatcaaggctaggaagaaactgcatcaactaacgagcaaaatgaccagctaacatcataatgacaggatcaaattcacacgtaagaatactaaccttaaatgtaaatgggctaaatattccaattaaaaggcacagactggcaaactggataaagagtcaagacccatcagtgtgctgtattcaggaaacccatctcacgtgcagagacacacataggctcaaaataaagggatggaggaagatctaccaagcaaatggaaaacaaaaaaaggcaagggttgcaatcctagtctcagataaaacagactttaaaccaacaaagatcaaaagagacaaagaaggccattacataatggtaaagggatcaattcaacaagaagaactaactatcctaaatatatatgcacccaacacaggagcacccagattcataaagcaagtccttagtgacctacaaagagacttagactcccacacaataataatgggagactttaacaccccactgtcaacattagacagatcaatgagacagaacattaacaaggatacccaggaattgaactcagctctgcaccaagcagacctaatagacatctacagaactctctaccctaaatcaacagagtatacattcttttcagcatcacaacacacctattccaaaattgaccacatagttggaagtaaagcactcctcagcaaatgtgaaagaacagaaattataacagactgtctctcagaccacagtgcaatcaaactagaactcaggattaagaaacacactcaaaaccactcaactacatggaaactgaacaacctgctcctgaatgactactgggtacataatgaaatgaaggcagaaataaagatgttctttgaaaccaatgagaacaaagacacaacataccagaatctctgggacacattcaaagcagtgtgtagagggaaatttatagcactaaatgcccacaagagaaagcaggaacgatccaaaattgacaccctaacatcaaaattaaaagaactagagaagcaagagcaaacatattcaaaagctagcagaaggcaagaattaactaagatcagagcagaactgaaggaaatagagacacaaaaaacccttcaaaaaatcaatgaatccaggagctgcttttttgaaacgatcaacaaaattgatagaccgctagcaagactaataaagaagaaaagagagaagaatcaaacagacgcaataaaaagtgataaaggggatatcaccaccaatcccacagaaatacaaactactatcagagaataccataaacacctctacacaaataaactagaaaatctagaagaaatggataaattccttgacacatacactctcccaagactaaaccaggaagaagttgaatctctgaatagatcaataacaggagctgaaattgaggcaataattaatagctcaccaaccaaagaaagtccacgaccagatggattcacagccaaattctaccagaggtacaaggaggaactggtaccattccttctaaaactattccaatcaataaataaagagggaatcctccctaactctttttatgaggccagcatcatcctgataccaaagcctggcagagacacaacaaacaagagaattttagaccaatatccttgatgaacattgatgaaaattcctcaataaaacactggcaaaccaaatccagcagcacatcaaaaagcttatccaccatgatcaagtgggcttcatccctgggatgcaaggctggttcaacatacgcaaatcaataaacgtaatccagcatataaatagaaccaaagacaaaaaccacattattatctcaatagatgcagaaaaggcctttgacaaaattcaacaatgcttcatgctaaaaactctccataaattaggtattgatggcacgtatctcaaaataataagagctgtctatgacaaacccacagccaatatcatactgaatggacaaagactggaagcattccctttgaaaactggcacaagacagggatgccctctctcaccactcctattcaacatagtgttggaagttctggccagggcaatcaggcaggagaaggaaataaagggcattcaattaggaaaagaggaagtcaaattgtccctgtttgcagatgacatgactgtatatctagaaaaccccatcgtctcagcccaaaatctccttaagctaataagcaacttcagctaagtctcaggatacaaaatcaatgtgcaaaaatcacaagcattcttacacaccaataacagacaaacagagagccaaatcatgagtgaactcccattcacaactgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcagtatcatgaaaatggccatactgcccaaggtaatttatagattcaatgccatccccatcaagctaccaatgactttcttcacagaattggaaaaaactactttaaagttcatatggaaccaaaaaagagcccgcatcgccaggtcaatcctaagccaaaagaacaaagctggaggcatcatgctacctgacttcaaactatactacaaggctacagtaaccaaaacagcatggtactggtactgaaacagcatggtatggtaccaaaacagagatatagacaaatggaacagaacagagccctcagaaataatgctgcttatctacaactatctgatctttgacaaacctgacaaaaacaagcaatggggaaaggattccctatttaataaatcattctgggaaaactggccagccatatgtagaaagctgaaactggatcccttccttacaccttatacaaaaattaattcaagatggattgaagacttaaatgatagacctaaaaccataaaaaccttagaagaaaacctaggcaataccattcaggatataggcatgggcaaggattccaggtctaaaacaccaaaagcaatggcaacaaaagccaaagttgacaaatgggatctgattatactaaagagctttgctgtgcttctgcacagcaaaataaactaccatcagagtgaacaggcaacctacagaatgggagaaaatgtttgcaacctactcatctgacaaagggctaatatccagaatctacaatgaactcaaacaaatttacaagaaaaaaacaaacaaccctatcaaaaaatgggtgaaggatatgaacagacacttctcaaaagaagacatttatgtggccaaaaaacacatgaaaaaatgctcatcatcactggccatcagagaaatgcaaatcaaaaccacaacgagataccatcacacaccagttagaatggtgatcattaaaaagtcaggaaacaacaggtgctggagaggatgtggagaaataggaacatttttacactgttgggaggactgtaaactagttcaaccattgtggaagtcagtgtggcgattcctcagggatctggaactagaaataccatttgacccagccatcccattactggttatatacccaaaggattataaatcatgctgctataaagacacatgcacacatatgtttattgcagtgctgttctcaatagcaaagacttggaaccaacccaaatgcccatcaatgatagactggattaagaaaatgtggcacatatacaccatggaatactatgcagccataagaaatgatgagttcatgtcctttgtagggacatcgatgaagctggaaaccatcattctcagcaaactatcgcaaggacaaaaaaccaaacaccgcatgttctcactcataggtgggaattgaacaatgagaactcatggacacaggaaggggaacatcagattctggggactgttgtggggttgggggagtggggagggatagcattaggagatatacctaatgctaaatgacaagttaatgggtgcagcacaccaacatggcacaggtatacatatgtaacaaacctgcacgttgtgcacatgtaccctaaaactcaaagtataataataataaaatttttttaaaaaagaaaaaagtgtctagagaatggaagtggtggaaaaatatcccaccaaaacaaacgagctgacatatcattgagtcagtggacagtttgcagataagaagccaatataaacacagatgctttaatatgaaaccagaaggatatctttatgtcgagccccaatatctactaaattctaatactttaacttctcaaatagtgaaaacaaccaacaatacagaaaagtctcgggcggagggaggaaaagtgacaacacacctgtgaaatggcttctcaaagtttcaatagcatgtgtttctaagatatgggaaagccaaaaaacgcatgggcagccttcttcctttagaagtattcaattgttctagatagaaatctcctttctttggttaagaatttattgtagtttcacctttccttagaaatgaaaactgtgattgttgagtaaacaacttgtaaaactattttcactgacacttattaagtatcttggctccctgcattgaatttctatttagtcacttccctcaacatgtagatcaaactgatgcctcaattataatccttgaagaacatgggggaaagactgtttaaagcattccctctctgctaaggaggaaaatatcccagtcacatgagctgtgtagcataatgtttgttttccatgttgatctgcaaaagagagagatgacagaaagagtgttgggtgtggtggctcatgcctgtaatcccagcactttgggaagctgaggtgggaggatcacctgaagtcaggagtttgagaccagcctgaccaacatgatgaaaccctgtctctactaaaaatacaaaattagccaggtgtggtagcacatgcctgtaatcccagctactccaggggctgaggtaggagaatcgcttgaacctgggaagcagaggttgcagtgagccaagatcgcgctactgcactccagccctgggcaacaagagcaaaactctgtttcaatacataaaaaataaaaatagagaaagatgacagaaagcagaatcagaggaaatgtatcactgttgaacatttcctacatgtattgcactgagctcaacactttgcagggtctcccttacagtgaccttctgtggtaggtatattacccttattttataacttgaaaactgaggcttaggggtatatacacagacctgggaactgaaagctacagttccaataccaccagctttgctgcttgctagccatgtgatcttgagtgagttatttagtcatgctgcagctcagtttcctcatcaatcaaatgatgggagtctctgacgatcacgctagggatgatgcatataaagcgcttagtgcttggcttgtagcaagaatccaacagatgacagccctcactattacggcctacactgattcttcagtctgcatctacacccactgtgggtcatcctgccacctgccctgccctgctgtatgacctgaggcttcctcctaaagaggcattgccagagcttcctcataggcaggcttctgggtgaacccagtcattgggaagcactaacaacaagagatcagagctcaggaggagaggagctgaggtatttcttccccactcccttcttcctccaaggtatgttttctgacagtgactgtccctccgtgtctccagcttccaacaggagatccctctctcatagctcctttacccactggtttcctgtagtgctaattcctctccttgcacctccaggactaaggatggtaataaccgcccactgtaactagtcttgggtgtccaacaccctttggtaattgtgttacctgctcccatatttgtaagcagtcctttcatcaaaatctcttggaccatctgaattggagtctgcttcttgcctaaccctggctgatatccaaactcaaaaatcatacactcgtaaatgaaggacccagcaacctctatggtctatggccaatgctttacaaatcacttatttgccaatgataatttaaactgtactggtagtatacaaccacgtattattaaataaccattcttaaaagggaatagaacattgttaaaatatagtttgcaattgctgagaaatacatttggtgatttattcagatgatatctaaaatgttcaatatctcattccaaaggccgcaccccaattacacaggttgcaaaccctatcctgcaagtagcaccaactacagtcccactttctctctgagaaatgtcaacctgactttatcctgagaaaacagaagatcaaaactcttcatagaatcttagagaaagtctctaagcaagagccaaaatgtaaaatttgaggtaattcttattgtcattgtcatgtgcagaagtgcagctacaattctgagggctcggttccagaatattttagaaaaagtaatgagcttctctagttttggacaagacggcatagactcttttccctgctaagtatgaccccaaaccctggatataacacaacaaacaatcataagaacattctgaaaggtgaaagaagaacacagactggctggggacctcaaaagtcaaggagcagcacagcaacctaaaatctcctaaccacccatccggaggcagaagatgtcccaggtaggtgcttcttcccctgtaggaggcaccaggaaagactaagcagaagcacagccagcaccaggcagcccgaggaagcactctctgccccccatgagcctggcatcttctgcctccaaatttggtgatgccaggccaacccatagaagcacttttcaccctcacaggtagcacaagcaggaactgagtgacaaccccatcagcactgggcagcccaagccagagaaaatagtttctgctcctgcaggcttggcatctctcatcctctacccagtggtactagatataaagaagaaccaaatggaaattatgagacttaaaacttcaataactgaaataaataaaaaaattcactagaagggctcaataggcaaatatatgtgacagaggaaaaaaaataagtgaacttgaagatagaacaatagaaagagacacctgtggggcagaaacaaaagactcaacagtcatatcattggaatcttagatggagaaaagaaagagtagagctgaaaacatattcataaaaataactaaaaacttcccatatttgctaaaaaacaaacctgcagatttaagaagctacgagaataccaagtaagataaacccaaagaaagccacactaaaacacatcataagtaaaattctgaaaactgaagacaaaaataagaatggaattcatatgggaaaaagtcaaagtttgatgttatttttcactgagaaaactttgcataacaacagctctgacaagctgatatacaaatggatagaattataacacaatataatgtttataatgtgttagatacaagccctttgacaaatattaatattaaattcttaaaaaattcctatgaagtagttattattattcttattttacagttggacagagacccagagaggctaaataacaaactgagacccagaaaggctaaataacttgcccaaggtcacacagctagtaagtgacagaacccagaattcaaactcagacactctggttacggggtctacattcttgactatgatgcctggaagtggtctagtatagtagtatggaatcatgtacatatagtttagtagtatagaatcaacaaccaaaattgacaaggtccttataaactagataaagagacaaggaataatccaggatttagttccagatgtttttgtttatttttgttttattaagattttctttaaaatgtattagagctggacagtatggctcctgtaggcttggatattagtaactctcattgttcagaattaagcttatactaaagttgtacttggtgtgggcaatgtttttttctgccagaatcatatagtaaaagacatctgtgattgtttttttaaagttgaagttaagcagttagtctccttggcttactacttttattaaatatcaatgctgatgtcattttctccacaaaccaacatcctaaatgatttttatcaggacagataaactctcaaatacagaaagcaggtcttttcattatcctattgattaaaagcaaaatacaaaaaaattagctacatgatacaggcacacaacaaaaatctttgtcaaattttaacatggcacaggtttcaaaataaaattatcccttttagaactggcaggtcaatattatctttttgttctaatatgggaccatttgcagaaatgtggtttcctgtgaactaagagaaagctgaagtgttttgacacactaaactgtactaacaacacccactgaaatgatggcactgtctttgaatgacgtttaccctgagactggagggagccactgggacatactggtacaaactgagtgttgaacacatataaccttaatggataaaaggcagggagggagggagggctagccaagcctctggcctatgtcccttaagtctcttcacctcactcctagggttcttgaataaaatgtaaaactaaggccttaaaaaacctgtagtgtgggaattgactgcaaatggaaatcagagaactctgggggatgatggaaattttcgaaaactgctgtggtgatggttgtacaactctgtaaattaattttaaaaatacagaggtatacagttctcacagattaattttataatgtgtacagtacagctcaataaaactatttggaaaaatatcctgcaggttctccccattgccttctgaacaaaggccgagttcatgaaaacatacaaaatcctttatgatacagcccttgcttaactcacttcttgtctttttttgccacctgtgttcccccagccctctgatccaccactccacctatattctatttactgagcaaccagcagttttcagaaaatctaaagtggctgcatactacagtcctatgcctctcaccctgttctctctgccttctgcctagaagtcttcctccccacagcttcctgaccaacaccaaatggggggttcaagacacagctcaacctgactactatattctaggatgcttttctgactttctgggtagaattggccatttctttttgtgttcctccagagtacttagtcattcaatgtctataaatactttttccttacaggtgacaaaagcatctgcaattctatcaaaatgtccgtgtagcaccaatcccttcctctcagacctataaagataataagcaagagtgtattgagactaacaagaaggtgacacaccaaggatgggagtaacactgagggagtctctcacatggacaattctagcagctttataaccagtctccttacagcagtcagagtgaaccctttaaaacatatctaattttatatatatatatatgaaaaagaatgtaagttttagtcagagaaaccgacagagaatttaaagcctgctccaccacttactatatatatgactatacaagtcgccccaacagtgagcacataatttcctcatctgtaaagtggaggtataactaccttacagacttttgcaaagaatcttcaagattagccacgtaaagttgtgccacttagatatgatttcactttcacttccttacttaggttgttggttcgataattgatattactgaataccagacaggctaagaaccacatcactgatttacactctcctccacatttaaccgaaaagtgaccaatcaaaaagtatcacaactcaggttgatgtgcattcagtctatcccatggtatctttgtctcttttcaaatcacaatactgatgttccaataaatgatgtttattatcaggccatgagccatcaagaaaatactaaactctgcttagaacactgtttaagaaggttggaaaatatatatcaactatagacagttttcttagaaggaaaatcaacatgttagcacataacaaattaacatacaatctgggtaactgaataatatataacggcatgcttccataatagatgaagaattatggaatctctgtttgcaatccaatgtgggtaagaagaaatgtattcattcaacaactattcaaacatttgttgaacaaatgatatatgaaaggataaaagaaccagtctagaagaggaaacttgtgatcttcaggtgaaatgcatgttacaaagcataagaggactgttattgtgttcttaatttcagaaagttaacaaaagactcagggtcagggataattaaattcataagtatgtgaaagaatgactagttccaaaacaatctaagatgaacatctcttaactgatatatggtttctattaaataggtgacatgagttaagtcatcattaactagtactttttcctcttgctatatcaaaactatcaacaaacattggaaagcctacctccaaaatgcatgctgaatctgtgcagcccactgccaccactctggtctacaccactagtctctcatatggacaattccagcagctttatacccagtctccccacagcaatcagagtgagccctttaaaacatatatcgaattatatcatgtgccaaatcaacatgtttcaaaggtttcccattgtacttagaataaaaagcaaacgccatggaccccatgatgcttacaccctggcccttgtctgcccctttatcctcattatctgccactgaccaattcatatgctcaagccagtggttctcaaagggtggtcccaggacaagaagcatcattacctaggacctttttagaaatgcagactttcaggacccatcccagacctactgaatcagagagtctgggtttaaggctcaacaagctgtgttttaacaagcctttcaatgattcagaaacactaaatttaagaattattactctagatatctgctatagtttaaatctgtctcacaaacttcatatgttggaacaatcctcaaattcatatgttgatggcatttggaggtggggcctttgggaggtaattaggattgggtaaagtcattagggtggagtccccatgaagggactaagaagaggaagagagacctgagctgacatgccctctcagcatttgatgccctccaacatatgatgatgcagcaagaaggtcctcgccagatgccagtgtcatggccttggacttcccagcctccagaatcgtgagctaaataaacttcttttctttatagattacccattctgtgtaattctgttatagcaatagaaaacagactaagacaatacattaggcttctttatatagctagaaaataccaagctcttttccatctcagcacctttgaatttactatagttctgcctagaatgtatccctcacctccaccccatgtcaccaccttgattgccccttctccatcaactgtaaaaattctacctgacccaaattactttgtatcatgctacactaatcactactatcataacacttagtacaacctgattttatttacttgtgtgttcatcttgtttgtacactaaaacatgtgctcctttagaacaaggatcttatctttatcaaccacccagtgagttacaaacagtagttgctcaacaactattaaataaattaatgaataagcccagtataaatccatttaacataaggttagaataacaaagttagaatagtgaaaaaagccaccactgacttataataaaagtatccaaattgcctgcttactatgggccagtccttgggctaaatcttttcttgtgtttttctctttaaattctccctagaactcaatgaggtagaactacaatcatcctcactttaagatgaagacgctaagatataaataagtgaaataaattacttgaggctaccaagctgatcattcgcagagccagggttcaaatccaggctgtccaactccaaagttcatacactgcacccccacccactactacctcttctgaaaaaggtatctgaccagatattttcaacatagatttcggcagactacagggataacctggtgaggaagtagtctctccaattcagatctcctacagataaaaccttggcaaaggggtactcaattctgtcaactgagtctcacaaaattataatgttaactgatgggtgtttagaggatgtacattttagaagactcttaaattgagtacagatgtttagaaaatcagtgtcaaattagaaagcattaagcagacattaaggcagaccaaattggtcttttcagaaagctgggtcaggatgggagaaatgtgtgcttgctaagtaggccaggttactcagaagtgggtcttctaactcagaaattagtgaaggcagcccagctttgccagagaatcagacagagtaagaagcctaaacatggagctgaaggattgacctacaggttttcaggtggagtggaaggaagcagattctcttgccaagaccttcacagcaacctgtagatgcagcactggaacccaggactctggcgtgttttttaaccattaacctgatgccagggatgttggaactgtcttggaactccacttttcaacagaaatttctggaagagattaaggagatcctatgccttaaaagaggaccaggacatgttcacatcatccatctgcgggtttctggaggtggggggagccaatggtctcagacttttggaaccactttattttcatttcatagtttcatcacattcggaaaggtttggtatatttcctcatcataaaaatctcattctcaaaattcctcttgaaatatatgtgttggtctccaaatgatgccacacttgtttataggactagatgacaaacactcaggtaaaggcattttactgtgtgcagcaaaatatacagaacattcactttcacaactcaagcatttatggctgatatcattaataaaacatagccttagaatccctcttaatccatcaatcagaatcaccactcaaacattatgtgcctcccatatcatgggtaattgtatggaaataaagaagtatatgaggcagtatagattgacaattaagagtttcaccctggagttacacagacacaagttcttatcttggtgttgttacttaccaaccatgagaattggaccagttatccatgccatggtttctatctctaaaatggaataaaaatcacccgtaactcattatatggaggttataagaattaaataattcaagtaaatacatagtcattattttactaaaatgtgctacgtactactctaggtgtttttcacatattaattcatctcaccctcaaacaatcttatgagatagaaaatatcattatgccccttttgaggaaacagccacagggaggggtaaaggaacttgcccaaggtcacacagccagtaaatggcagagccaggattcaaacccacgcagtctggctccagagcccacatatgtaagcactatactattaagaagacaacaattcctatacttactagcttcatgaaagtaaaaacatttgcaggttttgctttgaaagatccaagtgaatgctactagaaaaatacaaagaataatgtactttttttatcttaagcactagccaaggaaacaaagaaggagcagaattcactgtacccaagtactgtgtggttattttgatacaagtcaacaactacagcagatgctggtatccatcttcctgacaggtgacaggtagtaccaacactcttcagatcatgagacctcaaaatactcattttatcctgacagcaggggtgagaaataacatgtaaatcatcatggggagatggaggcctaagtaaatattccaggaaaagggctcctttagcataaagtagcctttttcacacttgtgcagactccagaaaggaggtgccccatggctgtcagctctggtgtgctctgcagatgactggtcttccagccaaactgttggctggcttttttctagcaattcaatctagcattctgctagtacataccccagcacaaagcgggccaggtccactttattacaaggttacaggcaagccatagataaaaagtgagtccttaaatatcagggattaataattcaggaagtaattatttttagaataatatttaatttcaggaaatatggaagttaaagctttatcctgtgcagaatgatttaaattccagcttaatttccatctactaacataattgtggtgactaattttgataaaagtactttggatttgcctaacacctctgagtgttgaattccaagggcttcagtaaatcctgggtcacaagattgctattttttccacatttcataagactttttggttaatactctaggaaatgatcacaagcaggttctcactctcctgatcaaagacatagttccacctgtgaccaacttgcttcctgactatgtcagtttcctgttgctgccttaacaaataccacaccttagtggcttaaaacaacacaaatttcttctcttagttctggaggtcagaagtctaaaatgggtctcacagggctacaatcaagatgtctacagggcagcattccttctggaggctctaggagagaatcagtttccttgccttttcaatcttctggagaccacccaccttcctgggcttgtggccccttcttccattctaaagccagtcagtagggcatcttcaaatctctcttggtctctggctctcctgcctctcacttataagcagccctgcgatgatggtgggcccacccagatgatccaggatgaccttcctatctcaagacccttaactcaatcacacatgcaaagtcccttctgccacatcaggcagcatttatagatttcagggattaggatgtggacaactgtggagagccatcatttcacttaccatattgactcttaaggctatgactcttaaagtcttttctcctaatctataaacccatcaagaatatttaagttattcttgtaactacacactaccttgttaactcaatcttattataataagctatgtcaggctatagtcaagaatattaccattataatattacctatataaatctggggatgtgaagcatagaaaagaatttttaaatctcaagttttgcatttgtgtacttatatacctaccaatttatagagtttgaaattttatagaatttgaggtttggtagataaggtcgtaaataaagtttgacgatttatatcacatcttcacttaacatatcacttcatatattttaattattaaaatgtgtgttaatgaaatttcaactgtaattaatctcctttctactgaaatggttcaatagatccatgagcctaaacaaatctccctggattttcatcattaatatttttactctttaagaataaagaatttatgaattatgatctacagtttatcccactatttcaaatgacaaaatcttgtcactgctttagctttaaaagtatgtcttcccacttttaaagcactttttctagacagccatacctactttcttcacttaagtagttgacacttatataacactacacacatatagttgtatgtgtcaacacacatgaaagaggaaataacagagaaagtgttaatctgcctatatctttgaatattatcaaagcaatttagaaagctttataactgaaagttaaatatgagaaagaaaaaagacagtttcatatcttacagacgaagttaaatagaacattctctgagcatggtttacatgtgagactttgttctaggtgctgtatgccaacactattcccaaatatatattttttcagtgccttcaaaagaggctgttatgctaccttagataaccccccttctaatctgcatgatgcaattcactgctatctgcatgatattccacttgaagtgcacagtagagcactgtgctttccatcagcaaatatctagagttatgtgggcatgaaatgtctcctccaaggagtcaacagcgacccaggaatcgttctcaactgcacccctgagctggcagccatccagtcgaggttccctagacaggcagtgttgtcactgatgttacaccaaggggcctgtgtttcagatgtttctctttctcaacaagcacatcggtgtgaactcgaaagaatgaaaaatagttccatgtgatattcatccagttgttttgttctgtaagtagcaatggttaagttacaaaccatgaatttaatgccaaactcctgtgctcaggtaggcatgacagtaaactctcaatagcctataaaaaggaagatgaaaggataaaggtaaatccaatttacacaagaatcaatactgtcatcaacaacactaatagggaaggttctatgatttttttaatttcctctttttttttagcataaaaacagaagttaatgggtccctctcagtttgggaaaatctgagtgacaagccaaaaccaataggttttgaaaggggcctgtgaataaaacgcaaaaagtgcctaattggagtcaagaaccaactcactataacaattgtagaatctagatggcaagtgtaggtgttcattatactaatcttttgaacttgcccacatgtttgaaaaaaaatcaaaatcaaaagttggaaataaaaaagtaaaatagaaaaagaaacaattcataagatattgttgaaccccatgggctttgagaaatttgcataaacttgaggcatattcaggctgaccagttagctcctctctccatatacagctccatgccaaaaaaattatataaaatctactatctgagaaaatgggaatccacattgcttcatagctcttctgaatgaacaaaatgcaactggtacagacttaaaatcgttagggaaatttccttttgcagatcatgtcatactgacatgtactagaatagcaattaaaatattctaaacccatccccctctccatgtaactatccttgtcatactctcttgaagtcagagtacaaattgctccagggctaagtgatgacagaaacatctcccaattactcctggttacacagactcaaagatgggaacaatgaagttctaatgcctacacactccttagtgaactcaaatttcctaagacaatgaatgatcaaagtagagtcttatgaaagcttctacataaaagacaggaaatgagacccaaatcaggagagttggggaagctcaggaggagggagatacatatccagccctcatttaagatcaattcatggatgactccctaaaacaccacagaaaatctgacacaatagcaaatgcactgaatgatgcatgccattcactatcacaactgagaactccaaacatttcgttgatattagaaagtgaaacaaatgttcctgcaaaagtcaaatgagaatcaaaagcaccatgtttgcactgcagcctgggtgacagagcaagaccctgcctctaaaaaaaataataattttttttaaaaaatcaccatggtttacagggaaggatactgccgtggctgcacagacctttagtgtctcaaagcattgtgcaaatacctgtgtatttctttcatgcaacatgagcattaacttgcaaattttaaaaccctctgatttatcattccaccacttcacttatttgtaaaaccaactaaaaaagtattaagaatttcaagacggcaacatgagagcatcagatcacatgcaggggctcttctgagctcgggctgttgaatccaggcctgaccatatgaactggcagagtgaaggagagatgtggggtggagtaggtcaaagatgctgcaggctgcccaaatgaaggaatgtgggaggagaaagggagcaaaagggctggaaaataaaggggtgtgaggcacgttcaaaagagcaggaggaggaagagtacctgaaggcggtatgatagaggtggagaggaaagggctagatcaggggtccgcaaacccaaggccacagactggtagcagtcaatggcctgttaggaaccagacagcaggaggtgagcagctggcaagcgagcaagacagcctgtgctctggctcctgtcagatcaactgaggcattagattctcatagtagcacgaaccctactgtgaattgtgcacatgagggatctagattgcacactccttatgagattctaatgcctgatgatctgaggtaggacagtttcatcctaaaaccatccccctgccatccgtggcaaaattgtcttccacaaaatgggtccctggtgccaaaaagttggagactgctgggctagatcatctggatgcagttcaccacccacagtgcctcaaagtcgctccttgttttctctttccctgggatcctctcaccacacgcccaacaaaggtatcactctttcatgcttgaagggccatggtcccctttttatgttttttgaacaaggagacccaaattttcactgcgtgcacactgggctctgcaaattacataagtggttttgcctagaagatttagaagatcaccagtctagatagagaattctagaaaataattcctgaggaaggtcccctttgatggagtaatcttttaaaaatttattctgtttgcagattgtctgttacctcagttaacaaaaacattgactgttaaattaaatgttgacacaaatgatcttgccatgtggaaccataacctccttttcctctgtaagaattccagcaaactaacaaattggaatctgaaagccccaggttggaaatctaggaagatgacagaaaacatcgtccttcagagtagcaattcctgaaacctcctaccctaggtccatgccttagctactctgaaggaaacacgacctttcctcaaagtaaaagagagcaaaatgtaaggaaataattataaaaattgacgcctaaagaacaaaccctgggaatctgctatccagacaccatcaagccatgagtgagtgcataccatgaaaggtttatcagcgcacggacaagggccaagagtagactagtaagcagtaccatagcagtcatgaaataagaccagatcatcatagggaaggcatggagttttcttacaattctttgctcagagctctataaaagcactaaaggggtctacatttttttaaatagtagggctatttatataatctgttaaattatatttatgattggcccccaaaaagtggctttccaggaaccttgagaaatctttttatctccaagaaaaaagagaattgaactttaatacgttttttattatttatttattttgttattatactttaagttctagggaacatgtgcacaacatgcaggtttgatacatagctatacatgtgccatgttggtttcctgcacccatcaactcgtcatttacattaggtatttctcctaatgctatccctcccccaacccccagcccccgacaggtcccagtgtgtgatgttccccgccctgtgtctaagtgttcttattgttcagttcccacctatgagtgagaacatgtggtggttggttttctgtccttgtgatagtttgccgagaatgatggtttccagcttcatctatgtccctgcaaaggacatgaattcatcttttttatggctgcatagtattccatggtgtatgtgtgtcacattttcttaatccagtctatcattgatggacatttgggttggttccaagtctttgctattgtgaatagtgccacaataatgttttttaaaagtgaaatcagtttcctgctctgccccttcccctagcaccttgctcctcatttgcataacaggtagaatgacattggccaactcccctcacagttagggtgaagtggattgactagtataccaccaaaattcacatctacctggaaaacttaagagtgattgaattattttctcaggactgccataacaaattaacacaaatttagtggtttacaacaacagaaatttattcttgcacagttctgggaactagacgtccaaaatcaaggtgtttatgggacaccttctctgaaggctgttgagaagaatccttccttgcctcctcctagcttctggtggtttctgacaattcttcatgttccatgccttgtagctgtctgactccaatttcttcctcctacttcacatggctttcttctccctatggcctcttccgatcttgtaaagacaccagtcattggatttgggacccactctaatccaggatgacctcatgttgactagttatatctgcaaagactgtattcccaaataaagtcacattctgaggttctgggttgatatgaattttggtggggacatttttttaacccagtacagtgaccttatttggaagctggatttttgcatatataattaattaaggatccagatgagctcatattggattaggatgccctaaatccaataactgatatcctaataagaagtggggagggcacagagagaaggccatgtgaagcaggaggaagagacctgagtgatgagaccagaagccaaggaatatcaagattgccaggagccaccagatgctgggaagaggcaaggaaggttcttccccagggtcgatggaaggagcatggtcccactaacccccttgattttggacttctggcctccagaactgtgagggaaaaaatttgttttaagccacctggtttgtgataatttgctgcaacaacattaggaaactaaccaggagaggggaaggtttttagctgaaaatagtctataacacttatagagttttcattgaacacgaacacacacacacacacacacacacacatacacacacaaaactaggaagaaacgcttctgttttaagacaaactccaaacatatggtcaatgctgattaaattaaatgagcatgagtcagaactacttgaattctattgaatctatgcctttagtcagctgtgtggaagaaaacatgtttgcatggactaggattaacctactagatatttcctttatttattcattgctgtatttgtttatttagtggagcggtgtttttaaaaaagaaggctctttacattgtttattcaggaaatctttgctaaagaaacaaccagctctcgacaaacaaacgattcttgaggaaattaagaaatgtaaacagagagatgcaaatgtgatgtgcaatttaaaggatttactcccagcagtgcttaggaatcaggacaggatgagggcccacccagctgagctcatcatcctgcctcagcctccattttccagaaagtctggtcacctcaggagcagtggagacccagaacttctaaaatggcttataaaggaaaccacccacaagcctaaagagaaaagaatgaacttagaaagtaagaaaaagtctccagctgcagtctcctcacagagctttgttctctgagtcctagctctgaaaagcacccaggtgaaatgaaaggccagggtcttggataataaaatatccccttccctaataaaaccaacttatttagcatcactatgtgttttttgtttttcttagagaacagtgttatatcgttagaagcacacaaagtaggacttaaaagaagttatttctggtactgtcagtaataaaatccctctgaatgatatccaatacagagctgtcttttgctgaattctctggtgcggaaaactgtaatgaactttcagtataaggctggaattggtagaaagtgctatgtgtctgtgttggttattctcagctaccctggatctgttctccacccttctctgtgcctgggggtgactgtggatgggccatcgctggctctctggccctctggcttcctgttgagtttctgttggaggcatcagcagatcagaaagtagaaagggaaggaagttagggtagatgaggcacttgtggaccataggaagctcacactggggctgacagtgacaggtgggatggcttgtctcataagcaatatcttgcctccagccctgcccgtcccactgtggcttcaccctctgccctgctgggtcaggccccccagtggtggcaacaaccccctgctgttgccagtctctgggggccttacaaggctttggattctgtccactctgcccagacgcctacagtaaagagcaccttcatcaatagccctaagttaaacccttgggcctgccttggtttccagccagagccatgaccaaaggtaataatgccaacatgtataagtcacttttaaaggtttctatgttatttacaaatcctaaccactcaaaagatgactttaccttacctgcctcctctattccacctttacctgttgaaattctgccttatccttcaagaatcatctttaacatatttttaactgcatatagtttctcaaacatttgggcctctataattttttttaatttgattattttggaccttactgcctggtgtagtggcatgtgcctgtagtccagctacttgggagactgaagcaagagaatcaggcttgagcccaggagttccagttcagcctggggacaacagagtgagaccctgtctcttataaaaacaaataaatacaggcttggcacagtggcttacgcctgtaatcccagcacttggggagggtgagacgggcggatcatgaggtcaggagattgagaccatcctggcgcacatggtgaaaccctgtctctactaaaaatacaaaaattagctgggcgtagtggcacatgcctgtaatcccagctactcgggaggctgaggcaggagaatcacttgaacccaggaagcagaggttgtggtgagctaagattaaaccattgcactccagcctgggcaacaagagtgaaacttcttctcaaaaaaaaaaaaaaaaaaaaaaagagagagagagaaagagagaaaggaaagaaagagaaaaaatagagaagaaagaaagagagagagaaagaaacaaagaaagaaagaaagagaaagagaaagaaagaggaaaagaaaagaaagaagacaaacacaaataaataatacaaaataataatgatattttggactttacttatatttccctcactttgctttattttcatttgtgttaaggtcatatcctccttctctggctaaagtctccttaagatcaatgacagaatggctctaatttctgtatctcctcccagcccagtaagtagttcagtcccagtatacatactcagtaaatgtctgctgttactgccagctacttgttttcaatgatttttccaccatcaaacccagaacatttccataaatatgcatatcaggttttatacattacatacatacatgatatattatatatctacatacacaccctaacctgaaacttttatctaatttttcttcttccatttggcgtatatatatgcacaacaatgaggtttttgccttcagtcaagtggtttctcaaacactttctacattcttacacttgggtgtctctgctaacccagaaagaattcagtgtcttccttgttctcttttcccttttatgagaccccataacgtcactcattagagctatagttagcctccgattggttaactgtcttttgctctccctggctacgataactgcggtgactagctgtgtctatgtctcagctttctcctgggcaggcactttatcttgcctgtgttgtcatttactacttacacaatcataagcaagttacctatcttatccaaaactcacatttcatccctcaactagaaaaacaagggaataacttagccattcaccaattcaattattcattaactacttattgaggactaggcactgtgccgggcacagggaagggagtgaatccaaagcagtccttccctcctgaaaggaacttgcagtccagtgggggatgtggatgaacagaaaagcagctacagtcacatgtgctatgggagacatgggcattagtgcagggcccctggggagcaaacaggaaggcccctaaactggtgggttgatgggtgatatggttggctctgtatccccatccaaatctcactttgaattgtaataattctgatgtgtcatgggagggacctggtgggaggtaattgaatcatggggacgggtctttcccatgctgttcttgtggtagtgaataagtcttatgagatctgatggttttataaatgggagttcccccacataagctttctttcctgctgccatgtaagacatgacttcgctcttcattcgccttccgccatgattgttaggcctccccagccatgtggaactgtgagtccattaaacctctttttctttataaattacccagttttgggtatgtctttatgagcagcatgagactagactaatacaataggaatgggctaggttagacttcccagaagaaggatggctaacccacactctcaattctaagctggggttcgatttaaaaaaacaaaaaaacataaaaacctcaatatttgtttgattttgagaatcattaaaataatgtcagtcacagttgcaacagcagagagatacttttcacaaccaaaattaatacaaatttgcttgaattctgctctatgtaaagagaaattatctgctttggtaagggttactatgaaacttaattcagcttcaagattaaattatcctctgctggagattcacatagagcagcaagatacaggaaaaaaatgaatttaaattataattgtacttaaaaattcaatagatcattgtgatcttacaatatttatttcatgcttaaactaccacattttttcctcacacagaggaacttttaccagcaactccaagctggatagcaaatgtggatagcaaataaggtttctagctcctcagtcctcttacttgactaataaagacaggaacactaatggaaacatttttatttttaataaatttaactattttaatgctataaatatccaacttacaaattttcaaaggttattacatatatgtcatatgcatttgaatgtgttacatactcaatttgtaagccacttaattggaatgtgacatatatcttcctatagaaatgagagttaatagtgcctacattctcaggctagccctcaaaagcctattaaacatctctttgaggaaacactgggcaatggtcaaattcagagctctggttctgatgatgtaaaacgaggttaggccctctgaggcaaagattggaaatgaggtggtagggacagagtcaagcaatgtctctgaggctctcgtgctatacaaaggaaagagctagggctttgaactcaaacagactagggtcatgtcagatttaccagttactagctctgcagtcatcaagaaattatgttctctttgccttcacatagttacctgcagaaggggaatggcttgggagcactgtgaggatgaagtaaaacagcatatgcaatgcacctccgtaaagcctgggaccgagcaggtgctcagtaaataatggctcccttccattcctccattggctttctgcacctgttacctatcttggcctatggaaaaaatgacctctgttgtagggttgaagaattaaataaagtatgtgtatgtctgtgtatatgcgtatgtgtgtggtatgtataaagccagtaagtagtaaatacatggcctagtgaataggaagaactcaataaacagtggtttgttttatttttctactagtagcatacttaacaacctgcttccttttccctggacacagcctgcaaaaattctggcacaccaattctgcagtgtgaatcattgtgtttatcctaacagacgcaaagctattgtttttagctggtaatatgttagcgggttcctattggttccagacctatctgggttaatctggaaaagggagagggaggcttctgtttccgtgagctgatcagcatggcctgaaaaaggacttggttgcagggatgagcataaagagaatgacttgttccccagtgggatcccatgcaccaggcccaagcccagtagggagaagagcagtactgaggctgtggtttcacaaggatatcctgggtatgagcaagcataggagtgaaacacttcctgtgtgtgcacaaaacacacatggctccagctcagtgacacccaagggaccacaccaggagtccatatctagccaaggaagcaatgttcctaaagaggataccagccatggtggcaacaatgaaggaggcaccagtacctggtgtttccaagtgccttggacatcagggaaaggtgggttcaaagaggaaaactatgatttgtgatcacatatgagacactcctgggacttcccaaacaaatgaggaaaggctttgttggagggcagggatgtgatgctgagacctcagtgggatgtaagccagggaaatgtgaattcccttgatgtggttcatgttgcatccataggctggtgaggtctgaaggagggtacatatgggagggtacctccaacaaataagtacagcaaccctaagtcaagcaaatgcagtcattgggcagagctcagtttcaatggcttgatagcagaacagaataaatggttacattatagctgcataataatatagtttccaaatattatgctatcaatattaataagcatgactcttttttaaacaaacacatgctgaacccttattgttcattgccacacagagaacataatgatagcttactagcacttgtcaggatcttgggtggaagacactgcataaatatcaatatagttagttgaagtgttattgttttccattctgcactggcattttatatggaacataatgaagtttttatctctaatcctcatatcaaacgatcggcacctacttggggtattgtctagaataattatattctgattagtttacagtagttgctctaaaaacatttcttatggatgcttttcatagtcaataattacttttgtgatgtctttcttccaatacatcccaacatgtactgttaagatttaagtggtttcacactaagataatataaaccaatgttgtgaatatatctcagctttctctcagagaatagctgtgactttcctccctatttgatcataacgctaccattcctgatcattcagtatgaatgtttagctcaatagataattgctgttttctggctaacatttgagtaggttggcttaaagatgtttggaacaaagcattctgggataagcaaaggatcaaagtccaagcttgactggaataaggagggcagacagggagcctagaagggtatggctgcagttacagggaattgtaagttagaagggaacaagaaagagaggcacagagatggagggcatatcacaagtctcctaagtgatcaattagaaagcaagcggatggatgaatagcctctataagtctaatttttcttattgcaaaatataaaagttatagatataaaaggcttgggtgtggaaaattaaggaaagaaattttgaactggggagtctcataaaatcttgcagaagcacagaaaacattagtaaaaaacaaatagcttgaattccaacataaacaaaagattaaatacagtaaaaaatgaatgaaacaaaatcagaaggcctaagctctgctaaaacttatcctcactttgtgatattgacacgtcttttaatctttctcagtttcttcctcatcagtaaaaagaaaatgatgaactaaagtgatcccttaacaacaacaaaagtttttataactggcgatatgcaatagccctgggttttccctttttcggcagtatgtgctttaaaaagcaaacaacccatatgtcttcccaatttccctgtgtagaagatagaataaataacctccaatgaagggcaactagaaagtggaaattccatgttgctactgaatcagtgttggagtctaatatataagtcccattttcctgtatttcctgagagtcaccaaagcagtagcaagtgcaccaagcccaaggagagctgcatacagaggcaaagcaacaatcacaatgtgtggtagaaagggtcaccaattccctgatatgctatatctaattttattttatggtcttgagtaagcccccaaatttccttatgtcttagttttctcacctggatgtgtaattcatattctcaaaactacctttttgtaaaaagataccaaaacttttttaaatactaaaaattgaggcatttcaaaataaaaagtaccaattttaagaggtcatgtgcttcatgggaatagcattgaacttggaataagaaataaaactgggtttaaaagtaggtttgctatctatgagccggatgaccctatgacctctcagttttcttatttgataagtgcaagattttaaatatgccctgcccaccccaagattgccaaatttaagtgagattatagaaggcatggctttccttgaactatatatagcaggctatgcaaagtgagttcttcgtagcctcaccataatcataattgcaaggaacctaattactttccactctccctcagtcattaagtttcacaggcccaaaaactgtgaatcaggaaccttcacaagttccccggaaggtgaaaaaaatatctgcaaaagaagtgaatccagcccaagtttcataaccttaggcaaatccaggaagagtgacggcacaattacaaagagtaactgcatagaatatctgttcagttaccactcttacctggcttgtaaaacaacagcagaaggtgttaacaaatgcttgtttaccaataagtccatactgcagcaaaattcctggccctactgaaaatgtagtaaaagcctttctacaacaacttgggtccttaaccatggaacaaaaaaaacccatgtggtcaggactgaccatgataatactaattagaaatgttttcagtcttgtataccaaacaggtctgtcctggagacaagcatctttgctagtttcataaaaatgtttgtttccagatgctattttggacatttcttctcttccatatttttattcagaaaggcagttttttgtttcccctgagtacttcctgtattccctttaactataggtgtagctactgcccaaagggttcctaaaattacagtgagaagagaagaggaagggagagagccactgcagcccctcttggtcagaggtctattttgtgaactgcttgatggacaagagagtccattacgcaatttttgttttgaagacccaaaacacaaacttgcacgcctacctgcaatgattcatcctccaccaaacctgctatgcccagaagccctgttttacagcagagaatatttcttcaacatttttccaactctacatctaaatccatttaacactaaaccatttttaaaattatgtttaaaattacaacataattatcatattatgttcctatttttgcatcaagttttttattgttgtgctttgtttgttttagtctcattgcctctagattttggctttggcaaaatttattgaattgctagttcctcgtgggcaagaatagattttctactcaactttgaaattccccaaagaacctagaagagttttacagctacacagagtgaatgctgctgagagctgacgggccaactggtctcctagcaaagggcaccaaatcttaggtccaaaacaaacaaaaagcatcaattctgaacttttatcaccattcaggccaaaaaaatgcctttgtatttgttgatggtttctggctggcccacattccctccatctacttgaagttcaggctgcctatttagagagtagaacgacccttggcaatgggtgcaggagccaaaaagcataggtttcttgggcagcctgcattactccgagagggacatctgtttagcaggaagcttccactctgtgccagccttcagaaccatctgtctctttacgcttccggacacacacacacacacacacacacacacacacacacacacttccatgcattcactgggtgtaaaaaccaagttgagagagagagaagctggcaacataggtctcccttgcaacagagcttggaggggcacacgaggaagaaacatcgtgattactctatggactttgcatccctggatggagcaaagttttcccaccccgcccatacccctccagcccagccccaagctagaacagtaacttacaggcctgaaagacttaataaagatcacccacaatgatcttcaaaactaaatttcaaggcagcagctctgatataaagtctttacacactcagaaaaatgcctctcttaaaactgctttcataagaggaaactagagaggcaaaagggaaagtgtcttttggatgggtgacctattaattacaaggattggttggtctgatgaggcgattatagaataaagtcagtgagactaaggtcacacaagacagacacatggaagccatgggctgggagcctcaaggggcttgtcctactaatgtctgtgtgtgtgcacatgtaagtgtctgtacacacctgtgaatggaaggacaggacatagaaactattgcttaaatggatccaacatctctctgctgctgcacattgtaaaactgacatccaacatgaaaaatctgtttaactgtttgaaaaatgttatagtgattttataatttataccttattttaagaaatatttgaaaactcaagaagtagtttaaaaaagagaaaagacagcaataagaaattctaaaaagaaagagggaggtgatagtaccagatatcagagatgagaattactgcaattgagcactcaatctggctctgcagtcaagcaaaaagagaataatgagaagtgacatagtcctcaccatcaaagaaaaaggaacattatcagtgcacagaaagataggtctctctggactgaattttaggaaaaatttattgcatagaaatatacagatagactaataggtgggcaaatattgacaaaacattaaataacaacaaacagtgcttcatgaagcaagttagtacagaagttttggatatgggctttttagtagacaggactgggttcagattaggaactacaacattggacaaattacttaagcacctcaagcttttaatttcttacctctaaaatggaggtgatggtacacacctctcaaggttatcatgaggattaaatgagatggcacaggtaaaggatcttacacagtatctggctagtagatgcttaagaaatgttggttccactcccatccctcacccccactcacaatggttggattcaggtctttttgtggacagaacaaaaatcagagccctaatgcccttgaagcatttccacagaaagcgtagatactacaatggtctgaataaattgccagttagaggcaacaatagagcttggagaacctggggggatggtagctggcctgtctcttatactgacaatggtgtcaacacaatgagggagttgctgaaggggtgtcaagactcagctatctggtaagtacctaaaaggtagatgctgtctgttgctcatcaaagataacttgatatttgagacacccattgtcaagcagtgggattaccattatttgagtgtttcacccagatagtggaccatcccacctacacagagagggttggctgaaggcatgattgtagataaagccatttctttgtctcaaagaaaacgtacatgtgaccctctcaaatgcttagacaacgatgaattgggattccaaaactctgcatcatagagcacgggagcataatttgaacttggaatatatgagaataaatgtcccttactttaaaaactaccaaaaagtaaaatgcctctatgtggctgttagaaacatcttatttttattttattttattttatttttatttatttatttatttatttttttgagacggagtctcactctgttgcccaggctggaatgcagtggcgcaatcttggctcactgcaatctctgcctcctgtgttcacaccattctcctgtctcagcctcccgagtagctgggactacaggtgcctgccactatgcccagctaattttttgtatttttagtagagacagggtttcaccatgttagccaggatggtctcgatctcctgacctcgtgattctcccgccttggcctcccaaagtgctgggattacaagtgtgagccaccacacccagccagaaacgtcttatttttaatagcattgtcaccagatggaaaaatgaatgcatgcattattggatgcattagtaaatacataccaatcttttaccatatgtatgactctatggtaggcctctgtgcatttattatgtcaattaattcctgcaaaggaaaccaaaggtaatataccgaatgatcattgtcaactatacttgtacacatctaggtacaactataagtttatattagtgatccataaaagaactgttaaactaaataatccttcataatcaggtatatggtctataacacagttaaagggacagaagcagaaaatgaccattagaagaaaaattatggtaatttagtcatcatatacatcatgatttgaacataactaacaatttcattaacacaaaaattctaatactaaaagttctttagctaaataattaaccaaaatttatttccacagccaaatcccagcccctggcaagttttataatatctgcacattttctcaaatgatgaaagcaaatcaacagcattaagccaaatcaacagtttaattacagctactctctatgcaaaatccactgcaaccaagcaggtcacagctgaggttgctgtgtcacctcctaaagactgggctgccagaaaaacctcagatcatttgcaagtactgaaacatgaaggaaatttggggctcagtaacagaagaactgatatacttggaacattttcagaaactctttcctatgccgacccttactcatcttcctgaagacacaaccactcattcattcagtacttctggcttgctcactgtgtaccgggcactgtgctaggcatgtggggaggggacagttgggggcagagtcatatcagacacaggcacagcccctctagaactcacagacattctcagacctaagcataaattcagggcacagtcctatggaagtaaagggcttagaatcaaaatgcagatacattaatatgcaaatgtgcttttcataagaacatatcacaggttgcacacgctcaaattacacttgggaaaatgatccaacataactgacacacactattacaactccgttcaaacacctatcccagggtcccacagccagggtaagggcaggggaactgtgcaaaaccatgctcagtagagcccaacagagcctggaaaaagcaccaggaatctgcaagacccagctctctgaccctgaagccacttcacactcagcttcaagataagcctcatatgacattgataaattattaaatctgttgattgcatggcagatcaggagccatagagtaaaaggcactctacatggatataaaaacacctttaggcaagagacagatgaactcaaggtgagatatcaacattaacacaccacatgtttttacactttaccatatacaatttcaaaacatttacaatgagacatgccttaaagttttggtaattaaggaaccctcacacacagagcagtcatgagagagattaatcattcagcaattatttactgagttcaacagctgagcatggctgttgctgggggagaaaaggagaccccaggagtggtgggaagaacaggcacaagtgctcctaatacagatttccatgcagaggcagggagttagggggagagttgagagaatcagattacaaaaacagttctgccactacctatggcacaaatttggcaagctgctcagcccctctgagctcccatgttctcatctgtgaaaagggagatacccacacctacctcacggtcactgtgaggattaaatgacagcagttatggtgacgtccggcagtataactagactgtactaatgtaaactgggcttcaccgctcaggaaaggggggagcctttctgtgcctcagatttcctcatctgtaaaatggtgataacagtctcttaaaaggtggggtaaggattaaatgagtaaattcatgcaacgagctcagaatggttggtggcatctggcgcatagtgagaactcaagacaagtaggctcctatcactgctatattcctgatgctataagagggaaacaagatggttgggggaaggtttggaaagaagaacaggatttcaccaggaaaggctggtggggtagaaggcataggcgtggagcaaagggagaaatcacagaagaggcaggagagtggtatgggagacctgagcccatgatggcagccacacccctcattatctgtttctgcttcactcagttcctgagctactcacaaacatcgcagaaccctctcaccagctcaaacacagccagaggagtggaaatcggagctttcatcatggggcaggtgcccaagatgagccctggacacgctcatgtcccatgggactcttcatatccccagccttgcccattaccacctccagcctccattctctgccggggatgtctggtaccctggaaccagagcccttttctgatgccatttagttcaagctccaatacagcccccacaccatttcatatggaatatatttacttttttgaatatatttttgcttttacagaatattttcacaggacataattttttaaactcatccctgaaaaggactactatttgctatcaaaaataaaaaggtcgagattgatctctccacgtttgtatacatgtgcctgtgtgtgtatacgtgtgtgtgtgtgtgtgtgtgtgtatgtatggggagggtggagacagcaaaaacaccaagtgaaaaaacaaggcatagaattgtacataatacaatcacactctgtaaaagaatggataggcatatatgccagcatgtgaataagcattcttaaagaatacagaagaaaatgtttatggtgatttttctttggagaataggactgagaaatctacagtggaaaaaataccaacttttcacttactgcacttttgtatgccttaagtttttactatgcatgtatactattttaaaagctgttttttaagtgagttttaaaaataaacaaaagatcccatatcaggagttgattctgatgcctaaataaaagtacgtatttctgatacatagcaagctactgataagtggcagctgcctatggctcctgttattatttgtattattatcatgtattacggttatttatgtgcatgagatcttccctgtgaggctgtgagctccatgagcacaactcccatcagggctggccctggagtaacagcgtacacaccagctcccataaaggagttcatcactgcagacttactaaaccaacacccacaggaatgaatgacctgaccagcgaccccatcattgagggagtaaatgcatccttatctccattttgcagatgacgaaaaaggtgtcatgtaaaaaagtaaaaaaaaaattaggggaggagctcaatcaaaatcaaaatcccaaggctccaaggcagaacttcccatcagcaagcattaaaacacaataggtctggctgggcacacctgtaatcccagcactttgggaggccaaggcaggtggattgcttgaggtcaggagtttgagaccagtctggccaacacagcaaaaccccacctctactaaaatacaaaaattagctgagcgttgtggcaggttcctgtaatcccagctactcaggaagctgaggcaggagaatcacttgaacccaggaggtggaggttgcagtgagctgagatcgtgccactacactccagcctgggtgacagagcaagactctgtctcaaaacaacaaaaaaccgcaatagatctgacttagtgctgaagactaagagagaccccagtaaaaactgcagtgggaactactaagatgtgagctttctaaaacaggtcaacaacactatttcattgtacacatatgtatgtaagtttctcccctgacactaatgaagtcaccctagaggcacacacacatgttcatggattacaaacatgaagcgagtaaaaaaaagaaacacattcataaatatctacagggagcacacgcaggagagtcctgctacccagccaaagcaggaggcaccatggagctggcgggctgatggctgacaagatatcacctagttgaaggtagtctcctccacatgaccttgggcaagttattgatcctctttgagcctcagtttcctcatctgtgaaaatggggtgatccaggtacctgtgatccacagagtccacttcggggattaaatgagagtataggtgaaaaagtaattagaacagcgcctgacataaaaagcacttaacaaatgttagttgtgtggtttttgtttccagtattattaaacaaaaaccatagccagagaataaacacaacacacacacaccacccccatcccaataagaattatgtgccacctcttatgaaattttgcacagatttctatcatactatttataatatatattaaaatcactggtgtacagatctgtccctcttcctttgaactgggtatttcctgaaaccaaaacaggttcttagtacctggaaagtgctcatatgtgtttgtttaaaatgtcaacatggaatgaaaaagtttaaatcatttggactaacagagtgataactacaagcaatattctgaaaattgaaattcagtttctttttcttgatatccttttagatagttcaccacaaaagtagtatctataaataaagctaacttatgctctgaggtctactaatatactaaaccatcagcactatagcttctcttgatggtcattcaatttcatttctgcaaagtttaagcctgcacatttgagtaaatgaattcaattcatcaaggagcccagcctacgacagagctactcagagatccaatcaacagcttctctctggaataaggaaatgtagactccctttaatgagttcacttgctggaatcagttctttttctcacagattagggcaatggagcacccataaaggaattgacaagggaaactctagctcatttccaggaactatgatagaattctgtgagtgaagtaactactacttcaatatctctgcgaatagatggtgagattgtgagctccaagagtgcattaatcacaaaccttattctgtttctgtatagtgcaatcacatttgtcctcagatgcaactgtgtggttcaagataaaacactgtatagtacaatgcttattgtctttaaatataagttccatccatcatggaagccagactcattcctcacctaaagccagtaatatgtcttttggataaagtacaaacttagggagttaattacttcattacattgcatggcccatccattataacaacatagctatgactggattcagctatggtagtcattcaatccaacctcatttacaaaacacagtttgtacctactgcctctacagagactgtagaaaaatggttttagaagccattcattcatgttctaggaactgtgtaatgagtgcctaccatatgtcacacactgtttcagatgctgtggctactgaaggaaagaagatagaaaaacatttttactcttatggggtttaatactcatatggagttagtgagagtagacaaaaaacaaataaacaactaatttcagataacaatgttttattaagaagagtgaggaagacctttctaacaaggtgaaatgtgaatgatgagaaaggggcatctgtgaagacttcccactgtatggaatgtaacgtggctgctctgtacgtgttcatgtggagctctgtggaagccatattgatcagtttgccacaaagccacagccaagacaggtaatgaggactcgaactcagttcctggcacccaaatccctgcatcccaagatcactagaaagatcttgtcagacttttgggtgcagtttagatacctggggaaaacctctgttgttttactgcctatgaacacaaaatggcccccaaaaaacctgaaaaaaaaaccaatataacaaattagactatttggacctctcgtgatcttattaaaaataatatcacttctctaaattttacctgaggaggagtgagctacaaaggcctggaaaaggtaaccaaggggtccatagatggagtggactcttactgcatacaggccacctggcgtccactcctcctttcctctggcagtagaatactcttcaggaactgttaagggataagcatctgtcccaagctccgctagtccaagtgagtcctgggggttgtgcaagagttactagagactttttttcctgctggatttgaacctggggtcttgtgaggcctagctgcaacagataagcctggcagagagcagagcctctttagagcagggatgtaggaagatggagtaagacacctggtctctatgccttcatctgagctcccagatcaacccaaacctaaatccaatatgctctcagattctccaattcctttgttaataaattgtgcttttatttcttataataatttaagatggattttctatcacataccacagaaatagttcaagtacacatattaggtacattttccttaatactaaattattgagaacagaatacactttttaacatatttgaagagccacttgtgaagaaatctagattgttagagaaaactgaggtctcttctgatttccatgaggtaatttatttgatacatattatgtgttcatattggtgctagctcctatggaggatgaaatggataaaacattgcctccttggactcaaagtgcatatcctacaacctagcaccgtcaccaatgttttactgatccatagcactttattggttatagagcacctttaaaacattgaacttcaggtccgtagaattagactgaattgatcaaaacccctggccatgaactctcatcattactccatgaatggcccctttttatcaagtgcccactcacatcatctcatttcacattcacaactggataaaaatattgagattctggccgggtgcggtggttcatgccagtaatcccagcattttgggaggccgaggcaggcagatcatgatgtcaggagatcgagaccatcctggctaacacggtgaaatcctgtctctactaaaaatacaaaaaattagctgggtgttgtggtgggtgcctgtagtcccagctactcaggaggctgaggcaggagaatggtgtgaacccaggaggcggagcttgcagtgagccgagatcgcaccactgcactccagcctgggcgacagagcgagactccatttcaaaaaaaaaaaaaaaaaaaaaaaaaagaattgtgatctgagaaatcacacaaacctcaccagatccagaattttaactgtgtaaaagaaggggtgtatgagtgtatattagtataaaagaaggggttcctccaatcacactagaaggaaccacacccaaatggctggtgtgtttgaagagtagaactagaatagacacttcaacactaagcatacatccacagtcctgggggttgtttctggtctactgctaatttggcatttttggatgtgcgcattttaaacaggttttgtacagattcagaatctgcatttgctaccttttttttctgcacgtactgttacttacagacacacttacatgttcaagccagacttaaatcaaatttttccagtactataaaagatatcttaaagtattcatgaaaaatatttttttcaagagtcacttctttaaaatgtcattattgcctttctttaggggccttttctttttgcagatcaataataagtctattgttcctttcttggttccattagttctgactgaaaagtcaaacaggtaagaaaagacacaggagttttatttgtttaatctggaaataaaatcacctaaaataaataccgttgaaattttttcaggtaattgatttctacttctttgcctgaaacagctctcctcttgtttttttggcatgttaatttggtggagtagtttcactttataggaacaatgctctccaaaagaattaatgttctctggcattggctgatcaatttgaaaaaaaattgtcttatttatcttaaaatagaaaatcctcccccacactatacaatacaggggtagaggatataagatgtctttttacaggaacgaaatgtttctacagtggtgaatgttcacaggggaaataagccatggtttgggtgtcagatccttcagacaccaccagtagaactgggtcagaggccctgtgtccaaggagggctccattgccaggcccatcacttacagctggtactagcagtacaagatgcagtgatgccatttcccttagaaggataagagctcaatgttggaatgtttttcttctactcataggcacagcaggaaacaaaaccgtgatgaaattccataaacaggcaagctgggtatggaagaaacgtggttgatgctggcaaagagctgcacttatggccaacaaaggtgaaaaacagagagaaattgtggcccatgaagccaccaaagacagtaaaaaagaagagtgccatgatgcaaagtgctccatctatggagtcacccaaggcaggtctaaatcttggctctgccaccctccagctacagtgctcttaagcaagacaaaagtaccaaaagcccagcatctggcatatcaatacttcagtggtagaggactccctacctcccccgttacattcactttctgtgatgctctttggtgtaatcatagtcctatgtcttccaagatttatcttaatttttatgacatttaagtacatgcaccatgactaaataagtgagtatgaaatttggaattccatcagcaacctattttttatcaaattagtttaactaactctattaggacccaaatagatcttaaagacaaatttatctggctgtgtcagagtccattgcttgccattttctgttcagtaccactgtctgtacataggccatgtgtcctaaaaaataagctggaccctcaaaaatgtcgcactaactcttttcccccaaagagccacctcagcacgtctaccacactggcctcctagctctactttttttctagcaaagcttcagcccactgacttttaagatattgtaaatcagatcagttttacaatcctgctcttgtggctgggatcaggaatatgagcaaaggaggccacgagaaggaatcacatgtgtaaaaggtggcttgaattattattttttaaaatatcatggaggcttattatgagacaaatcatcaagatagctgacaatagatataatgttcagccacttcaggtctttgccttttctgtccacactatatttatttgcacacaaataccaccaatgccactaccactgtcactagtcccaattagccttattgttctccatagcattgagcacaactagtcattccacgtattttacctttttattttctttatcttatgcctcattctaccagcatggaaactcaaataaatcattgatttgtttatttttcatttgtgcaccctcaatacctaaaacagtacgtggcacagggcagggattcaaaaagtgtttgttgactgaatggtcagatctattattttttgagacattctctctagaaagactatcatggggagtagaagctaatataataggaattttagaacaaagcatttcagagaacttttaagataagtggtaaaaatgtttatctacaaacaaaatatccagatatcaattcaagcatggtttttggtattgttttccaccattccttcaatgaatacttacagcaaaaactcctatacagctgtcttctataaccctgtggctattcagacccaatctacccatgagctacatgccagatataaaagcagctatggatgatctagtggcatttgcatcaagccccatgccactacctcactggcttagcttccaaaccactggtattttattccatgtccacctagtttctgcctcttgactgcctcccattttcatcacagcttgcatcctctgaatttgttgacttgatgctacttctaggcttgaccttcactgttcatcaaggtttctaggttaggcacgttccattaaggatcctttccacacatgtcttccttgggtagacaaaggaactcgaggtccagtctctgatgaactacactcgagtacaagtgcacctgccaggtccaccttggtccctactactgggttcagggatttaaaccacaacactatttcataggtcaccaacttgaagacacatgaaaatctggttcaaattaaccatgaactgaaggacacctccagtcaatatgtcacacataaaaatcctataggctagtgatttccagcctgggctgcaagaacatctggggaacctcagcgattattgcaaaggagtttgtgaattcatacgcacatctgcactgttagtgaactgaaaaaaaaagacatgactatataacaacatatgctttgccatgtttcagcatcaaatagatgctaccatgttttatcaaatacaagcatattgaaatgtattgattaagttacaaaagtttgtttaccttacgtgtaaatcaatagatattaaaggtccaaatgaagggttcaaaaatattttgatatcataagacaaaaaaaaggctatagattcctccaagttagataatgatgactagactcttaaccaagatacagaataatgcaagattatgggggaaaatatggcagattctgcccaaaatgaagaatcagtgactagatttatcctcccataagaaacaatctaaaaacatacaaatacataaaacaatggctttcaaaacactggacatcaggccacaaggaacaggcaatgaaggtttgcattggagatatgcgaaacaaagacagggagccctgtggttgccatagcttactgccttgggaaggtttccagggctcagtccaacacaagtaacccaggtggagcccagtgaactctctgagtcaggagatggagttggggttccaggaagaccaaggaagttagaattcacaggacagcataccagagaaaaaaagagctacataaagagagctaaatagagagatctgcaaagaatcccacttgagtatccagctaagtaaggatgaacgcatgcatatgagaaagacatggctgcttttgtactacaacatctgagtgagtagttataatggagaccctgtggtcctcaagccaaaaatttactaccttgtacttttcagagaaaaggtgccaacctgatcaacatcatacttaaaggtaaaagactgaatgctttccttataagatcagcaatgagacaaggatgtctcctcttactgctaatattcaacattattatgaaggttgcatccagtgcattaaggcaatgaaaagaaagaaaacgtatgcagactggaaaagaagaagtaaaactgtctttatttacaaacaacatgacattttatgtagaaaacctcatggaatctgccaaaaagctattagaactgatcaatcagtttaataagcctttaggatatgagatcattatataaaactcaactatatttctggatactataaatgaacaatcagaagttgaaatttaaaaataccatctatagtcatataaaaaatctgaaatgctaataaatctaacaagagattgtcaagacctgtataatgaaaactacaaaacatcgctgaaactaaacaacatctaaaataatgttgagatacacctatgtttataggtcagaagacgtgatattgttaagatattatctcctcaaatctatctatgattcagtacaatccagctataacaactgacaaactgattctaaaattcatatggaaatgccaaaggcctaaaatagccaaatcaatttttaaaaagaacaaaggggaactaaaacaatctgatatgaagtcttattataaagctaaagtaaagaaggcagattggtattagcatcaagatagacaaataggtcaatggagcagaatagagggtcttgaaacatacacacatgaatagaaaactaatttttaacagaggtaaaatagcaattcaatggagaaagataatcttttcaacaaatgaggctgaaactaccggatttccatgtgtaaatttccatattgagtttcaaaccatacttgccaccacataaaaaaatcaactcaaaatgaatcatagacctaaatggaaatcctaaaactataaaagttccaaaagaaaatgtaggagaaaatctctgtgacactacattagtgtgcaatgtctgccatagaaaagtatcacaaaccaggtcactataaaatcagaaatttattgtcttacaattatggaggctagaagtccaaaatcaaggtgtcagcaaggttagttccttctgagggcagtgaaggaaggacgtgttccaggcctctctccttggcttggagatggctctcttttccctgggtcttcacatcagtcttccctctgcacttgtgtctaaattcctcctttttataaggacaccagtcatattggattagagcccatcataatgacttcattttaatttggttacctctgtaaagactccatcttcaaataaggttacattctgcagaacaaggggttaggatgccaacatcttttttaggtggacacaattaacccataacagacatcaaaagcacaatccatacaaaaaaagaaactaataagctggactttattaaaattaagaatgttatactcttcaaaagacagggttaagaaaataagaaacaagccacagaccacaagaaaatattttcaaatcacaaatctgataaaggacttgtatctgaaatatacaaagacttaaaattcagttttaaataaattaacaattttttttttttttgagaagaagtctcgctctgttgcccaggctggagtgcagtggtgcaatctcagttcactgcaagttccacctcccgggttcacgccattctcctgcctcagcctcccaagtagctgggactacaggtgcccaccactatgcctggctaattttttgtatttttagtagagacagggttttgccgtgttagccaggatggtctcgatctcctgacctcgtgatccacccacctcagcctcccaaagtgctgggattacaggcatgagccaccacacccagccaaattaacaaattttaaatgagcaaaggatttaaacagatatttgaccaaagaagataaaaaggtaataagtaagcacatggaaataccctcaacatcattagatgttgcagaaatacaattattaagtcacaatgagaaacttttctctattagaatggctaaaattaaaaaggctgattgtgccaagtgttgacaaggatatggagcgactagaactctcatatcctgctgatgggaatgtaaaatggtacaactttggaaaaaagtttgacagtttcttaaaccattaaacatgcagctactatatgatgtagccattccacttttaggtatctcttctagagaagagaaagcctatatccatacaaaatcttgcatatgaatgttcttagcaactatattcataacagccccaaactgaaaacaacccaaatgccagccaacagtgaataaattagaatattgtgatatataagccatataatgaactagtattccacaatataaggaatgaaccattgatatatgcaacaacatggatgactgtcaaagtagtcaaactaagtgaaagaagtaagctgcaaaagagcacactatatgaatgttaatttcacataactataaagaaatacctgaggctaggtaattcctaaagaaaagaggtttagctggctcatggttctgcaggctgtacaggaagcatgacaccaacactggcttggcctctagtgagggcctctagtgaggaagtttacaatcatggcagaaggtgaaggaagaagtcattgtatcacgtggtggcaagagtgggagccagagtcaggggtggagataccagactgttttaaacaacccaatcatatgtgaactcactgagtgagaactcactcatcaccaagtggatgtaggaactaggccattcatgagggatccaccctcatgacccaaccacctcccaccaggccccacctccaacactagggattacatttcaacatgagatttggaagggacaaacatccaaacccatatcagaatctgtgtatgtaaaattctagaaaatgcaaaataattgacagtgctggaaagcagataattcgttgcctggggataggcatatgggggagagggaggcattaaaaagggtcatgaggaaaattttggaagtgatggatatgatctttatcctgaatatagtgattgctttggtgtatgcatatgtcaaaacttattatacactttaaatatgtgctatttattgtatatgtaatcaataaagctgattttaaaatatgcattccacagtcaaatgacctactatttcaagtcctggctctacctctaactttgttatcttaagcaagttatctttgagcctctcattttccagctgtaaaatgatcattcataacatacatttcacaggattattgtggatatcaactgataactaattcaatccctgaaaataaaagataatcaactgtagctattaatcataacaacaataaagtcccttgttcttagtttctaatgtcctgtaaaagcaaatttgaaagccaagatgtacaactcatatttttagaacctgaaaagctgagtcttccccactttctcattcagtgtttcagatagtgttaatatacacgagctctgataaggtaaagagtgcactggaagaaactcaaaagtaagttttttaattatctaaaatcaaattttcaaatatgagtcatgatctcccctactagaaacacaaacagtttagacaataatgaagtaccagcaaaataacactccttatgcacgtgtgtttgaaatgcttgttccctggtgccataaagaaatagtacttgaacataaattttctcagcaaggccatttttactttctgcagaaaggtacacttgccagcagttttgccacaagaatacactgaagaaaggagacagggttatttataacttgacacatccaccctactgctgtgtctggtttccattggctggaatgggacctcacattctgtatttgtcctgattggctagcaacttagaactttttaaaagaggcaaaggcagaggagaataaaggaaggacgaagtaacttgtggaatgctgagaaaggtaaaaacatctccaaataaggaaaggaacaggctatgacctaatgcttgcttggactggtataagcacgccagggcaaatattttggctaaattgtgggagctaaggacacaaagtacattgatttatttattgtggctagcagatacctaagaatgttagcacaggtctttgaatacattttgcttctaagagaagttattatttattcttaattagatgggaggaaagtctctttgaagaggaacctctactttactttttacatgtgggccttcctcagctgcagttggtaaaactgcatttccagttttaaaaaatacacacacctctcaaaagaatttcaacttaaagctcttttacatatgtgctgcttagcttagaccctcaagaaagaagacaaagaaagccctaatgagttatccctgtcccatagaccacgtgggtggccctgtggggttatgcaaagagactggtcgggatagcaccttcacaatatgtagctgaaagaccagacccagaaaaaagtgcaatgcactgcaataattggtaaacaggcaagacacacaagtattttcctgagactctggaaaacgaaataaggaaaactcacatgccaaaggtattaaatgtcaagtcagtaagaagatagtctgaaaacatttaaaagctataacgtcaaaaaaaaaaattctggtacaatgtgattcaaaagatcaccctatcacagcagtagtttctgaaaaagtaacattgttttaacgcccacaaatctagtttgtgtagaagcatacactctcaagaacttttatttactgtgtcttgaagaaatatatgtctttttttttatttattttaagttctgggatacatgtgcagaacatgcaggtttgttacacaggtatacatgtgccatggtggtttgccgcacctatcaacctgtcatctaggttttcagccccgcatgcattaggggctctccctccccttgccctccaccttccgacaggccccagtatgtgttgttcccctccctgtgtccatgtgttctcattgttcaactcccacttatgagtgagaacatgcagtgtttggttttctgttcctgtgtcagttggctgagaatgatggcttccagtttcatccatgtctttttaacgctaattggataatgtgtgatttttctaaccaatggtgctacaaaagtccctatgatctcatacacattaagtcatttgtatgtgatatggttaggctttgtgcccccacccaaatctcatcttgatttataatcccattatccccataatcttcacgtgtcaagggagagaccaggtggaggtaattgaatcatgggggcagtttcccccatgctgttctcatgttctcagttctcacaagatctgatggtttcacaaagggctcttcccactttgtttggcacttctccttcctgctgccctgccttcctgccttgccctccttcctgccttacttccctgtcaccttccaccatgattgtaagtttcctgaagcctctccagtcatgctgaactgtcagtcaattaaacctcttccctttataaattacccagtctcaggaagttctttacagcagtatgaaaatggactaatatatcatgtattcatgctaggagcaaattcaaatgagtttaaaaaaaaaaaaccacagggaggaaaatattgctgaaaaccatacaactgggaggagacactaattctccaccccaggtggcctcactactgacattgttaacgccaaatggttaagctgatgctttatttccctgtcagttaagggactacaagtaatcaatgtttaagataaaacatgcagcggaaataaaaaggacaatttatatgattcctcatatttctgcctgccccccaccccacccaccaccaacgtctagctcatggaagacaagagctagaaacaattttttgacctttgattttcaaacacaaagatgccataaagaaaaagatgtatattttttgctgataaattttgccacttggaaatttaaatcttctatacatcaaaaaattcccaaaaattttaaagaaaaatgacaaactagaggaaaacaccaaaaaaaagatacatggttaatattttagtatacaaggagctttttcatggaaatatgggtaaaaatatgaataggtaattcacacaagaaagattataataatcattgatacatgttcaatctcactgagaatcaatgagattcacactaaagtgataagaggcaggactagactccagaggcagggctcagacactggaccaaattgaggactagctaaaatagggacaaggcggaaacggctttccataagacacccatcagtatgccatgtcagtttactattgttatggcaacacccagaagttaccaccctttctctaggaatttctgcagactgctccttaatttgtatatagttaaaggtgggaataaatatgactacagaactgtcctgagctgctacttctcagcatactccctatggggtagccctgctctgcaggagaagtcacggagccataacactgctggacctataacactgccagacctataacactgccgctttaataaagctgttttctttattagagaaggaaagaattcaaaggctcacccttgaattttttccttggcaaagccaagaaccttcccagctaagccccagtgggagcttgcctaccctgaatcagtatcagagtaacctatcaattataaaacattaattgtaaataagtagaaacttcctagagaacaatttttcaaaatgcattaaaaactttaaatgtttttccatactctttacatttcttctagaggaattttttcttatcttaaagaaaacaatggaaagaatataaatagaagtatgtgcaaagatacatacatcagaacattgtttataaatgaaaaactcagaagcaacctgactgcccaataacagtggaatggttaaatcagtaatggtgcagacatgaggtagaatattatgtagccattaagaataatgctttagatatagaaggaaggaaagttagtaatgatacatcaataaagtgaataaaatcaagaatgtatatgtagtctaatcccattattataacattttttgtacagaacaaagtttggaaagctatacatgaaaattttgacaatacttctctggataacagaatttgggctgttttaaaattttcctcctcctataaacaagacacagtcaggcacagcatgatgtctaaaaacagagattctatagtcaggttgcctgagttcgaagcctgcgtccaacatttactacctgtatgacctttgccaagttaatctttccatgcctcttcatccttaagagaaaaatgaggataatagcagtacttatttcatagttactgggaatgctaaatggagatcttctagaatggtgcctaacacctaactgagactcaataaagctaatcattatttgttaacctgtgttactcatatggcaaacaataattatgagaataattatgacaaaaatgccttgacattgacaagagtgccaagataattcaatgagaaaataatggtcttttcaagaaatggtactggctgggacaagcgaacatctgtacacaaaagaatgaagctggatcacaactttacatcatatgcaaaaataaactcaaaatggatcatagatctaaatgtaagagttaaaactataaaactcttagaagaaagcataagaataaatctacatgaccttagattaggcattagtttcttagatatgacaccaaaagcacaagccacaaaagaaaaacttgataaacgggtctatatcaaaattaaaacattttgtgctttaaatgataccatcaagaaagtaaaaagaaaaagcacacagaatgggagataacatttgcaatccctatatttaatgagggactagtatctagaatacataaagaactcctaaaaattattaaaacgacaaacaacccaaataaaaaatgaataaaggatctgaatagacattccttcaaggaaaatacacaaatggttaataagcatgtgaaaagatgctcaacatcattacccctgaaggaaatacaaatcaaaaccacaatgagaccaggcatggtagctcacacctgtaatcccagcactttgggaggctgaggatggtggattgcttgagtccaagagtttgaaaccagcctgggcaacatggtgaaaccctgtctctacaaaaaataagaaaaattagctgggtatggtggtgcatgcctgtggtccctgctacttgggaggctgaggtaggaggattgcttgagcccgggaagtggaggttgcagtaaaccaagattccaccactgcattccagattccaccctgggtgacaaagtgagaccctgtctaaaaaaaaaagaaaaacacaatgagatacaacttcacatcatctaggatggcaataatccaaaaacagataataacaagcgttggtgattatgctgagaaattggaaccctcatacactattgatgggaatgtaatatgtatggtgcagctgctttgaaaaatgacttggcagcacctcaaaatgttaaacagagttaccacatgacccagtaatttcacacttaaggatatactcaagagaaatgaaaactaaaaacatacgtctacccaaaaacttacataagaatgttcacagcaacattattcataataaccaaaatatggaaacaaccacaatgtccatcaattgataaatgggtaaagtctggcaaactcacagaatggaatattatttggtggtaaaaaggagtaaagaactgatatgtactacaacatggatgaatcttgaaatctttctaagtgaaagaagccaaacgcaaaagatcagaaattgtattgtcccatttatatgaaatgtccagaataggtgaatctacacagacagacagtagattagtggttgtgtagagttatgggagagtaggaggggaaaatagggaatgagtactaataagtacaggatttctcttttgagtgataaaaatattttaaacttaaactttgagaatggttgcacaattctgaatatatgaaacactgaactgtatgctttaaatgggtgacttttatagtattgaattgtatctcattaagatgcttaaaaaatgtttttctaatcccttgacaactctgagctttatttcctaagaatgccctttgaagagccagcagtttatagtggtagtagaacaacagcttgaaaagatctcctactgtaccatggaggatacagtcatgttgctatattcacacccccaccccatgccctgactgatacattaactccttattcagtacctatgataaaccaggcatagtgctaggtaaggggcccaaaggtaatcaaaccctagtcaagtttatccttgagtagaggggcaccacaagacacattatgttgttttaaaaaaaaaaaaaaaaaaaaagcaaacatgacaaagtccaaggtccctggaagcacaaggctgcgtggtaagagaaacatcctggaagcagcaatgtgtaagtaaagaactaaaacatgattagagttagtgagaaaatgtgctgaaagaaggaatcaattgtgttctgggcagaaggaatgtgcaagggactggaggtgcacatattgtttgagaagttaaaacacatacaatatggttggtgcacacagtgttcactgtggtgaggaaaggcaagtgagtttccttataaaggccaggcataccatgctagcgagctcagactttagtttgaaaacaatgcagaaccattaaactgaaaaattacctgataacattcatgttttagaaagattattctggcttcagtacagctacatatgacttgaaggaaatacaaatggaagcaaatacctaaattaagaggccactgggaaagaaatgatagtttgaaccatgctattaatggtgtgggtgtagggaggcagctagattcaagaactattttacatgttgaacggacacaactttgtgattgactgtatataggatagggaaacaaggggagggaagggtgactcccgggtttgtggcattagcaactggatgatggtgcccttcactgaagtagggaacatacaagagcagcaaacctggaataaaaagttttaaatacattccatttggatttactaaattgaagtgtctatgaaacttctaagggtggatatataggtctgaagttcagggaaaagagcaagctggaggatgtagctttgagaattaagagtctgcagagatgagatgaagctctgagggtagctgaggtgtcagagaagggaataaagaggaacagggcagaccctatggaacatgggaaactcaggccatggagagcccatgccgggatccctcaggctctcaagtggtctctcttctaccttcagtggtcagcttggtgggccccaggataaacactgaagaaagtggtttttcattcttggcctcaggacatcctaacccttttgtgcaccttcaataagcatttgttccaagaatattgaggaaaggctatatgtcaaggactttcctgggcactgggatatgaagaagtcaacaaatcccctgccctaaaaaactctggttggtcaagggaccaaaaatagacatatagaaattcttcatattttttctcctttttggtgagaaaaaaaaatttttttaagggaaattaattttataaattctaaatttatttttttctgaaataataagcacacaaagcgacacaaggacctgaaaaataccaaagtttcataatgttctttcaaagttggccacttaaaccaaatttcatacataagaaacacagctacttgacaatcaaaacagaaagaaaacacagatacttatttttagggagtaaaaacatttagtgtaaaattgcagttacatttttctgaaaagcacactagagcctcaaatcctggtaagttgcacaatgagataaactgtattcaaacaaggcccaaaagagttcagtcagtgtcaaaaaaattttacacaaatctaaattttactctggggagcaaatcaaaatcttcccaacaacatgaggatcatatagtatttgttttcattgtgattgccaggaacatgaaattcaaagccatgttttgcattgcagaaatttctagaccctcagtctggtaacactcttttgacctgtgacatagttggggcagccatatttctctgctgccagatgctttgctacagaaacaaacaagacacaggagagaaatgccacagtgctagcatatgaggtagctacataagtgacttttagaaagagctccccaggtcactcgtctgtctcctttctaatttgagtgtgatccagccgtactggggccatccatagaactggtttgcccctcctgatagtggttctatccccagtgaagctggccactaaagactgccgagctcctgtgatctctgagccctttctgcctggattttcccacatccatagttgcagatgccttgatgtttcccaaagattttgttgtgtggaaatgaactcttgcagactctacatttattccctaaaatccagggcattgaacttctgacagctttgtaaacttttatctacaaaccccacttcactgacccctctctaaacaaattacacttagtggatgttcctagctttgagtatgttctttccacaataactttctgagaagagagaaaggtagagaagagttagaggatggcattcttgtttatcatttatcaaactcctcagtcatagaacaatttacaaaattagatacccacacaggaagtaaaaacaaacgaaatacttattctgtagttccacttgccttttaaaatagtttttttataattcagagctgtattccttggctgaagaattttgtgtaccaataaaaattatttcaatacattatttgaattccagtcacatctccctctagcattttcagtttatatcatcagctgacatctagttgatgtctatccacaggtagacaataattttccttggaacacaataattttccttaggttcacagaatcctggatctgaaactgaagtgagtcctattgccatttaggaactctacatttacatgctcctctctcaagaaaaaaaatagttgcctttcacttaaaatttctctaaaatttttgtaaaattcctctaaaagaggaatatccaataccttctgtcttaggatgttcttagtatctcaatctaacaatcaggaattttttttaattcctcatgtttaacttaagtacataattaggttgccttaggaacctacaatggctcttaattctttctactcaaagcccctattacagtgtttggtatatagtaggtgttcagcatatatttaatgagagaaaaaaatgaacagagggaggaaaggaagaaagtgagaggaaggaaaaaagaaaagaagggagggaaggagagaacaaataaacactaaaaggaatcaaacatgaatccactactaaggaaattaacaacagagtagcaagaatgttaaatggacataaataactacaatataaagtagaaagtattaaagggccacagacacaatgttggaggaaatccgaagagaggtatgaaatttctagctaggagaaatcagaagcaagtcaacagaggaggtaagacttgaggtgggatttgaagaacaggtagatttcagacaagtgatcagaggggataagtgtcccaaggagaagtcatgaatgtggaaaatcatggggtgatggggaatgaagtggtttaaggggagcacagaaggtggtatcgggcccctttagtatctaggcttataagcagaaatattaataattattcagaatatcatttgaatgaatgaataaatgaacaaacaaatgaataaacaaacaaattaacttaggcctggaactttaaagataaagcagaatatgaatgttgtttctataattattcctattgcaaattacacctctatctctgaaaaggacctcctgggaaagccttctgccatcaaattagatctacttgaaaaaaaaaattaacgacagaattttaattatttcacagtgtttgcatgtcactttattttaatcccagggatatgggaaatcaatataaaatagtttgttactttcctattaccaacacaataatccatccagtgtaattttgctttctttaccttctatttcttttttttttttttaacatttaaaagcaaaccggaagaggctttgctcccactcttcctctttcctatttgctcccaacgatttaatgcacatacacaagactggccaaccaatttgtcagtgaagtactctcctgctggcttttatggctgagttattgcctttaaagaactaagaaataggacatactgctacacaactggtcctggcagaaacgttaactctagaataagacggatagaacaaaatcagtataaaagccagtgggattagtgaaggctttaacatacagcttgcaatggttgaaatctcttatgacccatgatgttggttaaagatcatacttgctgaaaaacaaccttagccactgttactaagttctaattgggttttctctctatagctgtcaaactccctctacaatctgatgactttttttcatacttaagcgcaaatgaattttaagacatacatcacgagaacttaatctctttttaacacaggaacttgtacacaaatgttcatagcagccttattaacagcctcaaattggaaactccccaaacatccttcagggcatgaatcgtaagacaaaattttggcacatccgtaccgtggatgactatttagcattaaaaaggatcagaatactggtatctacagtttatgctgcgtgagaaaaaaaaaagccagtctttaaagaatacatgccatatgattccatttaaaaaacatctgtgaaattacaaaattatagagataaagaacagagtaacagttgtcaaggcttagggatggaggagaggggatgggtgtggccataaaatagaagtgttaccatgatggcacagtagagaggctgttgattgtggaggtaattacacagggctacacatgtgacaaaattgtcacaaatgcaaatgatgtgtgcacaactggggaaatctgaaaaagctctatggataatatcaatgttaattccttggttttgagattgtaccataatcaagtaagatgtgaaccctgagggagctggaaggtgaatacatggcatttccccatacatttctttgtgagcctctatgcatctatcattatttcaaaataaaaactttaaaatatatgtagtcaatttatatcaggatgtgtcatgaggtttctctctcctgagttgaacaatatctaacataaagctgagtgatagtaaggtccaaaataaacactgtccaaagaaaagaagggaggaaacagggaggaaggtgtataaccatccctggtcaatctaaaattgatgaaaacctgatttggggggaaatttataaaatgtctgaagttttcaatatacctttttacaataaggacattaaaatcaacattataaggcaattgtgaaaattaaaggtatatacagatatgtagatttctcaatatacatatgtgtgtgtgtgtgtgtgtgtatgtataagagagctcattttagtaagagcctgggactcaagaagtattcattctcttccaataagcaaaaaaaaaagaaaaaagaaaaataaaatcatcattatattcttaattcctcactctcttactctttcttattgcataacctcacatcttggtgaaattattttctcctccttcaacaactaagagagagcaaagattaaacacaaaatcagagctcttttcatctaggcccatctgcctaggtaggcctaagttgaatcactgaaccactgacacacagttctgtgagctctcggaagctcagaatcccacatacagtttggccacagggctgaaatgttgtagcattttatcaacaaccatgttttgaacaatttaacacccaagctctctcattcctgtctccttcccaaggcaactgcagattcctcttccctcagggaatataaccccactacctttcctcattttagggaactgtaatgacctggacagatggtaaaagaacactggaaaagtgatgtcttcaagtaccagcccaatgagggtatctactcggggggcttaaaatggaacactcaagcacgccaatgaccagcaaagcaggaaatggtcccagaatcactgacagaagaggcaaatttcccagaatacaatcccttcatgccgacccccagggtcaaagcacacagagcagaatctgggccacaagcttggaatcatcctcatgtagagttatcctcttttcagaagatgcttccccatctcaaactgggcttttatggctgagtaaaatttaccttgtgtatataatttacattaatttgtttggcaggctccaaaaaggcagtacaagcgagaggtccaacagagaggtcagacacaagtaacagcttgaaacccaaggccagggtccagatgggtgtagagacgagctggagtgggagttgagggtagggggattagcagaaaccagtggggcatgcagactataattaggagcatgtatgtatttggggcttgaagacattgctaaacagctgaaggacactgctcaggaacatgagaagctgatcccagcaaggctggttgacgtttccaagactggacagaaaacctgaggaggctgggaggagtgggcagtgccagaaaaagtgagagcagcagctctgagcaagcaagtcctaccagcatcataaatgagacgaagagctaggtttgccatggtcaggattttgccacagcagggagaggatgttaagatcagttactggctggctcaaactgacatgcccataattacttactgagcgtccatgtcatgaatggagtgctctatctgtacatacagccagaggtcatacagtgaagatagtgtccctgctccacttctctgttcacaggggagcatcttctctctttgatcataaggaagaggagcagagcacctacctagctgtgccttttcaggccaaccacgtgctggcagcgtctgttccttgtaagaccttcccaggaatctgctctgctaatgaggcccctctacctgacagctggttacacaagctgctatcagaaaacaaaagctgcctgttgaggtaaccaatatttccacacctcacacacaagcgtgtgcatgcacacacatacacacatacacacacacgcgtgcactctccccagtaaaattcagaaaccatgctcggaatgaatcaaccaccaaatggaacaaaggctgcctccaagataattagagtttggactgaactgaattttttctggcttagactcagcattcccacttctttggttgccagccccacagcctacacaataggcacatggggcaaagctggctgcagcttatagttttagatgaaatgctggtaatccatcctctggtctgccatcttctcttatccctcagtagcaaccacagaagacattcactgtcgatctcagaacatcaagaacatacctcggtccattctgctgagacaagagaattccaactgaaccactgatttggccatattaagacagtcttcaccattgcacacctattacaacggccaaaatacaaaaccctggcaacaccaaatgctgtagaggatgtggagcaataggaactctccctcattgctggtaggaatgcaaaatggtacagccactttaaaagacagtttggcagattccttcaaaactaaacacactcttaacatcagatctgggaatcatatattccttggaatttactcagataaaatgaaaactcaggtccacaaaaaatggcagctttattcataattgccaaaacttggaagcaaccaagatgtccttttataggtgaatggttaaacaaactgtggtacatctagacagtggaaaataatccagcactaaaaattaaaaaaaagagaacatcaagctatgaaaagacatagagaaaacatgaatacatattgctgagtggaagaaccaaatctgaaaaggctatatgctgtatgattccaactatatgacattctggaaagtataacactatggagacagtaaaaggattagtaattgccaggggtttggaggaggaaaagttgaataggcagagcacagagagttttcagggcagtgaaattgctttgtataacacaacgataatagatacatttcattataaatttttccaaacctgtagaatgtacatgacccaaagtgaatcataatacatactctgaacttcgggcgagaatgatctgtcaatgtaggttcattgattgtaacaaatgctccaccctggtgggcgatgctgacagtgggggaagctgcacatgtggggatgggggttattatggaaaaatatctgtaccttcctctcacttttgctgtaaacctaaaactgctctacaaaataaagcctattgattaaaacaaaaatcttcagagactgacaaaagtcaaatcaaaaatatgttgacatgcaaacttaatggtgtattgtgtgggtttctgtttgtttgtgcttatatgtgtgtttaaatagataccaagttatagcattctagaagaatgctaaatttaccaacatggaaaaacataagattccaaattcaccacaaatggaatgccactgcttcaattttctttgcaaaggcagaaaaaaaaaaaactatcaaaaatggtaaaaaaaaaaaaaaaaaaaaaaaaaaaaaaaaaaaaaagactaatgggaagaaatttttatcaatcaaaaatcaccactctgatcctctaccaagatgagcctgactgttatgagctgcgttacaaatgactgcaaaaaaaaaaacttttaaaaaaatctgctgtctattaggctaatctagtgattgccattttcctcaaattcttcatttgatgtttccaaagcaacaacaacaaaaaaatctgatgtagcaagccttacactgaaatcatattaaatcttcaaaaaccaatcagaaaaaaagcataggcaagtcttcttgggattcagacttaatcacctttaggtactaaaggtgggattagaacttaagtatgtctctaataaacaggatgatgcaaaatcaatcctggctcactgccagtcttcctcctgattgacagctagagcagggctgtccaacagcaagacaccctgaattgcagacataatttaaaattttctaagtagtcatgttttataaaataaacaactgaaattaagagcatattgtatttaactaatagactcaattatttatcattttaacatgtgaccatggtagccacattccaagggctcaagagccacatgtggctagtggttaccatattgaacagcagatctagacttccagtgtaaatctaacaggtcccaagcttctccctttcaaatatgtatttattcattcaaacacacaaagtctcttcatatgcttcattattcctactactggaggttcaccagagtcagcagtaacagtgcttgagtcacaccttcaatctatgcaaaccataagaaagattaagctctatgccaatgtgaaaaccagctcaacttcagtttcttattgttattattattattactaatttatttccagtatatatccttcccatttctttatcttaatttttattacatattgactatttgtaattatatatatttatggggtacaaagtgatgttataatttatgaaaacaatgtggaataattaaatcaagctagttaacatatccatcaccttaaatacttaattttttttgtggtaagaacgttagaaatttaccctcttagcaattttgaaatgtacaatattattaactatattcactacactgtgcaatcgatttcaaaaaaattcctcctgtgtaactgagattttgtaacctctaaccatcaattccccattccttcccttccccccagcctctgtagccaccattctattatctgcttctatgagcttcgttgttttagattccacatctaagtggaaacaattaacaaggtacggagacaatctacagacttggagaaaacatttgcaagccatacatcagataaggtattaatatccaaaatatataaggagctcaaacaattcaatagcaaaaaaacaaaaagcctaatttaaaaatgggcaagggacctaaatagatatttctccaatgaagacatacaagtgaccaacaaatacatgcaaaaacaaattcacattgttaattattagggaaatgcaaaataaaaccacaatgagatatcatctcagatggagaaaaaaggaaatccttatacattgttggcaggaatgtaaattagtacagtacagccattatggaaaactatacagaggttcctcaaaaaactaaaaatacaactaccatatgatccagcaatcctacttcctagtatttatccaaaggatttgaaatcatcttgtcaaagaaatacctgcactcccatgttcaatgcagctctattcacaatagccaagttacggaatcaaccttttcacactgtttggaaaaacaaagaatttctcaactaaagtttatctttgtgatagaataaatcaagaaataataggtgcaaagccatctagggtctgcaacaagagtggaggtaagtgtagtgaggggtgggaggagaggaaagaaggcagagaggaaagaaagaagggaggggaaaatatcacagcaggtcatagaaattacctcaaggcatcgagtttaagagcaggattcccacattcaatgactttcacccaaacaggtaatgcaacctaggtttaaaaaattgtgtaaatgttgtaaaagggattttcaaggcaatgaacattgattacatgcaccaatacatctgaaagagatagaaagcagagtttagccaatacatttgtgcattttaaagactgtcccttaataaacacaataatgagccttcttatattgctgcaacattatttatcacagtaaagaactcgaaacaacttaagtgcctatcattaagagaacatcccaattaaccgtgatttagccatactgtaaactttttaaaaagaggtacatttctatgagctgacatagaaaaatatccaagctacgggtgagtgaaaaagcaagttgctgaaaaatgcatattataacacacacacacacacacacacacacacacacacacacacacacacaaagtgacaatagctataatctctcaggaggaacctgggataagttggttgtggggatagaggaggaatcaaagaagactggacactttggtcttctcagtagtatttttttaataaagaaaatgtattcagattttacttagagaaaaagaatgattttaaaacaatagtacacaccctcaaatgtgtttatcccaaatcaaaatttaatatattgaaacccaccaaactcatgcttatgcttacctaagaatggagtttctctcaccatgtctatgaatatatttgaacacgtggatatatccttgaatacagagaaagtgttttcttgaattggttattttttaaaaaattagatcgctgaaaatcttctcatgaaaaactgaagacatcagtaggcttctacgtacatgttgatggggtttcagacacattaccgccaaaataagttacctgggcatattgaatattttaagctgaaggaattgagaaacagcatgtacaggaaggactttctgatcttcccctgaagcagggcataaaacttaggaaggactttctggtcaacttcataataaacctatttagaaacttataataaacctgattaaaaatttataaactaaatgcaaactgtggtagatgctattactatctgtgaataaagacctccttctctcctcaaggaaggactatgctcctccactccattttggacttcaccaggagatttgccttgatatatacaaccaccaagaaaaatatttaaaggtgaccaagtggtctaagtttctcttgtcactgtcctctgcaacaagaggcatatcccatagagcctttgatctattttacaactacatgaattgtggataactgataacaacatgaaacaattcctgtccactgacatgcaaatattactttctgtctcgtgaagattcagtgagcttcccttctccactatggaatgtgttttgtccttcatttgcacattccaatctatgaatgtggctattctttggattgtcatttgaacatcattggtagtcataacatcctaccagttccctcattaataatgagttaaataaaatctctaacacatgttcattttatatccaaaagagagtataattttacctttctttgaaaattatcctgggtgcttaaaatgttagataattttactatacactgattccccctaacaaccctatcttttactaatgagaaaaaggagccccagaaagattaagtaacttgcttaaagccacacactgattagtagcagagctggaatctaaactccaggtctagatgacacctctacactgcttcaagggcaacccttcagagaaaggagagaatagggtggaatcagggtattgtgaaatcacagaagtgttaacagccagttccttttttgatcatatgagggaatgaaggcacaaaagtataaagatcttggccacgttgcatagcttattataggcagggatcagaacccaaggttccttacaaccagcctgatgatcttgcgttcaaggaggaagtcaaattagactagggccttgatggataaatagaatcaacagactggcaagatgcaggaaacagaggctggacacatgtgaatgtgaggtatggaaagtaggagaggcccctctaccacaagggttctaggaaatttacacagtggggagcctggaagtgggaagagatggggcaaggagactgtgtccagacgttgtcagagggggccacaggtttgtaccgcaggagaagtactgcttgggggagaaattcctggaggctgtaaaatgagttatttgctttcccagtagtcagagactagatgcttggccacctgactttgtgcacaaccctttgccatctgagcttctgcttcacctgaggctgaaaaagatgacatccaagattccttctagggccaaaaactacaataaagtcaaaagagtagacatacttcctcataagttgatcatggtggcatactctgttataatcacatgtgttctagaaacccaggatgccacatggggcagaaaagccagaaaagcccacatggggtcctggagagaagaggctgcctcaaaggttattttggaggaggaggtggagacctcatgttctaaagaggaaaacaaacctacttgcccttgcctgactgtcaggctgtgtcccagaccagcagggacttcacagcaaggccaggcttcctattctgtgagttcctcacacccgtagagtgtccccatctctctgccactggggcataccctgctcctcacaactccgaggcaagaatcaagttcacagggcatctgttcactgctacgagtgtgtggagacagccactgacaggaacactgattcccaaaaggcacatgtaaatacaagatgaatgcaaagagaaaagtgactggactagagagaaaatatcagctctaccaagaaggaatcgtgattcctgcttctattattatagataaaaacctaccatcttatggtcacatgccgggtcttatgaaaatgagggctgtgcacacagacagtgccctctccacacctatgcaccaacctgtggagcctccctccccaaagaatggccaagaaccagggcatcagtaaccgttagacatgcagaatctcaggccccatcccagctctgcgggatcagaatccacgttttaaaaacatccccagatgatcacattaaactttttgagaagtgctgtttgtaaggttcctgtgagtaatgcagcagcaaagctcgggtacacaaggaaagactaacaagtgagcagagagctggagatggggaaagaccagaccatgaactggagatcacaagctctcttaccaacacaataattcagaaggtgacttctcaaaactaatcttcagctgagatcagctgacggagtaagaccttcccaggatgaaaggagggctgaatccccaggcagggcaaggcagaagggaaggggcagactctctcttgatggcatcctagcagaatcaattgttagttcccaaagctgtcctagaggcgtgatgctctgtggtgcatttgctatctctttgtgactcatccacagatgaatgggctcaaagaaaagggagaagcgagccatgaaatatagtaaattacagcttaatcttcctcaccctggaattcattcagtagttttaatgaacttacagtctggaaagcatgttgaagaatgtatatggaatatatttcatgccactctgagcatcaaaggagcgcaattccctttgttattaaggggataaatgtccttccttcagtcagtaccttggcaaaaaaacaaaaaacaaaaaaacctgttttccattattgctgttatctactgcaaaactctaaagaatacagattttcaagaagtggttcccgagcacagtcagcttcctgaccttgtatcttcaccctgaaccactgagacaaataggggaccctgaactgtcaccttgaaactccaccaggttctctctctgttggctacctcctttgacttgacccacagacccaagagagaaattgtcatggcttgcttctaattcaggttggaggaaaacccaaagacccctggaaggatattgagttatctccagaaaacaaaaacagtaccctgatttattaacgtacttatatgcattaatatatgtccagattagacctggacatttaaattcatccccaaaaggatatagcttatgctctgatactctactcccaccaaccattatcagtaattttcaaattatggactgctctctatcagtagataataaaatcagcttactgggttatagccaacaattttatgttaataaaatagaataggaaaattagacttaatcagtggtagtaagatgagagactgtgtgtgtgtgtgtgtgtgtgtgtgtgtgtttgcacgcataatgtaaagtgtatttttttactgtgtgtcacagtcaaaccagcatacagcacctggatatcaaccccttactggaaagagcagagagacaacatgagcaaagaactggaaaaacaggtttccttcatgaacttctaaaagcaaaatgaggaagaaattaagccctcttgtggcccaacagatgggctggagcttctggttaccctctcccctactcacatcccccactccccctacccattatggctcaatcagaagccacatcccataaatctcacaagaatgaagaaaagctgatttgtgctgcacagatttgtgcctcggacaaagatgccaatctggtggatggattccccttagcagtgaaaaaagaggctgagcgatttggagatcctattccttggcacagttttcactgaggtccccattctctacaaaaattattttccttttctccccaaggtgtgttcatggtagctcccagtcatgcttggcttcaaatgcacaaaaaatctaaacaggaattaaccaaacctccaaacagtactgatgtgaactttaatgtaaacactaagtcataatcccacctttgtcactatatcccaatacctccaaagttaaatacagaggcaaggtagcataagagttaagagattggggccaaaagtcaaattgacctcaattgaaccaagccccatcatttcctgaccttggaaagttacttatgattatctaagactcagttttctcacccataaaatggaggcaataatattatagcacctatcccagaggagttaataaaaattaaataagtgtgtaaagcatttatctcagtgccaaggacatgattatcatgcatcttcaagtaatattatggctatttttattattacaatcatactctattatttaaaggcaaagtttagtttctcctcagcctagtgacagagcaggagcattgccctcttggaaaagcaccaacattttaaagttccccttgatcaaaagccaccgaaatccaacccaaaggacatcagcctaatggctaatgtcagcatgaccataaactacaaatgacatctccaaccagaagcattccaaccctaagacaaacgcctccacaaccagagacatgcctgccccaagataaactcccctacaaccagagacattccaaccccacaataaacttctcctccacacagaaacattccgagcctgtgataaactctctcactctgaacccctaaatactcttagtctgtaagagagagtgctcctgaccaaattggccagaagcccctctcaggtttattctccaaaataaacctgtctttgactattgagctgcttttcacgtttctttcctctttctttaactcttacacctagcttgtttgtttggttgttgtttgttttgcaatcaataccaatggtataaatttaaaaggaagagaataaagaaattatattttctgatcaacgtttgttgtaaatgatttatacagtgatgggtcccaaactaaatttcccagggaattccctatttccttgcgggggtaaagagcatccgaattatttgctcattaaatgagttgccaaaagccagaaaatctatgcatctgagagttttcatctcaagagacccaggagctcgaaatcctagcagtatgaatcatctctgtccaagtgtatagagtctattagcagagggcagctcttgcttctgatggcaatggatgccagctgctgctgagaaaacaggaaaggtaatcccatgtttcagctttaacgtgcctggtcaattgtgaaaactgacttgaagggagagaaatttcatcttgacccccttggataatgaacaagaaggacagcctggcctgtgaaggaaacaccagagtggggcaagctcagagaaaattcagccaacatagcagtggaatcatgctctttaagtgtcaggccagcctcacaggtaccacactttttctaaacacaggtttctccattcacaaattgtttacttcagaaatgactttttctcctataaatggaattcctttgtctgagaaccacatacgcaagaaacaaggatgaaggaagagccatctaaactaccaggtcagctacattcattcattcattcacctgccccagcatatccatcctacgggtttactaggtaacaataggggtatggatgaggcaacagggatgtacagagaaagaaagtgcttagagtgagttgtatagcttaaatgctcatattagaaaagatggaaggtttaaaatcaatgccctacgtttcaccttaagaagttagaaaatgaagagcaaattaaacccaaagtaagtagaagaaaggaaataataaacaaaaagcagagcacaataaaacataacacaatcaacagaaaaagttaacaaggacagaagatttttaaaaacattaataaaagtaataaacaagtagcaagcttgatcaagaaataagagaaggcacaaattactaatgtcccgaatgaaaaagagatattgcagatcttacagatattaaaaagatggcaagcaacattatgtcaatgagtttcactacttagatgaaatgaacaaattccttgaaaaaccacaacttaaccaagaatgactcaacaagaaatagaaactctgaatatccctatacctattaaggcagaggttatccacatgtagctccagcagaaaggcagcatcagcaacacctgcaaactttttgaaatgtaaatccacagctctcactcggacctaccaaatcagaactttagagtgggtggggtgggggtcacagcaatttgtgttttaacagaccttgctggtaattctgataccatttgagaactgtttcaatactatcttcctacaaagacagacagatctagatggtttcactgatgcattctatcaattacgtaagaaagaaatcataccagccttacaaaagctgagaaaatttaaaaaggggggatcacatctcatcatttactgtcaatctctactcttttatggaagttgtaggagtctttattttccctgattcttattttaaagtgattcctggtttctttgaaatgggccattctgacagacaagtggtccacatagcccaaatggccacactgcatgttctcaagtagagaaaggtctttattaggtgttttctgtcttttgcttgcagcccttaggggagtgataatctagttcacgataaggtaattaaggcagggagttgcccctcacccacaaggatacccacagcatagcaatccttcccttctcttgcatacaaacctcactcaagccagagcagggactgggactcagataacaaaagcggtgataaaaatgaactatctgctcatagtattccttctaaataaaacacccataccacctttccacatctggctgtttttcttactcatccttaagcctcaggtgtcatctacagaaagacttttctgaacccccaaactaagcagatgtaactaaatctttacatctttatccaagaacttaatattgaaattctctatgactttgtacctttgtcaaataacttatattgaaattacctgtctgggtcctatatctctccaattatgtcattagctccttgagggcagaaaccacatttcattttttgttttggttttggtttaatgtctcacagtgcttgactactaattgcatagttccactcagtaaacctgtagtgaaatgaagagtctgagagtggagtcaggtcaaaatttacctccataaataaaatacactcaactcaaaacattcagtatgacttatttttaaaataagtactttcaatttgttcaatctctcagtagtattattaatgcaaaccacatggactgactttcattttgcaaatctcacctaccctttttaaatatatggtggaaacataaggtccctgcccacagatctatgcattgcagagcctactagaagataaatacagggatcaaaagaataacagtagtaggtgacacctagaatcttaggataaaagggttggatttcttcttttagcctctttatgcagacctgcaagttttgccttcacagccttgaggatcatcctgaagcatgagacacagattctcccacctccgcctattgcagaccccattccaacaaatcctccaataaatgagatcctgaagaattaatctcccgcacaagcagaataagtgcctgagggaggccaagttttgcagagagttaattatgatgaaggaagacattctgtggccattaatttttattgggagggcaggcattatattaacagctagtatatatatctagaattgggccatatagcatacacgcattgtctcatttacttatcacaaccctttgaattaggtaccattagtaagccccaccctgagaataagcttaactggccgaaaaatcacaaagtttaagtggtggaaaatggatttaaatttacatctctcagaccccaaaatccatgctctgaatgctagtgatatattgcctttttacagtcttctggtataattatgctcctacaatgttccacccaagccagtggcaaaagtaagtcactgatatcaaagaggggggatcatctaccctatgaatctgaagacaaaaagcaccctttaaacatgattcatcttcgacacaagagactaatttaagaaacatttctttctattcaaaataatgatgctaaatgggaagcgatttaagctttacaatggcttcatcagaatctcatctgtcagatctcaaaatcatgctcccagaacatgtttctcaatagaatgaatcagcaggaaagaaaagcagatgtaaagcaaacaggtgaaagtatgaagttagcaataactgtgctcatgggccaccaccaccatcagcaccaccatcatcatcctcatcaccagtattatattgttattattaagtaccttcattcccaaatagtagcattatgtcctctgaaggaatggggcttctgtttacccagcaaacaggcactgtttgcattaccttaagggttaacctactttcttgataatgggtcatgagtgagtaggggtgatcagtaaagatagtactattacaaacaacagagcacacttgtagttactaaaattatccaaaaaatcatggcaaaattatcaaagatgtaggattatgaatttggtatgacagcagaaggatgattgcacatctcacagtccatattgctcacatcgggttctcacatgctttaattgcagtgctaattctgagaattcttgattatgatctaatggtggaacacatctgaaagattaaagaactgattgtagaaaagtcaacacaaagtcctccatttatgtacataccagagtgcaggacaacggggacgaccctgtcccctggtggcagagctccgcgattcagaacctcgcagcaggaaggaacttgcctgtgactccacattcagccatgctttcagaagcactggacttttatcaatttctagggatatttgtgttgtcagggtatactaagtaggaatctattcccatttatattgtgatttgctttgtacctactaattttcactgaaatcactattataatttactgtctctacccccacaagtaagggatggaacttcatttcccagtaaatatattttgttttattgcctcctaggtaacaatgtgcaacaataccaaagtgtttcatttaagacctgtgattttgtgcttttcaggactagtaaaatacaatagcatgtggaacttatgatttctaatttgtttcagaacgtagtatactgtgtttatataagccacacaatattaacccttcaagacaactttaaaatctctttcaaagcatgattaaaagtacgtctaaaaattttccttgtgaaatgtaaatgtatctaatacacctataaaatcttgtcagctacatttatgaaacataagtcataaatttactacataaacaacaataagtcaaaatagtaacattgataacaattgctaaaatgttctttacacttactaaaagccaggatatacacttaacacttttaatctttatctcttttaacccttacaacaaacccacaaggtaagtatgttattctctttttaaagaagaaggtacagcttagaactatgtacctcaacattggcactctaacattttggataatcctttgttgtggtggaaatgttccatgtactataggctatttagcagtatccatggtctctattcacttgataccagtaatataccccatatccagaagtgacaaccaaaaactgtctgtagacattgccaaataccctcgtagggccaaatcagccaaatcacccccagtcgagaaccactggcttagagaaataaagtaacttactaaaggtcatatgcttagaatataattgaacagaagccaggcattctgacacaagaatgtatactctcaatcaatgaaatacagtgttgtttactctgtgatagtttaaagaacataaattttcctcaaaatagaaaactaaaaatgaagacaaactgtaaatgccttcccgtagaaagatattctatggccacaagagactgtgcccttccaaaattttcctttcctaattaaggtccatgtcccaatgcctattgcccttacgtagcttgatctcctgccccacctaccccaatcttctttaagtcctattccatgtgccccaaaagacagtcaccaatcccttgttaaggctgattccatgctttagtaaataagatccagactctgcctcacagagcccctgaagaacaagacctgtctgcttcctacctgttcccttagatgacccaagacttccacctgtatcatctcaaagtgtaagccttctgcatagtggtcactgaattccggtactgaagtcccaagacttcagtgactaaggactttccacacaccaaagtcttcctatgtgcctcacatagactatttcattccaggctcacaagaaccctaggaagcaaatactatttccatttaccaaaagaaacagattccagtaggcaggggaaacccacacaagcatttcaccaggttcacgacaggactcagattttaacccaagtatggacaactccaaacccctgctctgtattccaaccctatactcttccaatttcatggcagggcaaagactacagacacacccttccaaagcatgttctcatcttgccatactccctccagcttgcttagaagttcatcattccagccccctctcctcgacatcccaaatttatgagaataaacaaagcagagctgagtgtgacttcacttgtggaatagaaaagggaaaaattcaggcagtgacctcacgaactttgaaaaggcagtatcgtattaaatcagaggatagaaaaatacagaacatgttttctcttatccgattctatttttgttatttactttttttatgcataaagagttatgtattcatgtatgactgatcacatcgcttcaaagcactttagctgttaagtacgaaaatagacaattttgaaaaaagaacctggtggtggaggtgaggatttttccctttcaatcacattacttaaatatagcttgttgtttttttgttaagtcttcattaaactttcctgagagcttcaacttttaggttaaggccaaatacgaaaactttcaaacataaaatgtctgaagagaaaagaacaattggcagagtagagaaatgaactaccaaaggcagatctttttgacgttgatttattcagctttaagctgcttcatttggggaagaaaaaaaaaggaggggctccacagctgtaaaaatctataaagccaggctgagcacagtggctcatgcctatgatcccagcactttgaaaggccaaggcgggtggatcacttgaggtcaggagtttgagaccagcctggccaacatagtaaaaccccgtctctattaaaaatacaagaagtagctgggcatgatggcatgcacctgtaatctcagctactcaggaagctgagacaggagaatcgcttgaactggggaggcagaggttgcagtgagctgagatcttgcctctgcactccagcctgggcaatggagaaagactccattaaaaacaaaaacaaaaacagaaaacagacaaaaaaaactataaagccaaagggatagaaagaactcaagaaactttcagtgtctgaaaggcctgcctttaaaccctggcccgaccatttgtctgctcatttgagttacctcagatgagttacctcttttccatgacttccttttctgtaaaacaggatcattgtgaagatcaaatgagaaaatgcatgtaaagcacctggcacactgtagacacacaatagatttcaatcagtagggggccctctggacatacctatgtgcttgccaaagtttgtgctttagcaatacttttaatgtcccatgattacttctcattaattaagtgaatttagaagtattgtaaaccaaggataatctggctaggggctaaaggacaatatatatggggtacagactatgtcacctgcccagtgatctctgtgctaactggcagctttgttcttttctggtgattcagttaaacagcagagagtgcccaccatcactgcagatgttgttcagtgacctagacttcctcctggaaggacctcagtaactggaaccagagaatactgtttttgagccaaagaccacattcgttctcagattgaatctcatctctttacagacaaggacactgaaccagagaggagcaattcggcacagctaaatgtgacagaacacaaacacgattcttaatcttacctctttaccagtggttctcaactagaggtgattttgacatacacgggacatttttggttgccacagctaggggaagatgagatgttactggcatctagtgggcagaggccagggatactgccaaacatcctacaatgcacaggacagcccctacagcaaaagcatcaatagtgccatggttaagaaatgctcacctactccattggaccagtgtctccagggagtctgaaatctgcctttaaagctgctgctgctggaagttgaacttggccccagcatggcggccctcactaatgactgattcaaccctgtcaattgtgcctcttagcattgaaagccaccaggtttgggaaggatttagagatttgcctcctcaggtaacttaaagtctggacataacttttgaagcaccctgatatgcctgggcataagtgctattgacagtcctgaaaatgcacttcggtcttattaggcaatctaagaaacttactctcaaaaccattttggcaaaacaccgccaaacagccaaatgatgcacaaccacacagatacctgaatatcaaatattcagaatgatccaccctgagcaaatacatctgatactgtactaagcacctccaggattaatggcttgagtagaggaaacacagagattgaagcactgattaaagctaaaatactctcagtgtttccacccaaagcttgagttccatgttgcagggactaaaaaaagaaaagaaaggcagagtcaatgatttaagcaattatgtacttactgattcttgccatgcatgccatctgtcttgctgacctcacaggcctctacaccggccagtgtgagggtcaaatgagagtctacgtgtgggagtatgcagtgaactgcaaagccatttgaaagtatgagtcacaatccaaacttatttacccagagttccacctagtaactatgacgttagttctgacccatgatagaaatatatgaaggatcccaatctgatttattcataaaatcaatgcacatttaataaagatctgtcatgcccaatgcttttggggagcatattccccacttaaaaaaatcagtgatgccacaaggaatgacatgcaccccactaactcttatacagaattagagaagcaggaactcttttaggtggaaatacctaagaagtttccattgaaagggatggtctttgaattggatcttgaagaaaagatgggatttcaacagataaaaatgagaacatttagagtactggaaagaatatgaaagaagaaaggatcataaaaaaatcaggcaaatatgacagtcagtaaggagttcagcttgactggaacttagggtgaatggaacaaggtaacagacaaagcagcaaagtttaggtggaagcaagtgtaggcagccttaaaatccaagacaagaagataggcatttaatggccaacaggaagccaatggagatttgttgctatttttcaaacatagaaggcacaatcagaggagctgtggagaaagtaatcagacataggtatgcagcatggagaagatgaagaaaccagagtaatgaaagagattaaagaggccacccaatactctaagagacaggtgatgagactggaccaagatcatgggagggaaagtaatgtgaaggaaaagcccacaatccgttagggacccattgatcatgggcaaagaggaagaataaaaagttaaagttgaaggaacacccaacagaagatcatacaaaggggctcagaagttttgatcctggataaatggaagaatggtagtaattatcagacataaggaagatggaagagaaaagacgaatgaattgtgcctagatgatcctcttgactcagaaaatgacagctcaatgccaaggtcactcctgctactggtgtctagatacactacccagacgaagtgcctgagctattatacttactacatctcagcaccctctcatcccatgcctagttcccaggtgaaagcctctaaatagcctttctgggcctagatccctacacctgtgccctgcccccctcccaccccctcccttccccccaccgactcctgctgatacattagcaagggtaagtgagtgaatgactaagtagtgaatgagtgatggctgcctgtactctgaactctgatcaaaactatatagactctccatcactccccttcccccacccccagccatgttttacctgaaattgtagtgctttttggccctttctcacattaactgccccaggacttgcacttgcaggctaagtctcagcatccatctgtgactggggctctaaccagaccactgtggctgctataaaggcaccctgattcaggtggcaatcttggaatgtaaactggacacattctcatggctgatgcacttgttcttactactttgagactgtattattagtcatcacaaatgtaggaaaatatttgtaaagggatttatctcttggaagatcctcttgtccctgatgttaccacttaggctctgaaaatcaatactactaagtaagcagtagaatgcaggattggttgtgcattaagtttgcaaaaatgtatgatttgatttatccagtgtcacccctgttaattttcccaacaagttacttagctgccacttttaattgcaaaggtaggggacaacagtctaccaattctatttcaaaggtgctgaaagaacttcggaattaaccaatgggccttaatatatcctgggaaggaaacgggcagagttcagcagaagatgtaccacatcccatcctaggatacaactgcttagcaggcagcctcccacagggtgataaccactcgccttccctcccttcacatgtgacaatctattattaccagcaaaggtggctgttgatgatgacttattagctatgtcaattcatgaaggctgaacatgggcaggcctgactaagggaatcatttgctggatttaatcaattactgggttcatcaagtgtgattactgagccacgtcaaaatccaagtgaaataacacattagacattcatggaaaaacataactccttgctttgccttgccacagatagaggccacactattatctatatgtacaatatccaggttatcaattatctgcacatgtctgtatcctgggctgtcttcttcctaatgtctagaatatttttgagccatttgccttttttttaaaaaaaaaaaagaaagcctaaaaatcagcaaaacatacatttttaaaataactgaaaacatgaagaaaacaagaaggaaagattctgggctatcctattagacttcagtatgcccatactttcaagcaccacgaataataaacaatactggaggctcactttataatctagcgagagaagagtatatgataatgtaagtatcctcccaacagatctgattgttcccaatgaccttcaatacttatatctattatagcacttaccacattttattataatccctttgttcacctgtatctcacctacaagcctctgtacctattaacagaggcaattgtacatatcttgttatttccagtatttactgaactatatagcaatatactatagtaagtattaaataaacttttgttaaatggaagatttttgtaaagtactgtgcatgtgactatcagtataatatgattatcaaaaacatgagggacacctttgtctaaagttaattactcacagaaatatgtctagatttagaaaatgaataaatcagacacagtaagagctagaacttctacctaaactatctaaacagtgctatgattaataacaaataaacaaaaatgttcatgctaatgaggttgttcattacctggtatggcttttttaagccacaactccaactcctaaacattctgaccaaagtatttccataatccagacacatgaaaattgaacgtgtgtctgtagaactccctcaggtttgtggataggtctttaatttgtgcctctatttcttaatcccctatcatactgaaataggggtgtgtgtgtgtgtgtgtgtgcgagacagagtgtgtgtgtgtgtgtgtgtgtgtgtgtgttggaagcacctctatcatagattcagcttgcaacatcagctctgatagcaattcctttcttcaagggcagctcataagtatttggttatttctaagtatttctcaaaggtataaacttctgcaagccagacctgataacttgaaggtgaaactctattaaaagaaaccggatgagacatttatgagtaagcaggtttacagcgtaatcctctctagccgtcaaattaccatttcaccacttctgcaaatctcttggaatgattgaccctcatgaacaagattcattcacaagcaaaaggatagttccccttaaatatgtggatttaaaacccaatccaataaggttttctgtgcaaggagaggcttacctactacctattgattcccttgctaacccgataaagaggacttatgaaatcactctttctactgaaatttggtcttggaagagattagtatactctccttaatgctaggagtgagactcagtaaaatcactatcatcaaaacattcccttgggctaccaaaatatgcctcgtacttggtgaaatacttaaagaaagataactgcctcaattgtgttgtagtaggatgacaattactttgaaagctgtgggttttttttttctttaacaaggttttgataggtaaacaaatacataagtgaaataaaatgaaagttagcaagaaaagcgtaaacaaatgtagattatttttgtatcctgggctgtcttccctttgatgtccaaatcaaaccttttaatataacatttatatcacttagttttcctatattaagccacctactttatttgactaattattaactccagccaaataactgcagttagaattaaactcaccagttaagtccacattgctgtgtttattcctaccatgagaaaggaatcacagctattcccagtccaaataaaccatcaagtaggcaagcaaacattcaaacagaccattacttgactgggagtgtcaagatatatttaaaattgtctaccattcatcaaatgaggaatccacctactccaaatctacagatccccagagaaggtctcaagcaagattattctgaaaaaggctgaaggtttgctctatagattaaacaaggctggaaattttttaaaacacttcttttatcaagagatttagtctatggtccattctcttgaatgggtgggttcagtgatagcttgaccaataagacacagcagaagtgatgctgtgctcacttctggacccaggccataattaagagactagcagcttttaattcctgtctcttagaacatttgacctaagaaaccagacaagtgcaattgccctgagcccaccatgtagtaagaagcccaagccagatggaagcaccctggaggacaaaagccatgtgaggagagagggagagagagaaaaaaaatagagagggagagagcaagaaacaaaaagcaccaagactcctaacgtgagcaaagatactatcttggaagtggagtctccatccccagcagccccagttgacaccaggtggatcagattcaaaccagccagccaagtccttcctgaattcctgacctgcaaaattatgagcagaataaaagttattttaagccactaagttgaggatggcttgtaattcaatgatggatcagaagcacatggatctacttcatataaaaaatgtatttcattaaaaatagaagagctcaaactgatcctctattaattcacactttaaatgacttcaataaagcttgttcaacataattggtttatttttcattacagtgacaaaataaaaaaaggcaacagcattcacgtcagatatgcaaaaaacacactttcaaaacaaaattgacattgtaatttgaaccttgacaggtttgagcagctctcttgtaaaacttcctctcactgtctaagtatctctccttaaaataaaattgaggcaactttgaagcacctcatactccaggttaactacatgtgaaaatgataaattactttttactactcaagactactgtgccctctaatctgagtgattaatttacatcctgctcagtggttcacatgcaattactaccgtgagtccaacgaacctgaacaagacagaattgtttagccatctgtacaagctctcactatatttagaaaagtacagcaatctccaggaagctttcaagttttagttcattttcctctcaatgactcgtgcactctatgctgcatatcaaattataataccactcccttggacccaagtttgctcaacccactttattttgttgttgttgttgttttgttttgttttgttttaggcttttagcagcctgaagccatgatttttagtttctgtctatagtgataagaataaaagagggatgaggaaggggctttactggcccaaatagaaacagaaactaagaactcatgactgtattctctccactggacacccctggaggagaccatgcaacacaggaatctctactgtgagatgacgctcattagaaaaggcgagactaaagcagtgatctaaaaaatgccattgttgaaacctactggcaaattttaattgcattaatgatttttttaatctgcatgtaatctgtttaattccataacacccaagtcaagtacaatgaaagcagatacaggccgtctagattgaattgtgggcttcaaatgcttggtcagcaaaaggtctaagtaactttatttcctaactcttctcaataaaaagaataaatattacagaatataacaatggagtcaccttataataaatgtgtccttaggcaatattgacattgtgtgaaaatcattaagtgtacttacacaaacctagatggtatagcctactacatgcctaggctgttggtatagcctattgctcctaggctacaaacttgtacagcataatactgtacttggtaatgtgggcaactgtaacacaatggtaagtatgtgggtatctaaacatatctaaacatagaaaagctaatgcattgtactacaatgttactgcagctactatgtcactaagcaataggaattttttagcaccattataatcttatgggaccacctaactcaagaaaagcctcctaacatacatgaggtctacacctctagataagcctaagataatatgcttactaaaagtttatgaaagctcttcctaagaaagcatccatgatcagctggacctttagaatcccaactttgatggagagtcatagctaagtttaaagaataaagatggaggttggaagtagcaagaaatgacgctggagaaataaaagaggtcatgggagaccgtctgtgccattattgtccaatgaaatttgtgaaaacaaatcattgtaaaaaacagaaagcagtgtatacaagatgaaccaatgaatgaacaacgtgaggtgatgaatatgttaatttgcttgactgtaatgatttcactatgtgtatgtatatatatatatacacatatgaaaaaatatcatacactttagatatatatataatttttaaaagatgaacaaatgaataaattccacgaggaagtacatgacatttcctaagctcatttcattattctatcattagagaacccactcaccctctccatagtcacaacctgtatgcatgctcaaatacacatgctgctccaccaagtcagcaaactacatctgtcaacgggtcctgtaatggggaatgaaaatcgcatatgcactgaaaaatgggcttcccattggacttcggaggccatgcactcaaaaacctggtgagttatttttgaactataaatacagaagatttaagtccaacatttaatagccacataggttagggccagtgaccacctgatccctcatggctccttatgccaaagagtgcaaagcacagcccagaggcaggctgggcacatgagggatgatgacagatgtcattctagttaaaattaccctttccacagtcaaatcgaaagactgccactgcccttaaaggaatctgtgcctgtgctttgagctcaacagcattttgtcagcaaatcaggcaaaggatattctgagacaaaggagaattcagacactaaacatgttatataaagaccgctttgtgctccccatccataaaccttcagcccccgccagcctaatcactctctggtcaaggttttaggaaaatcactagacagcatggcagtaacaagcttttgagcccacaggatctactctcttgtgaaggcatccacctactgtgcctcactagatgcctgcaatcaatttttaattacagcagcagtcacgatcggagataaagcacgcaacatgctgagaaagaaccaaaagcctgtttattacagttccagtccaccatgagccagacttgtgaagagctgggccacaaatgaatcaaccagttgcagctcagaaagacgttcttacctctgggacgttttcttatatttcctcctgtaagaaaaggcataaacatatatcagaaaagggttgtggcaggcagtgggtaagaaagggattacttcagtggggatgggcatgggggtcaacacttcttaggggggtttctctgtgaagcttatgggtttcaaagcttagttaaaagtttgggaatgctgtgttatattgtagtcagaagtacagaacctaagcctttagtaaaaaatagcatcccaagagctcagtggctctgctcccatgttcttcccttttccttttgaaggttccatggcattttagttgaggtcaggctttaaagaccacaaaatctaggttcaaacctcagtccttcctttaccaggttcatgaggttcttacagagtaaatggacacaagcttacaaaacacttcttttatctggcacatattaaatgggttaaatggtgaataatgatcagttatttatgttgtcactatcgttactattatccccaacatctagcactgaggtccctttaaggatgtgcctttttaaatgtaaatgtgcaatcatgcagctaaactatgagatgagacataaggtcttcaaaaaaagaagaagtgaggaaggggacaatgagaaagtctagaagcaaatgttgagaaccagcattaggaaccatccccaggaagcagaagagacccagttccagcccacgtctgttatttacagtcatttagccttgggcaaatcttgtgcatcaggcttcttaatctatcacatgaagctagtaacatctgctctgaccatctcacctaggtcagagtggcagacaaggagaaaatggccataaaatgtatgttgtcccaatatcccaaagttcttcatatgtgtgtcaatttttgtagactctgaagacccttaaaagagtttcaataggctcagcactggaggggattagaggagaggaagtgttaaggaaagaaaatccatctccttgtagcatatccgggaagtacaatgtttcccagttgaccttagttccacaccagcatttccattacagtcactgtacccaggaagcaaaccactggtttgctaatggagagctgtgtaccatatttctttgtaaactaaagaggtttcaaattgagaatcactaggacctgttacatctctgttaaaatgaaatcacacagggcagtgtcaggtgtgtaaagcagcaagtaacacagaacctacagtgtggtcttgactagatatgtagtgatatctatttacctgaaaggagacacaccagaatgacaaccatgactccagggtagtaggatgacaaatcactcctttttagttttatgaattttccaaattttctttaaagagtgagcattataacagaaaaaaatattaaaatatggatacacctagttacatataaaggtatatacaaatataggactatatagagatatttccatgtttatattatatcacatataatagggaggaaagttgactaacagtagattaaggcttggcctttgaagcaaactatctatgttccagtcttggctctagcacttagctttacaatgctggactagttattaaatccccctgaacctcagtttctttgcatataaagtgggaagaatcagagcccctcttctgagaccttgttatgagaaataaatgagataattcacctgaacatcagctccccaagggcaagttctttgtgtggtttacctcatactctccccaaaagctatgatgcatgtgcactgatcaatcactctctcgcacctggaccctgtcaccaatgacagctcacactttccaggcagcagccaagggcagaggcttcaccttcagccatggagcatagtgagctgtgggtgtgacctgtgcccttggactcattagcacagcagtctaacaaactgatctaaggtacaactggcaagacgaaaaaataacccattgagcgtatacagggaccaaaggcaaggaggcagttggaaaagaagaatgcccctagcctctactcagaagcccaactaatcctatcagcagacagcatcttcagaggtcagaagaagacagcccttgctattggtttccacagaattctcccaatacttgccaaagaaatctataaaggcactgctgggagttctgaaagaatcaaagatgaacaaaaataagaaaagcttcattttcagcacctactagcaataagcacttaatatactttgctaatcctcataactctgtaggatcccctctctgaaagagcgcaaattctaaaaaggaagttaagacatgcacctaaagtgttattttaacaacaaatacaagggatgctttgtgaaagaggtagtcttgattgctgggtgaaatgtcagcaggaagaaatatggaagtatacagcaagcagaaacagagggcatgcctcatggtctcaaaccagtccagcaagcagggactataaagtgaggtagcaggaaataaggctggcaagtgctaaggacagagttaagtgggaagagtaataaaatttatattttagaaaagatgatacccagggggagtgtcacctcttgtgggaagccgcattacacaccctcttctgtgctcccacagcatgctgaaacctctctgacaccgttctccgtggcattgcattgtctcatgtctgattttgtggaaaggcaacagggctctggagtgtgatagacctggctcaaaacctaacttcacccacactagctatgagacctcaggcaagctctgtgctaaatcaagctttcatttctgcatctgtgaaatggatgagatgatctcaaatgagatagtgtattaaatttgtcatgtagtgtgcctgccatgtaagaggcattctaagatttttaggccccttggtccctagttctgagcttcttgaggtcagaggtctgtcatatgcatctctatatctatcccaagggcatgcacgttaactggcacatggttggctaaataaatgaactatttgcaactgtcacccatacacatcaaaagatgggttgtgcatctggtagacccaaagaaagacagaccagaagtctgattttcagtccaactcaccttcctgacacgcccctcgttcatagatatattcttagcttcagatattgtaaagtttcccccttcaatcttctcccatttagacacagccctaaaatcaacccaaatggtatcatcttacaatggagtttggaggtcagctcttaaagcacaagagaaaatgcaactcataaaaattactcaagatccaactctcagattattttgaatgggcaagattggtgaggcctgactgagccctactcatccttcagttctcaactgaaacatcacttccaaagaccttctagggccccccaaactgggtaacactccttctgtgtgtcccatagtggccagagcttacccaccacattgcacttatgactgctcatggtcatgatctgttattcttatggaaagaatgatggcttacctgacatctgctagtgtttcttccttgtcatggcaactgctcaatatgttgttattgaattcatgaatgcatttacccaaaaattgatcaaaaatgctttctttttattctttttccttctactaagcaatgatttataatgagcagtgaggacatccaccacagctgtggtttcctacacacagagggaaagcaatgagaaggctggggagctcacatttgttgagcacctcctctgttccattcctcttacacaagttaactcacttacaactcctgcaaaccctgagaggttctacctactttcgacttgacagaagtgagtctcagagaggttaagtaacttgcctaaggatacagaaccttaaagtggctgagacagaaggcaaattctgaagccttcaaagaaaattaaggaatgtatacaaagaaggcaaaagattccaccaagaaacttagacactagataaaaccaaaataaaattaataacaataaaacatactgcattctgtccaccaaaatgcaggaaatgagctggaaaaaaaaccccagtttattcttggccttctatttttaagaacttcaacagaatccctgactcgcaatctgaaagacaaagggaatttttttttgctttgttttgtttttgagagggaatctcactctgtcgcccaggctggagcgcagtggcgcaatctcggctcactgcaacctcctcctcctgggttcaagcgattctcctgcctcagcctctgagtagctgggattacaggtgcatgccaccatgcccagctaagttttgtatttttagtagagatggggtttcaccatgttggccaggctggtctggaactcctgacctcaagtgatctgtctgcctcagcctctcaaagtgttgcgattacaggcatgagccaccattcctggcttgtttttaaaatttgtttctaaaacttaatttaaatttgtaatattttgaaacttgaaacaacacactacaaatctcaagatttcatgtagctagaccaagctgatgtagaaagtagagaatgacaaagagctgttgtgttctgggacctggcaaatttggcagggtgggagatggagaggccagcttcatgctgggagagaaggcaagggcatcttcacaaggccaggctgaggacaccacttcaaagaaggtctagagtggcactttgcaaagtctgttccctggaatgggtccaccgttctctctctctctctctctctctctctctctctctctctctcactgaaacacacacacacacacacacacacacacacacacacagcttcatctgtttgtcgtttctgtttttctaaggggaggcattacagcatactgctcaagatcacttgcctgagctttaatcccttctccaacttattgtgtccgacaggctgcatgacctttagcaacttatatcacttctccaaccactggtttcctcatctgtaaaatttgggtaacagcagtgcctgctttacggggtgatgtgagagttaaatgtaatgatgactgcagggcatttagcatagtgctgggcatcctggaaatgctcaagcgtcagctactgtactaaaaacagtagtattgcataaataataatggcattataattcagtaggttttcaaaacttacttgatcaaaaatctttcattgattttaaaagtcacaaaaaaaaggttgaagattgcttttccagaatggaaaaattggatactcccaattttccttatcttggaacacttgaaccacaaagaaagcaggtgctaatctcagttctgctaagaggagaatgagctgaaacactgcccagcttttcccatgcataaggggccgtgtgcctgcctgtacaccctgccacccaccccagcaatgtcccacttaacctagcagagccacacactccccttaaatgtcaaagctgagccattgcccaaaaggcaggagaaaagaaagtaaaactggatagttatgaactggatatcacaataatccttggaaatatctaaaattatctttcaaagaaagtcctttttatcaataactccctaaaaactgagcccagtgacttgcttacacacatccttaagcagtctcaggaagttgtaactcaatgcggagatctcatgtgctatggctagaattattgattaacccatactcatttagctcttaagtaaattaaaagaccactagtcttaatgtctgtttatgtccggaatgtttcaatggaactgtggattacccaagaagtattaaatgatgcatgtgtgtgtgtgcgtgcacttgtgcacaacaggggacatgaaccccaaaacccccctcaacggcttcggtccatttacaggcagctggtcacatcctgacaggcagattctgaaataggagcatcatcaaagggcaaagagcactgacctccagtatttaaataggttccccaaagctctccacggcagtgtcataaagtggaagcttctagaccctgaacttcattttccttctcctgccctcagtcagggagataaagaatgaaactaagcaagcttaaggggtgattctgtccacagtcaggggcaaagtaaagataagcaggcaaacagcgagaaacaacagtgaggtgggagcaaggatgcttttaagggtctttatttgctttttgatggctaggagttcccagagtactgggcacacctgcagtcaaatgtaagcatcaagtactccagaatcaaacagatgatttggaaattgtttctaatagcctggataagtgagagtcgattaaacattgatgctaaattatgaagcgcctggcagtctttcacttttttaaagtgagtatctttgaacaacagccatatgggtgctgcaataatgaggtttataaataggcttaatattctaacaagctggctttgaaaaaccaaaacttgtgctctgtttctaagttgacagaaagatacctcccagttgggcacaagatttcctggtatgggaagttgaatatgcaacaactgcatacacacaatgcaaattccagttctgccttcagtgttctccagggtttctgggtaacaatgactcactcttctccaagtcctatcctgtctccattcttttctccagagaccactaccaccgccgacacacagaccgcttcggaaagcttggttctcagccctcagttctctcaagggataggacattgaaagacaggctcagataaaaacaaaatgcacagcaaggctcgtgtagttaactacaggttctcatgagtacagatcacatgtgtttcactcatgggaaagtggactgagataaaatgtcacaaataaccatgaaatgagtgaggatctgaacgatcatctgatcctctggttttgtttttcactggcatgcagggtacaggttggaaagaattggatatctctagaaacttctaatggatctcttacatcatttgtatgaattaatctacgcgctactgagaatggaaagtctttgtacatttcttctcattcctatcagtgatttcatttccatgatgcatgtattaaaaactaactttgcaaagctatccattgcttcctggcctttcccatattttgaacaagtaaatgctaatgagaaaaatatatacataaactggtggtctcttgacaccttccacaagaatatttaagggtgagaaaggagataatagagtaagagaatctcctgtcttactagctcgaatatttaactgatgagctacaaaatgaaattccatgtgcacaatgatttcattttcctgcctggccaaaagtccaaagcaagacaacaacaacaacaaaagattataaaatggaaaaaaaaaaaacctcatttttaccttgaacagcccaatcattaggaaagaaaaactaacaaaaacaaaaattctagggaatttattagctaggttttctagtagagaaaattgttctacagactcatactgtcattgaattatcttagaaaaggaagatcatattcagagatagccagctcccaaacatagaggactccagtatgtttagccaaaagtgatggatcaaattcacatgaaggaagcctttgacagtgtggtttgggggtggggatggtgaccctaaagaatgggagaatgcaaatctgaagcagagatgtaaataagacagtcaattttttactctttcttaggagcaagtgcatttctatctagtgctggccaggcagtggaaagtagagaaacctaggagaaggtaacaaactccaaactaaacaaccccacaggaagccccacctggggctacaccaactcacatggcagacccaggctgccccagtgctcctgtcctcccaaagcaagccccactcttcactgatctccctccgcatcccctcggctgcctgcagacagctggccagaaacagaaatcaaatctgctgctcatgcctgcttctctcatgagcctggattaaaaattccagcacttggactcctatttaagaagccctaaatgggacccctccccaaagaaagctgaactcttcctttggaaggcaagattttttttttagcaaaccaaacacaatttcctttccttctagctaaaagccttttgctcaaagctgggcaatgagctaatcagtggcaccaaggaaaaaacagggaaaggttttgagagaaagaaaatagaaagcaaatgtcatgcttgtggaagcccaagtagtacgttttttgcataactgatttagtcctctattcacgtatttacaaccacttgctgtgttataagtactgcaaaactgtgtgggtgggaatggaagcaatttttacgaccttcttcctgggagcccgtctcctgcttaaataaacatcagtaagaaaagctaaaagcaaaactatctcttaatatctgtgacggcactgccaaagtagatataaatccaaaggattaagacaaaatctcactcttcacagatctatccctgtaattaggggaggagtagggttttttctaattgaattattcacagagctgtttcaattctctactttgtttttccccttgtagatttagccagaacaaaaactgtaatcttctgctgaatttcacttcaatgtcagtctaatttttctaagtcttgcctacccactcctgcagtgttccttccctctccccactctgtgcccttcctcccaactcttatcaaaactgactcctggcagaaagcagctgctggtcatttacaattccaggtgaatttgaatcagtgccatggctccttgggagcatgagtccttcctatttcatccaaaatcctatcttgtagtagcatcatctatgtaagcctccctaaacacacgctctataaatctcaacaatttaaatatggcaaaatgagcccattgtccaaaatacagggaaaaaaagcgccaactagcagatgcatttcttgggaccattttgagctcttctgtcaactgaaatcagatgagcattggaagcaaattttcctgagctatagtagttaccttcactgaaactatgccaaatctcccagaaattggtgctttgaacgattctttcattttttttttaacaatgactaatttcagtcagtgattttatagtcagaatggcagttctgaaacaacatttatgaggcttgatttatgataattaatccttctatttcactaatgagctaggaaaggccttatttatgaaagtgtttaaattcctcacagttagcagacacggtttccagtgacacccacatggaatggtatactaaatgcaataaacttttgtgggtcatccttagacaaaagtcagagagacaaatgaaaacaagtggcaggatgtcagtcggaatttgaactactcctaaaacatctggaaggagctttcaaagattaatctttcacttccatatttactagatgtatctctagagtgtaggaaaagtcttggttatttaagcattttctttggttggaatctggataaacaacagtttaatggtctttggatatccaattgtgactttcagacaaaatgctccatgcactctcatactgattgtctaaattattgctcttctggtggccttaagggaaaggaaagctgtattttggcagaatattgaataccgggtccttgcaatgggtccttggatttgggtagaaatagaaggaaggccttaaagagcagagaaagggcatgaatgggcagaggtggtacagtgagtgagcgctgtggccagaactgtggactgctccaggagacaaggcccagccatatccatggaggcacctctggagcaggcacaggaggccaagccccctcaatggagcctaaactgcagaaaggcctcttgccagagccagagagcctccacgcagccaagcttcacttggcccttctgcagtgggctaggctccaggcttcaggtctcagccccatggcatgtgccctctacctcccagaaggtccgtgatgagggctcatcccatttggctccctgggtcatggcctctttctgcccttggaatactgggaatgaccatactggtttctgtctctgttccaaacctatgttttgatgggcatgataccaagtagtcaatataagtttcaagtaaagttatgattattagctggcctaagtaaatgccaatattttgaacaagtaaatgccaatgagaaaatatacataaatttttggtcttctgaaaccttccttcagactatttaggggtcacactaaactgtattctctacttacaaaatttatagatatattaatttggcatcattcagatatacacagaattttcctgcttactttgctgggctgtagattatatctccagacctgtttaatctccagactcacttatccaactgctcttgccttccccatatctcccctcatagtcagtatgtcccacactgaactcatcccatactgaactctctatcccccattcattctgttcccactcacgacaagacctgcaaacatgttcctcccttagtgatcctaatctaagaaaaaagaacctggggattcaagccaaaaccctgcgagttgaccttaattccactttcttcctcatcccccatatccaagtcctgttggatctacctcctaaaaagttctcacatccatgcctactgataatggcttccccttgctgaggccccctggtggatgaagtcggacctggctcctctccagctgtgtctggagccttcgcctccttccagtctgcgctgcagccacttggccttctttcattttctcagaggggccatgctccttcttgtctttagatctttacaggtataaacatcccaggccttaaatgcctagaatacgcttccctaactctacttaactacaatttacataatcttcatgtctcagcatgcgtctcttttcctcagagaagccttctctgaatcccggaccaggtttgggtcctctcttctatgttttcacagctccctgtgctggacttcttgcagcactcgtcacagcaggtagtaatttatggaagtattgtttaatatattcctctactgtaggctgaacatcccccgagggagggagcctttgtcttgtttcccactaattccctggtgcttagcacagcaccaggcacatagtaagtgccacagaaatatttggtaagtgaatgaatgactgaattttctgcatacagatgtgtattccttcaactatatgaacaaaactcattacctaaaatgatcaatttttatatcttctggatggaatgattctctttagttttttcataatctcacaagctaggaacatctagctttgtcttacggtcattaagactcatttattttgtttaataacagctgtcaagaggactctgtataaacagtacaataaaagcctgaagaataccaacactttacacgaattcagtatacttcctccagaaatagagtgttgcatttgttgtagaattcatttttattgctagtgggaaactccgatgatggtcattctcaaagctgtcccagtctattgtaatgtgccttatatttgttaagttggtgcaaaagtaatgcggtttttgccgctaaaactaacagcaaaaactgcaattacttttgcattaacctaataacaattatttcttttagttgtttctcaaaaatccaggagataggtcctataaacacttttcttccatgtggggaaatggaaaccaaggaaagtagtcttccatgagccaaagaaaattaaagattgaaaactagagatggtaatgcagaaacctctctgctgagggctgcttcccaactgacagaggaatgctgtaaagctcagtcaagatattaagcactttgctgctaaatattgagttgtaattaactaatacactagcataaccaaattacaataatcaagtgatgatgtactagtaagctgcatgagtattcaagtaaagaaaatttcactgtaaatgtgagaatctacttcttttgatattcacatttttcccctttaatatacattaagaatgtatttcagagagatttaacttgatctttattaagaaaagaaagactcgaaaacaatccttcaaacacaaatgtctcccttctctgaatcctagcatgtagcgtccacatcacttagtcagcaattaattattgccctcttttttgttgttgatttttaaccttttcacatgtataagacgtatcttgtttccctcaatatattctaagtttcctgatggtaaggattttcttctgatattttcgtatcccttctgaagctcctagcacctagtacataatggaaacccaataaaaatatgctgaacgatctggcaattccaattgaatgggagagtaaaaggaccagttaatacattaaatatgtaatctgggggaaacaaacaacaattttttaaagtattctcctggaattgcttttctggtaagattcaggtcaatgccctcttccctgggtcatctccttgcaaggatttaataataagaaccaagattctcagacccaccactccaggccaaaggtctctccatggctccatattgccatcaccaatagctacttgaacattccagaggctaccaatttaacatatctatacccaagtttatcattctgctttatcctagcctgctcttatctccatagtccctaacgaggcaaataacaccaaattcactgagacatctaagctgaaagaactcagaagacaacagctcctctttctctactctaaatctatgttctgtcaattctcatttcaaacatgccccctgttctttcatcttcagcagcgctaccccaaatcaggcatcttccccaactggtctccaggcctcgagtcgcatctccaatctgtcctccaccctttttccagaattacaatcctaaaattcaaatctaattttgttactctccagcttaacatcttttaacaatttcttataactgaaaggataaaacacaaacttctaaaaatattatgtatcataaaatatatatatatttctctagaagatatgaaagaacacctagaacacagcacttttttgttgtatagtaaaatgtgttcaattactcacctcctcaaactatgagcatacataattttgagtaaaacaaaaagtaaaatttttaaatgtcatgtatcactacccagcctctgccttcctttccagcatcacctctcatgactacacttctatctgtccctcagtactgcactagatgagctgcaagaggacaccacacattaagcttttaaggaaagtaaggctcttgggaattgattagtaggagaaggtaatcctgttacccagaccaattcaggggccaactacttctgacggaacggcggtgggggggggggggaggagccgggggccagtgagggggaggtggtgagatttatctccaatagctccatgttgcatgacagcaaacagacccaaccatactctctccttagggaattctcaatgagtggtgaacatagagaaggttcactagaacacaagccatatctcagttaagtgcaagcagctttgccagtagtccctaagaacatctcagaaatctcaactagtttattttgggctgcccggaagactccttgtttttctctcatctttgtaaaaggtttctttgcatttttgcaaaaggctgacatcaatgaaaagagtctaagcaagtttcttccttatgactctaatgagtctcctagaatgaatacacaattcactgtagtctgtaacaccttctctggccctcccaggtagacgtagcttccttcgcatccccctggaactatattcatcacctccaggtactcatatcagtctctgccactagccttcaaattgctgaaagttaagtaagtatcttacctacttttgcaaacccagggcttagcaaactgactggcacctaatagacactcagtaaatgttaattgagtaatcccatgttgcctgaacactaattatatcatttaaaagttcggttatatagaaagaaaacacagagagggcttaaataagaaatttaaaaccaaaggtccaggctttgttgcctatggcttttctcctcatctttgctgtgtaggttggaagagtcacttaacttctctgtacatcaatagggtattagttaagactgtttcagagaaaccaaattcaaaacatcctaagcaaaaacagagtctaactagctcatgtagctgggacagctgacagaactggagacacatctacaggaactgggacctccaggagctgacccagggattcccactccgtgttttctgcttccttttgagcactagcctcactgcctcctatcataaaaggtcttctctatgaggtgggaaatggatccaatggcagccccatgaaagtccagaagaaaagcaaagcctccctttcccacagccaatacagaaatgtcaatgagggactctaatgcttctgtttgggatccataccctacttgaaaccaacttttattacctggaaggtgaattctgtgattggccagtcctgtagtatgctggggtgaggagtagagtctgttagcatagtaaggtggatgggaagcttgctgcatagacaaaaacaatagttgttgcagtctattaacttaatagccattctcttgcctttatattaataatgttactttaggtaatgcaaaaaagcatcatcatcttcatggagtgttatataagcataaaatttattataccaactacctcatagttgggcaaaataaatatatgagattagataattataattgtgataataaatgccaaggaataagtaaaacctgctctcttgctctcagtttttaaaaaatgcagcatagaaacacgtttctgacatcatctagcaggctggcaatagaaaaactttttggtcgggacccaaggtacagtcataacccaattgctcaaacccaaggagccctatgaggcttcatcaggggtatatagaacacccacagccctgtttccctgactgaaagattctgtaacaaaaaagtaattcagagggacacaaaaaagtaattcagagggactcaaaaactctatccagtcctccagagaaaagagatatgacaacagctcattgggaggaactgaggtttatggaaaaggaaaaatgaggctcctctccaaagagtaagaggacagcatccctctgagagttccaattaagaaagctcaggtgtgcagtatttgttttcttctcacttagagaaatgggagcatgtgcgtaagcagcatcagggccacagagcaaggctgaggaccagcaccctccctggaaatcacagctagcctctgagcgttagtgtgcagaacctcgctcaaggggcatgggcgccatcatcataacagacacctgggcttgcaggtgtctataatcccagctaagatagagtgtttaaaactcacatctccaatatttgatgcactgttagtatgctgatgatgctacaatgctaagagttattcctaattctttcttagagaaatatgtaaaacagctctatgtttcaaatatgtattactgtataccgggtggaagcgtaggcactggggataaaaagcaaaccaaaagcaagtgaccaaagcaaaccaaaaaccctgtcttcatggggcttatattctagctggaggagacagacaataaacctaaaaataaataaactatacagcattcggatggtgggaagtgctagagaaaaataaagcatggcagggtatgggtacgggttggaatgtataggggacacctccctgcaatatacttggctgttgattatttgcaggtgataaccacagaaatcctcttgctctggtaaagactacctctcaccagtgtgaaagaggggctataaagaagggaaagagaaagcccacatgatcaccacagtgggattcagccctgggccacaactctgccacacatcttgcccatttcccacctcagtttagatttctgtgccccaacctgggcaatgatgttaataaaacctgcatcctagctagctcatggctcattgtgttgacaggtctcacggccataagctgtcctaaatatatatttatcttcattttgaatatttaaaagctcacatttgggtttttatgcttcaccacctattgattgagcatctactatgtgctaaatgctgttctaggtattgcagtgagtaagtatgtgtcctcatggaacttacattctaatggaggagatgaaaaattcaacaataaattaaatacgggcgataccaacaagaaggagatgcgataacattgaataatccaggcgtgagttgatgatcacatcctgaagtgagatgtctctcagacaagctgaactgaattcctgaccatctgtggtcacctacagagccctttctataaaggtgtcatggtaatatattggtatgaaaatccaattatggtttgaggctttctaaaatgttgaaagagcagcttcctttctcttactgacaatctgttgtgtggacaaatatgcacacacccttccttcccctaagggtttctattttgtggacggcaaagtgttattccaagttgtggactgcaaaaatgttattccaagttgtataaaagagtgtgtgctttggtttccagagtctttagctatttattctagcactgctgttatgtttaaaaagaagaagaagaagaagtggtaaggatcacatactggtaaaaatatgtataataataacaaataatagcatctccttttcaaattagaaagtgaagctataatcaccccacacttttcatgttcaaaagcactaggttctgagtagatacaagagactagaaaatgaaaatgtagttacattacactgcaacaccttggagagagaagcctagcagatatgaaactgagaaagctacacgacgcagtgttgtaagtgctaatgcttttccacacaagttcccgcctcagcattgctgatttgaccaaacacttgtctctagcccaaatgtctccatggagtcggtttaaattgaaaagcagtccaagagaagaagttcctgggtgtatggatatgaatccctctagtcagcatggcaaggaatccagctcgacaacgctttcacattatacactttgggcccagactttgtggacacaacaaactttctgtgtgcagcacaatacaatcggacgtaatgttcactaaatataacatgagattactgtaaacaccactccgagagctgctgcgttgcaggcatctaaactgtcaggaaagcctgccagccagagacaaggtttccaaataaatttacagtctccactagcggtggctagacaagtcaaaaatcaaattatttggcatggtttcccattgaaatcaatggcaatgaagctcacttggactatatatggaatggcttttataaattgcacctgtcaataaggaccccttaaagaaacacatactaccttaatgcttctccttagaaactttgaatatcaagctaacttagatcaacacattttttatttgtcttttgtttgtgtgtgtgctttcaaaaacaataacagcagcaaaacaaacaaactggcaggaagctggttttcccatcagtgcccttgttagaaacagaatgtctagagaatatgcttggagaaaagccatatttttaaaccacactagatatctgatgccaaatgactgatgaaagtagtatctagtagtaatggaaggtgtctttgggacctgcccagtgactgaggagcaagctgtgaatatacagctatccctcaagctcctgactggagtgaccagcagttcactgatgatgaaatatttttacagaaaataccatgtattttcaggtcacctctcctcagtacccaaaaacagacagaacccaatgaagtgaatgaaattcagagatctccatccatcagggcaactagaattctggccactctatttcattgttcaaatattgcaagaaaaccccaatatcgtttctgccccccctttctccacaagagcctttccttctagtaaacatttctccaccaaaaagaaccccaggaaatatcagaagttcgactgggctaaggagagggaaaaaagaaatgtagcagccagaatgcatgttgaattttaactgttggtaagttcttggaccacctgcccaagtgtatgcaagcagtttgcagagaaaaattcttccttcaattaaaagtccctgtctgggtctcaaacttttctccctgggcaaaaaggatcagaaacacctcattgagtattgggccaccataactgactcatcaaaggacatctctccttccccccaaaaaagcatgacttggaacagcaaggcattctaagacagaaagacaaccctctctgtgttggaagaaaagtagcagtgactgtaattaacagagcagcagttgtggaacttctagggttgtatttaaaggcccatgcaggaacagggtgagcagtcgtgactgcggctgtgtggtaaaataaggatgggagcgggaaatggggcaggagaagtaaataggtatacttacagcccgcggagccgaagccagattttctcgatctgttccggttgcaggtatttcagagagttgctctcaaattcttcaatctccttggttggcgactccatagctgcaggtaggtgaccactggcggtgaagctgagatagtttgggctgtcccctccccgtctcctcgcccagctcgcgatgcccagccaggcgcggcgcgcgtttgcccggcactttctcggcgcgctcccccttctgcgcccccagactccgacttagagcggactccgatcgcggcaaaccatggccccaggtgcgctccggaggcagctgcgggaaccagccatggtcccgggctaatgcccagggataagcacagggatagggatagagatagggattgggattggactccagctccaagagaaagcacctcgggtctattcgtattctccccctacccccaaacaaagccacagaagcgatcagcgcgcagctaaagggtttggaggtgaaaaggagggctgggtggggaggagagaaagtgagaagggagagaaaagcggcggctgagcaaagcgggagccggcgcgggcggtggggcctgacccggacgccgcgcacccggctccgccccgcgcccagcgccccgctcactccctggccgcgcctgccttcgcgcccctctgttttctctcacttaccagcagctctgctgacaagcgagaaaactgacaagtgagaaaagtcgtctgtcagcgcccgggctggtgtctgggctgtcaccgcgggcgcggagggaggggcgcgcgggcaccgccgtctgccgggcacacgctgggctccgaccccggccgggcacactcacccccgcagggcagccgcggccaccaccgacctgcggagctgcgtgggcttccggaaccctcacctcaacaagagctcggctccgcgcgcaagtaggagggaagggaaatccttatcctcccggggccagggcacgcagaagccgcgaggcttcgcggaggttgggcctggaggtcccccacagcctcactctcgcacccgccacagaaccggatccattttgaaatattgaagcgactgatggggacgaagggaaccacacaccacactcaaaaactcttgatgttttcttgctaaaggggctctctcgctcgcgctctctctcctccctcattccctccctccctccctttcacccccccacccccatctctctctcttgtgcggaagaaaaggagaaaatataccaatagtgaggaggtaagtttcttcagatcaatatcacacgctactcaagagggtccctcctgggtgctggctgggcggctgtggatggtgacaaagtttcagctccacaaagctgcaactcactgtcagggttcccctagttcatgaacaatgtcaataaggtagaatgctctggaagaacgggaccaggtatgaagttgggagtcagggagggaggacagatgaagagaggaaccaaagactgggggaatccatgcccaagatgattgcaagcgacatcacagaagggtccgtcaaacttccttctaggtgaagccaccaccaggggctatttcaaacctggctctcagggttcctgagattcagggtggggcatgccctatacagtatttttcctcaatgacaggtaatacttctttccatcacactctcagaattattttcctatctattagatgattacctgcttcccaaaagcatgataaacttagaagtgaggactagtttctcttcactgctcaagtaaagttccattcacctgaccttaacaaaggaataaaatggtctctaaatcataaatgctcacccacttcataattggcattcattttccagaacttagaggtgagagtgatgaggatgcttggctggccccatgcattctagcagagaaggtagtaactcaaggtaagacaaaagacctgtttgatgaaaaacgacttacctactcacctgccaggtaaatctgaagtcgccccattaaaggcagccttttaaggtttatggaggcgcatatattttcactgagttaaggtattattactaggcaatggtaacattaagcaatattttaacatggagttcatctatctgaataaaaccaattacccttccagtgtcacccagcagagaaacagtgccctggggaaatagaatgtcacaagaggaaatttttatagtgacgtgttttgagaatggaagacagcagcatggtccccaaatggggtatttccattagtgtgtgcaccttgggcagcctgctggcaccatgtggaagtacaataatgataataacagcaaacaagtgtcagaaactttccatagcccaagcattgttctaagtgttctactctcatgtaatactcgagactattctatgaggtagatactattattatcatccccattttacagtaagaaaactgaagcaccaggaggcttcctagaccaactagagagaaaactgaactagaaaagaccagagtttgagttatggctgattaccttatcctatacaaatacatccccctcacagagtcccattttccacatctataaagtgatacatttaggcaaaaatatttttatgttgttttcagctttatgattcattgaggtcatctggagagacttggaaaaagaaattgctgaaaagagagacgaataatgctgaattcacattttaactatgtcatagtttctctaagtactggcctaggatgaaaatatacaaaggaatattaagcatgatacttacctttcactccataccacatctatgactttttcctactcttagtggaattttgattgtcagagaaaagcaaattttggaagaaaaaggaaagaaatcgacttttgctgcaattaagcaaatcagagagaaaagagcaaaaacattttttttaagtttttgaagctagattttgtttcatttgagaaaatttcttacaaaattaatgtgtattagaaagtcaggaaaaatataactttgctttatctacagccataatagtctttagagcaggaaggagcccaaaagacaacacagtttggaggttttcaaatttttgaagcaacagaatattttattttaaataatataaggaactcaaatgcataactcagctttaaaaaataaagatagagtggctccagttgaatggggaagggaagtagttagttctcaagtacagagtccacctctgcctcctctttaccccagctcttagtgcccaatgctcccactttacagatgagaaaactgaggccaaaataccacaaaacaactaaggattccttgctcctaaaccacattagaaaacaactttgtcttctctctgccaacaaaatactactatttttagatgcaccatgttactacgtcactcagattgtgttctctcttcatctatcacagccaaagtatgcttgatagttgcagcaacaccacaagccacaatttctactagcattctgctcagaggcaagcaaaaagaaacagatgcaaatagacctggaaacaaaaggtctaagaaaacacaaagccactcacaactttgctttacagtttaatttcctttgtttcttcctaacccagatttttcagtaaaactgtttaggaaacattacatggtcaaacatcactaaatgcatatagacatgcatacatacatacatatatatatatgcacaggcacatatacattcatgtatgcatgcatacatacatataaccaacaatttaaagtactcctgcaaattcacacagagtaactaagtctatggactagccaacctctgcactgtcagaattaagtatcacaaaagattaggaagaaagtgagctacctgtcccagagttcaaggggaagctagatgttaatctgataaaaaaaaataggaatcaggctttgaaggcatgagaatgacccccctggtctctttcattgctaagatttcatggttcatttataatcacaataaccacatctaccaccctaccagtttttgagaactatcatttgccaagcaccatggcaggcacatcacaggttgatccatttcatccccaacaaaatactttagcatagtttaattatgctcatttacaagtaaagacagaaagggctcccaatggtcagataacttctgcaaagacatacagctaatacatggcacagcaggttccaaacccagaccaaaaggcaaagctcatgttctcttgcctttgctataccacctccctgcagacacgcaaaaactctagtaaagaggtatataatagagaaggtacggaaaggagcaggagcatggatgaggggatcattcatgctgtggggaaattaggaaggcttcatagtgaaggtgacatttgaactggatcttgaaagtaggtggagtagaaattgtttgcatgaaaggtgggtggaggcaggtgattccagagagagggcactgcatgaaaagaggcacagaaacatggtaacgggtagggtgtcctgcaatccacaaacgttttgtgtggtgtgtctgtgaatgtgacacggaacagaaagagaaaatgctggaatgatcagccattctcttgttgtcatggaagaagcttgggctctctcctatagatgtcagggagccatgggcacatctaaacagtgagaggcatggccacatgtggagggtacctgctgccctgaatatgccaagggcattgtgcacagaggtcagctctccaggaagctgccacaggagcatgcaacaactatggtgcaaatgataaccagggctgcagaagagaaatccagtgaccaactgcaaacaagctcctccgcttacaaacaaggaagagtagaaaaaggaaaataggcaaatcagaaagagcaaagctttttttctttcagctatgagatgatgactacttgctttgacctccatgaagccagcctatgcccttgatccatttttcacgacttggcagtggcatcatgaagagagtctgttgagggggaaattctggagacacatttaggacatcagaagtagcaccaccaggcacagcagcccctcctccccgcccacaccagatgtgaggcggcccccacaatgttctgtcaacagaggctgttctctctcactggcttcctttgtggggaaaggggcctctttggcgacactgttaccctgcttctccctctgacgtctttttctgtttgattttataatttggggcagactctgtctcaggaaccaccttccctagaaaaaagaggtgaaagaaaaggcagaggactggctaagcccagaggtacccccactctagcccccctctgaaatggggctctgaatagccagaatctcaactacattaccaagtagtggcccagagaagtgagaagacaaagagatagaagagatagggcagctcaggggcagcccgatgtagtctgcatgtgacccacagtttctgcgcctctctctgccaggatccttcagttgctcccacaagagaagcttacataatccttccgatagaggtggcacaggcaaaggaaaggacttggagtggtactgcctcaccacgccacctaggataagacccttctcttgtttggccatggttgggttgggctcagggacctctggatccctttccaatgctcacataccctaatgttccatcaacagaggcatggttagtctggcctgggctaaccaagcttttcacggacccaaaaaagctgcaggaaaacctgagtctgcccccgcaggccagatttgactataatagacataacctagattgtccaaccagaaccatggaccccatacctatggatagagtgattggtccagggggtgatatgtgactgaaacagatctggtccttatgggagatttgatgtggcccctaggaaagagatggtctatttctcttttctttgagaaacaagccatatggcttgaagttatcttagccatggggttatcttttcaccatgtggagagaatataccagaaaaatgacatcagggctgggtgcagtggctcatgcctgtaatcccagcactctgagaggccgacgtggccggatcacctgaggtcaggagttcaagaccagcctggccaagatggcaaaaccccatctctacgaaaaaaatataaaaattagctgggcatggtggcacacgcctgtaatcccagctgctcagaaggctaaggcacaagaattgcttgaacctgggaggcggaggttgcagtgagctgagatcacaccactgcactccagcctgggcgacagagtgagactccatctcaaaaaaaaaaaaaaagaaaaaaagaaaaaagaaaaaaaaatgacatcaacacagaaaaagctgagagaagaactagagagacaaagaaaaacaatgtgaaagggtccattgagccccctgatcctgctatgcctgaagccagaatgcccattgacttttaggttatatgaacaaaataaatgtaccccaccaattttttttaacttaaactagtttgagtcagagttatgttactgacaactaaaagaatgccaactaataatacaattattccttataggaatgttgtaaggagaaaaaaaaaaaaaacagggccgggcacagtggctcacgcctgtaatcccagtacttttggaggccgaggcaggcagattgcctgaggtcaagagttcaaggcaagcctggctaccatggtggtgtaacccaatctctactaaaaacacaaaaagtagccaggcgtggtggcacattcctgtagtcccagctactcaggaagctgaggcaggagaatcacttgaacctggaaggcagaagttgcagtgagccgagattatgccactgcactccagcctgggcagcaaaacaagattctatcttaaaaaacaaacaaacaaacaaaaaatcacgtatggccagtgccttgtacattggaggttctcataaaatagtagtgcttcttccatctcatccatctggcaggacacaaagggacagaaactggaacactataaagggatctaggggtgggcagagcacccaaggtaaatagaaaaagcctgtattatcttgataaatagatataccgataattttctttcagttacattttgataatgacctatcaaatcattgctatattacatacattaatccctcagaacaaacctgaagtgaatgaaaacactttatttacttttttaatttattttatttatttattttttttgagacagagtttcgctcttgttgcccaggctggagtgcagtggtgtgatctcggctcactgcaacctctccctcccaggttcaagcaattctctgcctcagcctcctgagtagctgggattacaggcacccaccaccacacccggctaatttttgtatttttagtagagacggggtttcaccatcttggccaggctggtctttaactcctgacttcaggatccacctgcctcggcctcccaaaatgctgggattacaggcatactttattattattattacctccagtttagaaatgaggtggtgaaggtccaagaagtctgccagcttccctccggctggtctgctctcctccagctagtggcagggcagcaagacagtgcaggcctcctgacttctggctccgtggacattctgcctctcagaatacactgccaacccagtataattaacttggctgtactaatgaaattgaaatttttgttcacgtaaaactgctgatgctacaagtcagccaaattctgacccaaaggtacataaatcagcgggttgttcttcctatcactgtaaagcaaatttgaatatggaaaaacctcagagctgaaagggatctttatccaagctcctaattcttcagataaggaacgagcagctcaatcacatgcagtcaccacacaagttggcagcagagcttggaccagaagtgatgtccctgaactcccagcccagtgctccactgtctctaaactttctgtgggatcaagaatggctcccacttccaacggaggactggttcaatggtttgctcagttaagaaaagatgcccactaaaaagcataggctgttggtaaatgcttcttgaagaaaggaggtctcttggggaattggtagaagtagagaagaaaggctccaggaaagtggaaaggtccacagcagcctagataataacagagaacctgatgtgatgggtgtaagagggtcaagaaagggacactgggcaacggctatacatgcagactgaaggggcctggactaccgtattaaagtttaggcttggccaggcatggtagctcacacctataatcccggcactttgggaggccgaggcaggaggatctcatgaggctaggagttggagatcagcctgggcaacatgggaagaccctgtctctacaaaaaatttttaaaaattagccaggtgtggtggtgcacacctgtggccctggctactagggaggctaagctgggaggattgcttgagcccaggggtcaaggctgcaatgagccatgatcacaggattacactccagccttggcaacagagcaagactcactctctcaaaaaaaaaaaaaagaaaatgctaaggctttatactcttgccaatagggaagcattaaaatctgttgagcaggtgtgtaggagatgcaaagtggaagtttgatttgcaaagaaggatttaaaaacaggattttcgaaggttgtttttgaaaggccaccaaaggtgaagatttacagattcttttctctgtatctggagggaaatgatctcacaaaacaaataaatgctggaaccttttaaattcattcattcgttcaacaaacattggctgagtgcctactatgtgctgcacactctgtgatactaggtatacaatggtcaattaaaatactccagttttgcaccatggatctttaatctaattgggaaaacagatactaaacagattataaaacaacagatgcatcactgtaaaggtaaagggtgctgaaaagaaaaacagggtgcagtgcagagaacaaaaggaatatgatttatttataaatagggtggcatttcagctatattgctgtgtaacaaactatcctcaaaattcagtggctttttaaaacaaccaatttttctctctcatgatcctgtgggttggccaggtagttcttctgttggtcttgtttggggtctgccatgcagctgtagccagatggcaacccgggctagaatatccaatatggtttcactcacatgtctggtgctttggcagggacagctggaaggctgagacctctctctttctccacacggtttctcctcgtggtctcagcatgtagctaaattaggctcctgtacatggcagctagattgcaagtgcaagtgtgccaagagtggggaggcaggagcggccagtcctcttacgggctaagcctaggaccggcacaacatcacttctgctacactgggttggttaaagcaatcacagagctagccctgattcaacagaagaaataaaccccacctcttgatgcagggtgtggggagggagtgatacagatacttgcagccatctttaatacacccaagtggtcacggatggcctccacaagcaggtgacatttgatctaagacctgaaggaaaaggagacagccagttaacaggcaagagtaggaggaaaatatttctgacaagagggaacaacatgtgcaaagattattaagcagggagaagcttgaggagttgaagggcttataaggagctaagttgtggcaggagcaatgtggcaaggggagagtggcctgtgatgaggtcaggaggcaggcgggtggggacaacagaaaaatattgggtacagatttagggacccattcaactgtagtcttctagagggcagagatcccaaaagtcttgttcaccactgtcccctgtccccctgaccttccctccaaccccctatgcctaacataccaattgaccaatgaccaattgggcttctcagacaagtactgtgaaatttatttcatttatggcacaaagttagtgattcctagcacatacattatactcaaagagcaaacctcagacatggacacaaacttgagtgttctactagacctgaagatgtggagctactcagggaaacgcaaaaagcactgaccagagttacctttcagtgcataaagggttaattttcaattatctgattagctgcacctttcagctatctggcggagaattactgttccttgcaccctccagataagtgaaatgttacttttcatgtgactcagcacacaaggggaatgagggatattaactactcctgacagtgttttcaaaattgtccttggggacatctaaatggtccatgctggtccctgtgattctcagaagtgaaaggattttaatactcaggagaataaaagaatataaaagaataacatatctatgaatgccttccacccacatgcttttaacagattcttgctaataaaaaagaccctgaaggcactgtgactcggcccataatccttcactcttagactgacagacccatcagaagttgacatgtgcatatatttctactcctgagatataaactggcttctatgagcagggagtgggacttgatttatggagaggcatagaaacttagggacacaatttaaaagtaattaacatggaaagccaatcttagcaaaagactctcaaactgcttatgtgctgccagtaccgccatggaaacaggtggactctcacacgtagagctatgtggcttccctgctgccttagctaaatgtaaatgaagaaatgaaaattgttctcctcaatgggatttaggaagcacttgggaattttaatgaaagcattgaaaggaaagagtgctgagtccttgaaaacagctcccatcaagtcaattaagaccatgttagaaaccattctgccttcactatgggcagagccaacagagacttctgaatcaatgagtctctttttaagaaatatttcatttaatactttccctcccctacctaggcataaagagcatttgtgaaaatcagtcccattctcacccattcatataacatagcagaagtacccactgcatcctgccctgaaatcagacttatttgccatggagtttcctactgataactggatatttcctatactcctattctacacagaattcaacctatcagaatctaatcactctgccagatcaatgctcagcaattcctaaggatgctgctattacctgggacttttgaccactttttctcttcatttattgccagattcatcatctcaaacaatgaggtggaattagttggttaagagaggaaattttaatgcatgaccttttcaaacccctctgccttccatagtgaaatctaacttggttaaggatttattgatagagggctggtcattgactgctggtaacctcaggagatttatttaataaccatggcttttagaagcaacattcatatcaaaatgaaaatgtggagaaaaattcagaagacagccaaataggaacagctccggtctacagctcccagagtgagcgacgcagaagatgggtgatttctgcatttccatctgaggtaccaggttcatctcactagggagtgccagatagtgggtgcaggacagtgggtgcagcgcaccatgcgcgagccaaagcagggcgaggcattgcctcactccagaagtgcaaggggtcagggagttccctttcctagtcaaagaaaggggtgacagacggcacctggaaaatcgggtcactcccaccctaataatgcgcttttccgacgggcttaaaaaacggtgcaccaggagattatatcccgcacatggctctgagggtcctacgcccacggagtctcgctgattgctagcacagcagtctgagatcaaactgcaaggtggcagcgaggctgggggaggggcgcccgccattgcccaggcttgcttaggtaaacaaagcagccgggaagctcgaactgggtggagcccaccacagctcaaggaggcctgcctgcctctgtaggctccacctctggggacagggcacagacaaacaaaaagacagcagtaaactctgcagacttaaatgtccctgtctgacagctttgaagagagcagcatgcagctggagatctgagaacgggcagactgcctcctcaagtgggtccctgacccctgacccctgagcagcctaactgggaggcaccccccagtaggggcagactgacacctcacacggctgggtactcctctgagacaaaacttccagaggaaccatcggacagcagcattcgcggttcaccaaaatccactgttctgcagccaccgctactgatacccaggcaaacagcgtctgaagtggacctctagcaaactccagcagacctgcagctgagggtcctgtctattagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagcacctctcctcctccaaaggaacgcagttcctcaccagcaatggaacaaagctggacggagaatgactttgacgagttgagagaagaaggcttcagacgatcaaactactctgagctacaggaggaaattcaaaccaaaggcaaagaagttaaaaactttgaaaaaaatttagacgaatgtataactagaataaccaatacagagaagtgcttaaaggaggatgaagctgaaagccaaggcttgagaactacgtgaagaatgcagaagcctcaggagccaatgcgatcaactggaagaaagggtatcagtgatggaagatgaaatgaatgaaatgaagtgagaagggaagtttacagaaaaaagaataaaaagaaatgaacaaagcctccaagaaatatgggactatgtgaaaagatcaaacctacgtctgattggtgtacctgaaagtgacagggagaatggaaccaagttggaaaacactctgcaggatattatccaggagaacttccccagtctagcaaggcaggccaacactcagattcaggaaatacagagaatgccacaaagatactcctcaagaagagcaactccaagacacataattgtcagattcaccaaagttgaaatgaagcaaaaaatgttaagggcagccagagagaaaggtcggattacccacaaagggaagcccatcagactaacagcagatctctctgcagaatctctacaagccagaagagagtggggtccaatattcaacattcttaaagaaaataattttcaacccagaatttcatatccagccaaactaagcttcataagtgaaggagaaataaaatactttacagacaagcaaatgctgagagatttggtcaccaccaggcctgccctaaaagagctcctaaaggaagcactaaacatggaaaggaaaaaccggtaccagctgctgcaaaatcatgccaaaatgtaaagaccatcgagactaggaagaaactacatcaactaacgagcaaaataaccagctaacatcataatgacaggatcaaattcacacataacaatattaactttaaatgtaaatggactaaatgctccaattaaaagacacagactggcaaattggataaagagtcatgacccatcagtgtgctgtattcaggaaacccatctcacgtgcagagacacacataggctcaagataaaaggatggaggaagatctaccaagcaaatggaaaacaaaaaaaggcaggggttgcaatcctagtctctgataaaacagactttaaaccaacaaagatcaaaggagacaaagaaggccattagataatggtaaagggatcaattcaacaagaagagctaactatcctaaatatatatgcacccaatacaggagcacccagattcataaagcaagtcctgagtgacctacaaagagacttagactcccacacaataataatgggagactttaacaccccactgtcaacattagacagatcaacgagacagaaaggtaacaagcatacccaggaattgaactcagctctgcaccaagcagacctaatagacatctacagaactctccaccccaaatcaacagaatatacatttttttcagcaccacaccacacctattccaaaattgcacacatagttggaagtaaagctctcctcagcaaatgtaaaagaacagaaattataacaaactgtctctcagaccacagtacaatcaaactagaactcaggattaagaaactcactcaaaaccactcaactacatggaaactgaacaacctgctcctgaatgactactgggtacacaatgaaatgaaggcagaaataaagatgttctttgaaaccaatgagaacaaagacacaacataccagaatctctgggacgcattcaaagcagtgtgtagagggaaatttatagcactaaaagcccacaagagaaagcaggaaagatccaaaattgacaccctaatatcacaattaaaagaactagaaaagcaagagcaaacacattcaaaagctagcagaaggcaagaaacaactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggagatatcaccacggatcccacagaaatacaaactaccatcagagaatactacaaacaactctacgcaaataaactagaaaatctagaagaaatggataaattcctcgacacatacaccctcccaagactaaacaaagaagaatttgaatctctgaatagaccaataacaggctctgaaattgtggcaataatcaatagcttaccaaccaaaaagagtccaggaccagatggattcacagccaaattctaccagaggtacaaggaggaactggtaccattccttctgaaactattccaatcaatagaaaaagagggaatcctccctaactcattttctgaggccagcatcatcctgataccaaagccagtcagagacacaaccaaaaaacagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagaaccaaagacaaaaaccacattattatctcaatagatgcagaaaaggcctttgacaaaattcaacaacatttcatgctaaaaactctcaataaattaggtattgatgggacgtatctcaaaataatcagagctatctatgacaaacccacagccaatatcatactgaatgggcaaaaactggaagcattccctttgaaaactgacacaagacagggatgccctctctcaccactcctattcaacatagtgctggaagttctggccagggcaatcaggcaggagaaggaaataaagggtattcaattaggaaaagaggaagtcaaattgtccctgtttgcagatgacatgattgtatatctagaaaaccccactgtttcagcccaaaatctccttaagctgataagcaacttcagcaaagtctcaggatataaaatcaatgtacaaaaatcacaagcattcttatacaccaataacagacaaacagagagccaaatcatgagtgaactcccattcacaattgcttcaaagagaataaaatacctaggaatccaacttaccagggacatgaaggacctcttcaaggagaactacaaaccactgctcaatgaaataaaagaggatacaaacaaatggaagaacattccatgttcatgggtaggaagaataaatatcgtgaaaatggccatactgcccaaggtaatttatagattcaatgccatcctcatcaagctaccaatgactttcttcacagaattggaaaaaactactttaaacttcatatggaaccaaaaaagagcctgcatcgccaagtcaatcctaagccaaaagaacaaagctggaggcatcacgctacctgacttcaaactatactacaaggctacagtaaccaaaacagcatggtactggtaccaaaacagagatatagatcaatggaacagaacagagcactaagaaataacaccgcatatctacaactatctgatctttgacaaacctgagaaaaacaagcaatgcggaaaggattcccgatttaataaatggtgctgggaaaactggctagccatatgtagaaactgaaactggatcccttccttgcaccttatacaaaaattaattcaagacggattaaagacttacatgttagacctaaaaccataaaaaccctagaagaaaacctagccattaccattcaggacataggcatgggcaaggacttcatgtctaaaacaccaaaagcaatggcaacaaaagccaaacttgacaaatgggatctaattaaactaaagagcttctgcacagcaaaagaaactaccatcagagtgaacaggcaacctacaaaatgggagaaaattttcccaacctactcatgtgacaaagggctaatatccagaatctacaaagaactcaaacaaatttacaagaaaaaaacaaccccatcaaaaagtgggcgaaggatatgaatagagacttctcaaaagaagacatttatgcagccaaaagacacatgaaaaaatgttcatcatcactggccatcagagaaatgcaaatcaaaaccacaatgagataccatctcacaccagttagaatggcaatcattaaaaagtcaggaaacaacagttgctggagaggatgtggagaaataggaacacttttacactgttggtgggactgtaaactagtccaaccattgtggaagtcagtgtggcgattcctcaggggtctagaactagaaataccatttgacccagccatcccattactgggtatatacccaaaggactataaatcatgctgctataaagacacatgcacacgtatgtttattgcagcactattcacaatagcaaagacttggaaccaacccaaatgtccaaccatggtagactggattaagaaaatgtggcacatatacaccatggaatactatgcagccataaaaaaggatgagttcatgtcctttgtagggacatggatgaaattggaaatcatcattctcagtaaactatcacaaggacagaaaaccaaacaccacatgttctcactcataggtgggaattgaacaatgaaaacacatggacacaggaaggggaacatcacactctagggactgttgtggggtggtgggaggggggagggatagcattaggagatatacctaatgctaaatgacgagttaatgggtgcagcacaccagcatggcacatgtatacatatgtaacaaacctgcacattgtgcacatgtaccctaaaacttaaagtataataataataaaataaaaaaataaaaaataaaaaaaagaaaatgtgtttatgtcaaaatattggcaggaaaacttacatcattcaattttattataaatttgaatagcatttcaatgatagcctaccttccaccattactgtctcgcactggaaaccactactaataaatgcatcatcataaatcacttaaaacatgaagaaaaaaaggaagaaaaaaagctcctaaaaaaagctgcagaacatttcaaggcaaaaagacttccgaaaatgtagtgattggacttttttttaataccagttaagcaggtgtttaaatttaagagtttatcagagtttgctcttcaaaagtacacttgaaggcatgattctgggcaccttggtaacagcctcacaccgaatccttttgtgctgcctgaaatacagatctgctggctgagcccacctcgcttggcaaccgcaagtatttggggccgggcctttctaatctgcctagtccgccaaggcggccggagccctgcagtggtgaggaggccccatttggccgagctgctgctaagcacggtgccaaatcaatatcccatcagacgacgctttgctggcaacaattgcaattgatggcgctcgcaaggctgtgtgatgtcgctgggtgtttgcaaagcagaggaaaatccctctatgcacaagcggttctgacctcactccagtgagccactcgcctgtctttagtgacaggctcactccagtgagccacccgtgaaatggttcaggaaagaagcagtgcggagaagaggctgcaaggaaataacctacggggatgaccagatgtgactcatgctgttcacctttgaagggaaggaacattttggagcggggtggcactctaacttgcctccaagggacagaagagagaatacccttcttgctctcagcaggcaaggactgtgcaatgcacctgaaagaaaacagccaacatcaataatgcactgggacccatggctgacatatttttcagctatctgagtaattgaacagttgccaaaatatagctctcaaacgccatgtgtggacagagccatcactgatactgaaagggcaggtttaaccctggatggtatccagagggcatatcgcaaagtctcttctttccctaaacataaatactgctaccaacacatgcagtagtagtaatagaagtatagtactatttatttttggtatgttgtatgtactattttttttacaagcatgatatcctagaaaatcctcacattgaagctttaagtaactcaatcaaggtcatatagtaggtagtagaagtggatttgaactaaagcctgtcattgacctacagaaccctggggcctctcagaagtaggtattttggtgtgagttgagaggctagctctgtgtctgatcaacaaacagccctctgactcaaagccctctgacaatggtactatgattttgcaattaccaaccacgtcaagctatctttaagcagctttaaagatttgagaatgaggagacaaagcagagaggaaaccactagtcgaaggctacaagtgcagacactggcaatgctgaaacaaaaaggaacccgcagttctcgtgataggaactgcttcaatcattcatttgagggtctgcacggccatgctataatggttcccgagacctcagggagtgcatactgcacagcttttacagggaggcaatgctgtattcacaagagtttccactgaaaaaagaaaatgtccaagcatgctgagcaatgtgtggaatattggaagcagagtcagggaccccagataagaaacctacaaatcacatatctgggaaactctctatcaccacaatccattttcttgtttttgcctcaacagcatttttccttctctccacaaggagtcaagagaccacagtaaaaatgttacttgcctgcttcactaaggcaggacaaaaatagtttcttggtaccattttcttgtcttttaaacttatcctattccttttatctagtttttatttcttgcatctagcaacagatgcaagaaatcaaaagaaaatgttttcctgatacaatgcatggaaatgaagacaagggagcttggattaaatactacacagctgaaaataatgcatggagctaagtgagccagcagccttactgttaataacataaataaaaaaatagtaaaataacaacactcctacatttatctcccttcttttcacaggcttcccaaatcagagcatagaattatgctgagtgcctaaagggctctgccctctgtgatctgtactcaccctagattaatgaggcattcctaacacctgtgctgacatttcttatgctgccttcccagccatctcaggggtggttttatctacatgggagcaagcctctaaattccagcagtaccagggacttagaaggcaatgaccttgacatgcgcgggctttcttctcaccacccaggaagcaggggcctcagcaccaatatcagccaaaaaccatcttccactctggaattaatcattatttcagagtttccacttcaaatcgttgttttaggaaaacccagatagcagaccaataatggagtttgggaaaggaaaccccacggtttggatcaaggatggatcaaggatgcccttttagatgtccttggatggatgtatcaaggacaccctttaagaatctgataaaagttacaaactttgtctctacctatttgaacaaaataggttatactatgatttgcatatattttaggaggctcttggaccctcctggagaccatccaaaagctgccttccccaaaaatcctgctgcagttcaatgacgtgcaagccagcacatatgtgtgcatgcgatgtgtgtgttaacctagtttgctctttttagcattacaagaaaatggcataaactaaaaggggccagataactaacagagatatattcaagttcttcagaaagggaactatttaatgagcaccaaatatatgccttgttttctaccaggcatgttatatgtgttcttgcattacatcctctttacagctgcataacagcaaggactgtgcctttcatattcacctatctccaatgcctttcatagcagtagtgcttattgaatactccttgaatgaattaattattagtatttcatagatgaggaaactgagcctctggatggttaagtaacttatacaaatcagacagggaataaatgggagagatggaatttgaactcaagtctttctgtgcaactttcccctgtgcttcaatgaactttagatgtaatcttctctgagactaaataaaagacatgaacataataggtaaccaaataatgtgctacattggcgaccagagctgtgggaaaaaatgcaaagtaaggtcagggacttggagtatatggagcaggaaggacacattgcaatattcatcagggtggttagagttggcctcatcaagaaggtgagatgggagccaagcctcaaagaaggtgagcaagtgagcagaagagtaagtcaggaaggggcaacagccggatcattagaggctggcataggaaccagcctcaaatgcagaagtatggctggtggttcaagaagcaaggtggctaatgtaggtggagttggaagagccagtggagagtaataagaaatgacgctggagagaaaatggaggctaagcaaaaaccattacctctccagtcactgcaaaggcatgggcttttactcagagtgaaatgaggactcattgcaagacttggagcagagcaggtacatgatgtgacttccgtttataaaaaccactgtggctgctgggttgagaatagaccatgataggggcaagggcaggaagggaaagtccaggtaagaggctacatctagttcccaggcaaaagatggtggtggctcagtcaggcggtagccatggaaacagagagaagtatattctggatacgtgagagaagagtagacttacagatgactccaaggtttttggcccaaggaacaaaaccaacatatgttcaggctcatccctatgttctaagagggcagaagcctgagggctgattcccaaggctccaaggccaatctgagagaaacaataagatgttttgccatttccaaagatgtttccttttgttcatgagagagagagagagagagagacttactctgtgtagcctgttagaaaaagaggaaggaaagagttccttaaagagcatgtttttcactggatttgagttttgtgagtaaagtgtgtgctttgaaatgttccctcccttcatgtcggaggctgcataatcttctctcctgcactactggatgctgggttacctggacctagccctgctggtcactaaaccctggggcctcaaacagctttctaaagctaggagctctgggcagatgctgacttcccagtgacccaaatctgacaccaagattgagaggccagggctcctctctcctgtcccccgacctctacataaaaaacacaggcatttctggctagcctaggctgccaggaacatgttgagccatcagctctgaacacaatcaagagtgaatctggaggtcccttccagatcccactgctcagccaggaagatagtctatgggaggttaaagcagaaattaccaaaggtttttacagaggataagtctcccacttacttgctttcagggcttgccttttaaaatactaaaatggaaaagccaagatggcacaaaaactatagttttgtaaggaaaaaaatgtattgcacatccactgtgtgcaaggcactatgttgagtattcttaccagcactgtcttgctgaatctacacaacttgtagttgtgaattcagcattattactttttttttcctaaggaaagtttagaaaggcaagcaattggcccaaagtgatccactagtcagtacagatgtctaacttcaaactacagctttcaccacagctgtctctaaggtgacaggctatcctgtctgctggggactaagagggttcatgggattttcaggtttaaatgcaagaaagtctctggcaaaccagaacaagacgatcaccctatctgtctcattaaactaaagtatgcacatagaaagtgcagtcatttcaagaatacatagaagggtaggtagaatgactgcctagagggtttacctttcagaagagcaagctctttcccacctagttaatggccagtcttctgcagtcacaagagtggagtccttggtgagaatttactgcagagcattaatccccattttcccaaacattcaaccccacaccaggatcacctcttccagctgactctcaaagcaagcttgtcacttgtgtttccaaaatcccattcccttttgcatctgtttgctgcaaaatgtcaactgcatctcctgctttggtcattgtaatttatactgctgactcatttacccaaggactctggcccagtatcttgttgagggaatgtcaatgaattcagtggcttgggataagattcaactgcttagaaatgtggtgttacttctccggagcctgggttgcaccatttgctggccctgctcatgcattcctcccacaaacacttatgccaacattgggccaggcctggggctgttatctttacatgactttgtcatttggcaaagagccctgtcttcaaggagtctcattggcatggttcaaagaaactagttgcaaaaaataagccaaaacagttgaagtgttgccatggaccctgtggctttgagcagctagcccagctgtgccaggggccagaacccctcgctgaaagctgctgtgtgctctgggacagtgctggcaaggagagctctttatcagatgggccctctctacacttctctccacaggccaggagcacaggaaggaacaaccctctggatcacctctcaatctcagggataatacccaaaagggagagaaggttgaatgcgtcactgacccaggaatagatggtaaagggctcctccttctccagcaggaatgtgtgagccactctgcctatcactgtcttactctcgcaagtgtcccccatggcataggtgtgctggtaaatgtctaacaactggctctcaagattggaagtgggggaagaaactcttatttgtagcatttactgatacctgtggcccactgtagccaattccaagctaccaacatgatggcactgaatacagagtagggaagagatgccacaaagagtaaggaaaagatgctgtcctctccagagctgcctccagcccacctcctctcaaaaacccacaccaagaactcaaccccttatctttagtcacactatcttctgattattgaatgagggaggagggaaattttgtgcttgtaaaaacatgaggaagcacatgatattttgcttgactgtagcggagggtatgtggatttttactactttaagtactttctccctttactgctaaacaagttcacatatatgatttcagagcaacttgacaaactgctgtgaaagagaagcagcagttattgttgaacagataagcaaacagcctcagagagtggctaagagagtgccaaccaaacaactaaatctgagtcccaagctctatcattatttctttactcgtttgtgcaaggaccgccctcatctccctaaggaagagtccagcggtccattcagcagtgagttcgtgatgatgggctcccagttttaaggctttcagtggtttcctattactcataggatgaagtcccagatacatagcatggcacaaaggctgtctttgccttgacccccaccttctctccagctccatctcttgttttgcccatctcctcaccagccctgcaaacttgtctaacctccaaccacactgcttggagttcacttagcatgagcagctccttcacagctctggcctctagctataccttcctcttccccactatttggaacactcctccttgtgccctctcccagcccctgctaagatctgcatatctttccactaatttatggtccttatttctatagaaagtaatgtgcccctctagactataaatcaactccttgaaggccaaggtcagactcaatgtgtcctctagaatatataggaaatttataataaatgcttgctgaatcattctatttcattacaaaaaaaacagccttgcttctcaaaaacaatgttccatgctcagcttgcctgaagactgaaaatcttgggaaagcaaccagacatcccatcagtggcatttccgatgaggggcagacccttgtcagagggaaaaacagtgtgaagtcagacaacaatcaggttatgtgcccatgacaggcagatccagcacccttccatggccggacatggactcctgccttaatcctcagtcccttccttccagacaatggcatttgagatgtgtcacacttagcagccttccttgctaaaactggttcaccctttgctactgtctcagttgcagctgcagaggtatatgggttggccagaatcataccagccctaacctgggccaagggaatgccaagagggacacacggttcttattatatttctccagcccactttgggcctcaaatatatgtgtggcttttcttcatcctttcaatataccaaatatgctgcttctagcatgtgcaatcttcatcagtttagtttacagaattagaaagctgctgctgggggtgcttctctgtttcctgaacttgagaaacagggtgcctcacacattgactatccttacgcgatgtgaatatactgtccaggcctttaccccaaactagacctaactgaacactgcctgcagaataggcagtcgacttacagaatgatgtgaggtcccccacatctagctcctctccagtctcaacaggtgccaagtcccaacatcgaccccatgcttaggccaatatttcccataatattatgttgcatataattagtcattggcatcacaaacatggcctttgctcaaataagttatagaaatgctgagttacaaaatattaagatggtacctttgctacatgacatctgagagctttaacttactacagcatattatgaacctccaaaatagggtacagcaggcagtgtttccaagacttcatggaccatggaaaactctactcagccctgccttttatggatcatcttgaagcattgatgtgctcccagtataactttgggaactgcactctaccttcatgctcattcattcactaagcaggcagtgcacttcaaccaaagccggggagaggaagaactagtgcgttttggaaaatgtttcttaaagcccacgtcagagggtgaagtcagacaacagaatgctaaacagaaaatcttaaagtatctccaaaacaaactttttaaatcttcagttgtagggccatagggtgcataaaatgtcaagagaataaactgtttatttcccctgacatcttgtcaatcttaccatggtggaaagactataggattgggaattaggtatacctgggttcaaatcttggctctgctcctattcatcagttctaaatctgtcttgtggggctgtattaagaatcaaatgaacactattacataataataagcaattaaaacatgtcttaaaattattgtgtttctatggcatggaaaacatcccactatgtcttctgcacataacctatgttttatttatatagaagcaattgttctactgcaagctctggggtatgtcctggtccaggacaaatttgtattagtcagggttctgcagagaatcagaaccagtaggggatagaaagatagatagatagatagatagatagatagatagatagatagacagacagatcaacagtcagccataaagagatttattataacaaattggttcaaagattatggaaaataagaggtcccaaaatctgcaatgggcaaacaggtgaccctggagaaccaatggtgatggtccaggccaaatgccagcaggctcaggactcaagaagagctaatatttccatccacatccagtccagaaaagaccaatgtcccagcttaaatcagggaggagaggttctctgccttactcagcctttttgttctatttagatcttcagtttgttggatgagacctacctgcatgagggagggcaatctgtattactcagtttactgattcaaaagttaatctcatccagaaacaccctcccagacagagtcagtacagtatttggccagatgtctaggcactgcacagcccagtaaaggtgaaacataaaattaactatcacaacatttaaatatagctactgaattaactaggttgagtaaatctgggatttggggctgtcagaagaccaaagtgccaaacagcaagttggaatgccaaatgacaacccaactccagggctcagatgcctaaataactggaggaaacattcaataacctagctggagtaaactcttcagcaattttgtctgctgcccactgactggccctcaaaggtcagtagatcacggctccaacttcattgccgatacttggagaactataaatgagagagaaaatgctctaagccaccagacaaagcatcccatggtgagagggatgttttgttttattttcttttaatcatataaccttaccttgttggtgcattttaaaagaaaaaatgatgaagcctcccagctagcctcagccaacactgataaaaatgtgtaactgagactcacactgggaaatgggtaggtaaacagaaaagcgtagttgctagaagcactaaaacctcaattaatgagattaacgaaagtaagccttcatcctatggtactcttaataggaacacaagtcacaagataaggaaaggtgctaataatgctgagtgcccatgtgccacactgtgcccagccctttaaagacataaatccggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtggcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaagacataaatccacataattttcaccacaaccctgaagcgggtaatcatttattttctccattttatagatgaagttcccaaaagttaagtgatttgcccaaggttatatgaccttggcgagcctttctctttaaggacagagaaatcatataagtgattatatttgtccttcattaaaaataataggaaactcaaattctaatgatcttaacacaatccctgctcatggattttatttaatctctatttttttctttggttcttgcaagccacatcaaatccttcgtgaatcaaagtaaagaaagataagtagaaaggtagacacacaggacatctggactgacaatccacatttaactgattccaaagctcttactctttttactttattacgttggagatatttagctgaacaaagtttttgttttgttggagtttctgtttatgcaccctgtggactttctagggtacatccagacatatatcttgggcctgcagcaggccttcaagtaatttcctctgggatcatccccatcatctctcttctatcaccttgactatatatttgaaatttttcatttgaaatgctgaggattcacagggaaagaaagtagaatggtggcagccaggggctgaggaggaggacaggagtctcagtttaggatgatttttaaagttctgaagatggatagaggtgatggttgcacaatagtgtgaatgtagttaatgccactgaattgtatactcaaaaggttaaaatagtaaattctatgttatatatattttgccacattaaaaataaataattttaaaatgttgggggacagcaattaattattctgaaaatttgctatagcaacaatggttactcttgacaatacacagaaaagatgaaacaaaagtagagagatttacaaatattgttatataaacatgaaaaaaatgaagtaaaatacactaaataagccagaccccaaaaatagtttattttctaaaaaagaaagttatacacagattatttgctttcaataatagaaagtacctacaggagtaaatgttatctttgccattataaagaaccttcaggggaatgaggaaataggatgttacttctaagaatttccaatacataactgtgtgctgttcctcaaagcactgtcttcacctatgtcttactcctccgtgttaatgttgtcatctagaagaaaaatgttggattaagagatattccaggtccttttcacctctaacattttatatttttgccatctttttcatgttctgtacaagtccttgtacattatacagttagataatgaggacattaactaattaaaaacccaacaaacctacctctctggattccttttatttgcaaatcaagtcggaactccttggcatggcaaagaaggcctcccatgcctacagttccagcctcctcatctcccatcactcttacgtttcctagactataatcatatgcctttactcaagtgcaccatacaccatgcctttacatatgctctttccatgggccagaggcccctgcaatgcctcctctctcccaacacccactctctacatgggtacccattcctctgctttactctgacatttccttcaacctaactcaattatcaccccttcagtgagctcctctctgaccttcactttcccatgcccccacccctcattgtcagcatcaccaacataaaagcagttgttgtaccttctacatccccgttttctactttcaactatccactgcactcacattgaaaaaaagcattttttggtaatatgcttatccccacagcaagtgaatctgtgtcagagaagagtcccttagactccatcccatgcccagtgtctagcatagcacaggtagtgcatggcaacttttcagtttttattgacagtatagaagaaaggaagggagggaagaatgaaggaaatcaacatttctatatgtcccaacaaactccaggctgttttactatgacatttctaaagaataatttcttatttgtaaaaataagtggaataaattctgctatgcttgagagaaaaataaatccatagttctagttgtccccattagtcatccagtgccataaattaaacttttgcctggtggcatattaatctactttcccttaaattacacactcatgccatatgctttaagctaccaatctctattaaattaaggaaatagtaaagatgatatggaaaatcattcaagaaaattacttgaatttttcagaaagccatgtaattacttcagtcctggctaaggcagtgtaaatgccgttagagtcaaacattgatcagccttcccctttaacttagactgactcattcataacccacctacttaccacaataagaatgcccaataaatcagcccaaaacatcaaatggtatctgaggcaatgcatgagatgaccacgtgtacctatacacacacatgtgcatacacacagatatgtacacacctgttttcctgctcctgaatttctctttgatgaaaaatttagacccaagctgcactccaactgaaggccagatgtgtttccatgttctccctagtattcaaacaagtgtgccagaggaaaaaaaaagaactggacaaacatgcctgtaagaaagggttgattcaattcaccatcactttggcctaaatacaactactggaatttccacatagcacagtagatcagacccattgaatgttttggtcacctttgatgtcacttcccacactgaccccccttgctaaatatgggaccaccatactggaaattaagaagcaagacccagatctaaatttgcttgccccctcaatataagttgttcttttccttgttcatttctaaaacattcttttgaaaattatagcaaaaggaggtcaacctgtcacatcaaacacagatgtgacatcaaccagcaaagttcttctcacagggattccccacacgtggccttaaaagtaatgataaaaatttgatttgggtaataccggatacccaagatatatttcttggccaaggacaattgaaagttggttgtgtgtttggatttctggattctttgaaaccatgacctataattcaaggtatttactatggtttggaagttttgttccctccaaatctcatgttgaaatataatctccaatgttggaagtgggtctggtgggaggtttttgggtcatggggatggatccctcatgtatgacttggtgctgtccccatggtaatgagtgagttctcactctggtagttcacttgaaagctggttgtataaaagagccttatacaacctctcctgctcccactctcaccatgtgacatgctagctccccctttgccttacacaatgattggaagcttcctaaagcatcaccaggagcagatgttagcacaatgcttcttagcctgcagaaccgtgagccaaaaataaacctcttttctttataaatttcccagtctctggtattcctttatagtgacacaaacagactaacatagaaaattggtacaaagtagtggggcatttctataaagatacctgaagatgtggaagcatagtgccagtatttgcttctgtgggggcctcaggaaagttacaatcatgatggaaggtgaaggaggagccagtgtgtcacatggcaatagagtgagtgagggaatagagtgagggtgagagaaagagagagataccaggctccttgaaacaaccagattacacatgaactcacagagtgagaacacacttattactgtgagaatagcaccaagctattcttgagggatctgcccccatgacccaaatatttcccactaggcccatcttcaacattgaaggtcacatttcaacatgagatttggtggagacaaaacatcgaaaccctatcagtattcttgaagatcttatagtagttagaaaggcagaatccttcttccgtcttgtttgttccctcaaaccacattgactgaggccctcctgggtacacacttaaaaaagagcatggtttctttgaggtttcttgggaatggaaagaaacctcaaagaacatcatccagagtgatatactggaggtctactagtttttttgcttggcatatttgggttcaaatccctattctgccactcagctgccatgcccttggcaagctatttaacctccctgaaactcagcttccttatctgtgaagtgacagtaataatactatcctcaaagggttgttacaagaatgaggttagcaaacctatataaagcacctggcatgatgcctccctcattaaatgtcaattcccttccctgctttctttcctatctaggaagaggcaattgtccaggaaaaataaaactcattcctgggaggtctggagtgacaactgcttctacagcatggcacactgccaaatgggagacaaaggcacaaaggatgacttttgaggtgaatgctgtttagtctttgtgttcctggtgttgtctcctggagactaatggcagaggcactggccacttgcctgctcccaagagcaggccatggagaagctggtttattatgggcattttgcactctgtacatgcatacacggaggcctctcagctctcccttggcctcggtggcattgcttcacatagagaagccagaattgtgaggcttccccagatgacttaggagtgcatgacaacccacataaaaccatattctattcaatagagagagaggggctcctgctttggccagctgaaactcagttgccacttacaaataagggagaattccttgggctaaaagcacaggtccagaggttgtcagttaaataacatcaattaagttcagagttttatcacctcaactatctcatgcaatatcctataagaataaaaggagacaaaaagaatgtggtgaagacattagagagtgagaaatttcaacagatatttggaagcagaaaagggaggggagaaggtaaaatatggctattctaccagagaagagaatgctataatctaaatgcctatactctgctaaataagagtttgttgattctcactgcagaaccctgagaagacccccaagacttgaaggaatcaagttcagtggaaagtaggggtgaggatggactggaggacagaggtcttagcctgcattcctatccccgtgatgctggcagccagacggatgcctctcccacccacttatgcccaggtagcagactaaaacattcttctcttgagaaactgaggagctctagagaaaataacacaatgtaccattcatgattctccaaaaagagactgactaaaaagttgctcaactgccctacaggaaacaggaaagcccaacaatcgacaagacccacccacatagagagggcttgctgttagcttgtaatgctcttaaatacaaacggacaatgattgtcatgcatttaagaaaagccttctaaatgatatgagtcaaaaacaaataacaaaaaggaacctggaagaaaaatcaatacaatgcagggaagagatgaacttttagagaaaaagagtaactgatatctacagcgataagataaaatattgcagagaagaaacaagaataggatgctacccaaataataggagaagagaatgagagagctattagaaacgaaaagtacattagaagaaataaaaagattcaacacaaagggtagagatgagcttgaaaaaagtctaacataaaggaagacaaaaagacaaagacatggaaaataatacaaaagatctttaaaaatgagaaaacaatcaattacgctcagacatctgactgagatgagttccagagggagcaaaatgagaatagaaggaaataaattatcagaggaatagtgcagtaacatttccaagaataagacataaattcccatattaaaagggtcctcacactgcccagtgtaaagagaaataggacacacatcaaggtacaacatcatgaaagttcggaccagaactagagagaatatactaagaagtttccagagagggtgaaaaaagtgcagttggcataagaagaactagaatcagaatcatagctctcaattataatacaaaaacccaaaagcaatgccttgttttgagcaaaatatttctcaacctggagctttatgcctagctaaaatttcaaacaaatgtaagagtagaataaagacattttaagacatgcaagttttcgaaaaagaaaagtatcccttttctcaggaagcaatagaggatgtgctctccccagggctcaacttgacttttctcctgatttggattttctgttttttgggtcccatgtcaaaatgatatacacactaaatattgacgatggaggccaatggataatgtaaatacactgggaggatacagagtggggaaatgggactggtggtctaaggaaactgaatctttgtttaccagaagaggaggtcaatggattatgtctaaactaaagaaagcaataacggtgctacacgcatgtattattttgataaatctatattaatttaaaataaaaaggaccaaagctgaactatgactcaccatgcaatttatactggtcacgtccaaagtataagtgactaatgatccagttcaaatgcatggcagaaggaacccttcaaacatctctttgagatctgaactcaatttggttttcctcttcaaggcttcaggaaaaaatagatatatatttttagctccaagaacctgccaaagtcctcccatatgaattgtggttaaaaacttcatgtctcccaagctggtgaaaataagggtcaaactacaaaagaagatctcagcatgctcaaaaattccatggttgcattgaccaacgggatagtgggaaatggagacaaaaggcacatttctagctaatggtgatggaagaaaccacacttaccccctttctctcctaaatttccaataaaagggacatgagataattttctttttttaaggtataagcctggaaaaacaaagaaaatgagagaagatacaatagcaaaaatatttaggaacctgacaagcaaagagatgagtaataactgattcaggagacccatggaaaaattaaaatgcacagtaactggtagcaacatggtcctctggaagagaaaggtggaaatggaaaattgggtaaaaatctgatgaagaatcagatatctagattcagtgacctattccacctagatagacaatttccttatcccaataagactgaaggtttagtctttgtggatgataaagtagaacatctctggagggagaaggacatacactcctcttccccgttagctcccagaatgttggcagataagcgtccagcttccattcagcctggatctcctaaactcaatccatcctccctcttcatcctcccaagcagctgggactacagggatgtaccaccacatctgacttttttttttttttttgtatttgcgtgttgcccaggctagtctcaaactcctgggctcaagcaatcctcctgccttggtctcccaaagtgctgggattacaggcgtaagccaccacacctggtctggaaaatttttttcttagcaatttagaccagtccaagagaaaagtccaactacactatattagaaattctgccccaaaacagcttaactagataacagagaagcccacaatccataagaaccacccccaccattttctctctatccatgtatacagcttacaactggagttttacttacttgtatttagttttattctttttagagacaaggtcttgctctggtgcccaggctggagtgcaatgctctgatcatggctcactacagcctcgacctcctgggctcaaacgatcctcctgcctcagcgttctgagtagctgagacttgcaagctcgtgccaccatactcggctaatcttttatttatttatttttgcagagattgggccttgctacattgcccaggctggtttcatgaccctggcctcaagcaggcagcctcccaaagtattgggattacaatactgcctcagcctcctaaagtactgggattataggtgcaagccactatgcccagctttacaactagagttctagtgtccttctcttaaatatgagcagtcaggaaacgccagacatctgacaaaaaatacataatgaaatagatggagattagagagagacagagatagagagaagtgggaaaggggagaaactgagaggaaagagattttttaaggaaatggaaactttaaaaaaactactaccctccatactttaccaccacatcaacagggctcctgtacaataacaggggatttagctaaaagaactccaagccgcagaccccatttaaggagtctctaggaaaactcaaaaacaaccagagagacagaaacaagaacattagaggaaattttattgcaataaggcaacccaattcctcaagaattaggccttagaattagactctacatcagttcttttatctgatacatcatatatggctttcaacaaaaaattataagccatgctaaaagacaaaaacataatctgaagtaataaagtataaaaaacagactcaaatatggcagagattttgcaattatcagacagggaattaaaataactaaaattaatatactaatggctctaatggaaaaagcggacagtatacaaaaatagatggataatgtaagcagagagagggaaactctaagaaaaaaaaaaaaaggaaatgccagaaataaattttaaaaaacagtgtaaaagaaatgaaaaatgactttggtggactcatcagtagaatggacatggccaaggaaagaatcagtgagctcaaatatatgtcagtcactagaaactttcaaaactgaaatgtaaagaaaaaaaaaaagatagaacagaatatacaagaacctaggacaattacaaaaggtataatatatgtgtagcaagaataccagcatgagaaaaagagaaagagacaaagagagacaggtagggtgagagggagggaaggagggagggagggaggaaaggaaggaaagaaggaagggagggaggaaaggaaggaaagaaggaagggagagaaggagggagcaagggagggaaggaaggaatttaaagtaataatggctgttcctacagtggaacaaggataagaattgcattgaacttctcatcagaagccctgtaagcaagaagaaagaaaagtaaaatgtttaaagcattgaatgaaaaaaagcaaacaaagtcaaaaaataccaacttagaattctgtagccagcaaaattactcttcaaaagtgaagaacaaataggctttctcagatgaacaaaaaccgagtaaatttatcaccagtagacctaccttgccagaaatgttaaaataatttcttcagaaagaaagaaaattatgcaagtcaaactcagatctacataaggaaaggaagaatattaaagaagaaataaatgaagacgagataaaatcttttttcttaattatcaaataaaagtttgttaaaagtaataatagtaatcatacatttaaggatcatagcttatgaaaaagtgaaatcagtaacagcaatcttataagggacaggagggatgattgggaattctctattataatcatgaagcagtagagtgttacttaaaagtggatttggatctgttgtatatgtatattgcaaattctagggcaatcaaaaagaaatttttttaagtataattaatatactaagataaaaaataaaataaaattttgtaaaatgctaaattaaaaccagagaagacaaaaaagatggaagataaaaatgaaacacagaagggagacttatagaaaagagttacaaatatggtagacattaatccaactatctcagtaatcaccttaaaagtgagtgacttaaatatgctaatttgaaaacagagactgtcagcatggataaaaaagcaagacaaaaaaaaaaaaaaaaagcaagacctaactatatgttgtccacaacaacaaaaacaacagaaactatcacatttaccttcattgagagaagggaataaaaaagaagtcttagaaattaagaatatgataaaagcaattaaaaattcagtcaaaacattgaaatacaggttgagaaagtcttccatagagtacagaaaaaaaaccacacacacacacacacacacacagaaggagaaatagaaaaaaataagaaaattagaaaatccatccaggacacagtaaaagttaaaagtatttcccaggccataattccagaagaaaattctagagattcaaaataccacaacctcaatcctcccctaaacatttattgggcactcatttcatacctgtaccatgacaaagaccaacatttgacacaaaacccgtatgaaattgttccttccttgttctaataagtgtgtaaggtgcactgcatgaatgttcatgatttggaaaatctagccatggtttcctcctgaatttcacattgccagatataagcccaagtgccctctggcctggtccatgcctacagacccaggcaggcaagcagtgccagagcatggagattgtaaatggtatctgagtcactcagtacagtatgccagctaacacaagcttctgtgccaatattcgtgccttcttgtcagttcagccttacccctggcacatatatattctgattcatctggccttcactccaggacttcaggtaaaataaggacctttggccaaaagaacatgcataaaattggccacaaatactataggagcaaaggaatgaagaaaaatggaagctcggcattcaggtacatttactgagggcccacccttctctggacacagcatgagtcactgagggtacaaaattaacaaaatgtactcatatttatgacaagggaccccctcatagtgttgttatgatggccagaaaaactagataaaaactaaatatttgaaaattttaaaaaagattatttaaatcatggtagagccatatgaagaaagggataacataggctttaataatcacagagagatggatttatatgtaaggacagatgtttatcactgagcaagggaagagatggcaaaatagaatctatttttgattccaactttgtttttttaaaaaagcacagagagcccatctaatacgtctgaatcaggatttctcagcctcagcactactgatgttttaaattggataattctgggttgtgggggctgtcctgtgcattgtaggatgtttagccacatcctggcctctacccaataggtgccagtagtaactccccagtcatgacaacccaaaatgtctccagacattgtcagatgtccctgggaggcaaaactgtctgcagctgagaatcactggtctaaatgaagaagtctggaagggcacgcagcagagattttgattctcactattcaacaaagtcttcaccatggctgctctctctgcttggtagaataacaggtgatttgtcttttcatttcatttcttttcttttcttttctttagagggaagagggcctctgaggtgtctttaaagattttcatggcataagcataggttttctgagaagctattattttaaaaatactgcacagtcaagatgaaacaaagaactcacttggtcaacagagtttgttaataaactcaaagtgaaatgtactatttctgcacatggacttgggatgttcaacttagatatatttgaaagagatgattttttaaattcagagaataacagcattttggagttggaaaagacctctagcattcctctagctcaggggtagacaaactaaggccatgggtcaaatccagcctgctactgcttttgtaaataacattttttggaatccaaccatgggaatggtctgtggtggctttcacactacatcagcagaactgagtggttgccacagagactgtatgtcccagaaagcctaaaatatttactgtctgatcccttgcagaaggattgtacccatcctctctccatgtgcaggtatctcctctaggacattaggccttggctggtggcctccgtttttaaaaccatcagatctcatgagactcattcactatcatgagattagcacaggaaagacccacccctataattcaatcatctcccactgggttcctcccatgacacgtggaagttgtgggagttacaattcaagatgaaactagggtggggacacggccaaaccatatcattgaaggactaacctcagtctatgcaccactctaataagatgccaatgaatcatcatccctcaagatggtacttctgccaccaacctagcagcctttcagagacttccctctgattaagccacagagatgggtggtgttttctgagcgttgaattctgagatcagaggcaggtgggaagtaacaactgagcttattggaagatgactttaattgcctgagaagaaactacaattctccttgaactccccagagaaatttcaaaaactccagagcagctctgagcacaactacacattggtgaccagtaaaatatctcacattgagatacatgaaaatatctaccagtaaaatagctaccagtaaaatatctcacattgaacatactctcacattgaacacatctcacattgaacatactttcacaaattggagggtgctgttagggaatgcaaggggaggcagtggactgacacaaattaaacttgatagtgaggcctttcacagacataccacagcagggaagagggtttcacataaaccagatggcaaaacagggcttctgagagtgaggagctattcccatcttaaaagactcgggtcttcctgtctcttttcaagagaaaactcaagggcattttccaaatcaggctcataaggaccaaaactcttaaaagcctgcaaaaatataagaaaattaaatcagtaagtaccaaaattatatataactagttcaccatccctagattttcaagctttgagcagaggagcagatgtgaagtgatgataagaatctgtttctgagacactaaagacagtaggtttgaacacagattctaaaatcttctaaagaatagtaccacattcatagcattttaaagacacaaaattgtgtaaggtacaaaggattggttatatgaaacttgtcagaatccttcccccatcatgagatggtgcaggaaacaggggtgggatgaggtggcaggcaaggatagcttgatcacaaccaattagcctgggattgtggaaccatggttgggatttggattcctctggagccacagaggtgttgggagccaggagcccaccaggtcaatgtctgttggggaaactgagattcagaccaggagacctctggaccatagtcagacagcagctagaactaagttcagagctaataaggcagattgtgagcaaaaaaagcttggaaatgctgaaggtgtacccctactatgtggagattggtagctcactttatgaatcagtatatgaatgccataagagtgtaactcacactgtcttaaagagaagaagggtagacaaaacaaaattcagtaagaaatccacatcagttacctgcttgcccactctgcaagataatatagatggtcaaataaatgaagctgattttccttgatgttctcccagtctcattttggtatcttcacacaaagtgagagttacttacaattctgccttaactcatttgtggcaataatattatccttcagttgtgaaaccataattctgttcccaaacagatgggccattagaaacctaaactttctaaacacactgagaatcataagggaatccttgtattgaagagcacgtgtctctctcaagatggacatgagatctcttgtgggttttcccaggacttgggaaactcatcttagattgctggagagccctcattactcagcctttgtcacctccaaaatgatgttttctatcttctcctgcttccttattttcctcttccttcatcttttttcatcttcttccctcctccttctcctcttcttctttttctttatttttccaaaatttattatgtgaacgataaatgatccaacttcatttttgacaaatattttgccaatggctgcaacacattttattgagataactatcccttcctgaccaattttaaaaacctaattttagttttctttttttagtttgtttgtttgtttgaaacagggtctcgctctgtagcccaggctggaatgcagtaacagaatcatagctcatggcaacattgagctcaagcaatccttctgcctcagccttacaagtacctaggactatagacacatgccaccacatctagctgcttttttttttttttagagatgggatcttgctatgttgcccaggctggtcttgtaatcctggcctgaagcaattctcccatcctgccctagcctcccaaaatgttggtattacaggcaagagacactatgctcagccttaaaaagctttcttgattacatataaaacatatatatacatatatgtgtgtgtgtgtgtgtgtgtgtgtgtgtgtgtgtgtgtgtgtatatatatatatatatatatatatatctcaaactcctgcctgcttcttggttattgtgatgcttcaactttgatcagaggcagtaaagacatactcctcctcttcccctaagagtagcagtattatcttatgaggttttctgagtacatttaggagcatcctttggcaatgaggtaagtatagctctgtgctagaaggaaggtaagtgcatcaaatcttctacaaattgaatagcatatgagcacccccataacagttataggtatagaaataaaaggagaaatgggttgactaagatgctatcaaatcatgacatgaagtttcaaagcaccctgtagttccacccgagggaagagttatatttataaatataaatatattgtccttaaatatatatatatatatatatatatatatggatgtggatatatttggatccatatatatatttattatgtttacatatataaatattatatatatatatctatctcaatttctgggctctttattctgttttattcatctctgtctgtctacatgtgaatccatgcacactgttttaattgttatagctttataatatatttttctaatagcaaaaatcctccctcattgtattctttgtttcttaaaaataactgtccttttatttctaattttatgagattacttagaaataaatattaccttttaacatcaatttatctagtaatgaaataaatttctaatactgaaccatctttgaatttctggcatatttacttggtcatgatatagctacagtcaatttagtaatgcttttagaatttctgcatctatattgagaaatgagattggcagtagtcgtttttccctactcagatggtatattttctgagaaaatttttaaccaaaatttgcaaagttgagcttattatatttctaatttctaaaatccataagaccaaatagtcctaatgagaaaagataatcctatacaccaacaatagacaagcagagagccaaatcatgaatgaactccgattcacaattgctacaaagagaataaaacacctaggaacacagctaacaagggatgtgaaggaattcttcaaggagaactgcaaaccactgctcaacaaataagagaggacacgaacacatggaaaaacattctatcctcatggataggaagaataaatatcgtgaaaatggccatactatccaaagtaatttatagattcaatgctattctcatcaaactaccattgccattcttcacagaattagataaaactacttaaatttcatatggaatcaaagaagaccccatagacaatcctaagcaaacagaacaaagcaggaggcatcatgctacctgacttcaaactatactacaaggctatagtaaccaaaacaatatggtactgctacaaaaacagacatatataccaacggaacagaacagaggcctcagaaataacaccacacatctacaaccatctgatctttgacaaacctgacaaaaacaagcaatggggaaaggatctcctatccaataagtggtgctaggaaaactgcccagccatatgcagaaaactgaaactggaccccttccttacacctttggaattaactcaagatggactaaagacttaaatgtaaagcccaaagccataaaagccctagaagaaaacctaggcaataccattcaggacacaggcatgagcaaagatttcatgaggaaaatgccaaaagcaattgcaacaaaagctaaaattgacagatgggatctaattgaactaaagagctcctgcacagcaaaagaaactgtcatcagagtgaacaacctacagaatgggcgaaaatttttgcaatctacccacctgacaaaggtctaatatctagaatctacaaggaagttaaacaaatttacaagaataaaataaacaaccccatcaaaaagtgggcaaagaatatgaacagacacttctcaaaaaaaagacatttatgcagccaacaaacatgaaacaaagctcaacatcactgatcattagagaaaggcacatcaaaaccacaatgagatatcatctcatgccagtcagaatgctaattattaaaaagtcaagaaacaatagatgctggcgaggctatggagaaataggaacacttttacactattggtgggaatgtaaataagtgcaaccattgtggaagacagcgtggtgattcctcaaggatctagaaccagaaataccatttgacccagcaatcccattactgggtatatacctaaaggaatataaatcattctattataaataaacacgcccacgtatgtttattgcagcactatttacaatagcaaagacatggaatcaacccaaatgcccatcatcagtgatggactggataaagaaaatgtggtacatatacaccacagaatactatgcagccataaaaaaagaatgagattatgttcttcgcagggacatggatgaagctggaagtcatcatcctcagcaaactaatactggaacagaaaaccaaacaccgcatgttctcactcataagtgggagttgaacaataagagcatgtggacacagggaggggaacaacacacatcagggcctgttgaggggaggggagtgagggagggagagcatcaagacaaatagctaatgcatgcgggccttaaaacctagatgactgattaataggttcagcaaaccaccatggcacatgtatacctatataacaaacctgcacattcttcacatgtatcccggaacttaaagtacaataaaaaaagaaaatataagccaaaatgccaacaactttagacaatctgccaaatagttggtcgacaatagtgtaacagtttaatcattatgggatacaattataaatgtaggagacttcattccccaattcctttgcccttttagcttctcttctttgtccccagctctctgaggaaagaaagaatgaaaactatacagacagattctgaagagaactgtcatcagaggcaagaattctacccccagtgagactttgcccaggggaaagatgtgacttgtcagcaatccatcacacaaagttgtgcatgactaagagaccaagatggcagggaaaaaatggcatgggtgaaagaggtctactcaagtatgagaaaaatctcaggaaattgggatactacaaagagaaacaatgagagactttaaaaagaattttcttagaccaagcccttaagattcctaaaacattagaaaggcataagcacaattaaggtattgtccttaaatatgacacttccgtgggatggaactacagggtgctttgaaacttcatgtgatgattttatagcatcttagtcaatgcatttccccttttatttctgcacctacaactgtaatgtcatgcttatatgctattcaatttgtagaagacttgatgcacttatcttccttctagcacagagctatacttacttcattgccaaaggatgcttctaactgtactcagaaaaccccataagataatacacctgctattctcgggggaataggagaagagtgtccttattgcctctgatcaaagctgacacatcataataaccaagaagcaggcaggggtttgtcagatttattccaagtaaacaccttaatgacctccccaaatggcagggggcctgctcataataggtgcatacatatgtaaaacagcaaaagagaaggtgccagaatttttctgccacctgtattttcctctcctgattcaccacctggggagagaggaatgatgagctgttggaaaccacagaaggtgcagtaaccttgaaaatctggaagctgaggaagcagtgagctagagagtgagaagccagaatacaggaggttgacctgaaagccttgtcagtccacattccctattagataatttttgtccccttttgctattgcttagaactacaaatttatggaattataaagcttatgtcccttataatcacatggtcatttcttcccagagctttagtcacatctctggacaagttcatctacagcaccctatagaccatttcatggcaataagcatccagagtgttaacactcctcatctcactatgacttcctgaaccatatggggaaagcacttttatacacaagttattgctcaactacacaagtgaaaaatctctacctcttggctcctcagagtaaatagatgcaaaaggcagaaatcaaaactttcatttggtaggcatctagaagcccatcagtaggaaaatatccttgaaatttctacctattttgatatggtcaacttctctttctatccaaacctctgtagaggttttgttttaaaggtcaaaaggaaaatatgaagaatctcaagcagtttgtctagataggctttcaaaactatttgacaaaaaactatggccacgctccactaataataataacaactataagaaaactatgtcatatgtaaccagaactgtatagttcatacgatgatttcacatatgagattccttctgggcctcagggcctatgaatgcagatgtgttaggctcttctataggtaataaaactgagccccctagcagtttatagacctgctcaaaattattatcagagccataactggaacctaagccttctgactacagtatagaaccctttctcctctttatgttttcaagtcttttaccctcattttaacagttggtcagtttaccacaaatgtggacacacacatacacatatacacatgtgcataccaggatctacattaatgtcccctctttcattcctaatgcttgtaatttgtcctttcacttattttcttgatcactctggctagaggtgtgtttcttatggcaggttgcagtcaagagtgttcaaaatctactgctcacttttctttcctgaatgactaaagaaattctggaatagagtgagttattgataaattaaattggtctcgtacttttaatttaaaggttgggggaaggggtgttgttgtgaactcatcagccaaaagaattcaggcttcttcccatccactctcaagagggagccagctgggatctgcatccttgagggctggtttctgttaccctaaaggaagctttaacaggacaatgttttaggagagattgagcaagaggaggacaagctggacactgatgcaacaagaggaagacagacttgtcttttccctaagggttggattcccagagcctgggaagtcatgcgagtgctttggggaaaaagggctaaggagagagtggagggttacatggcatcgccatggttaaatatgcagtcagtggggaaggatcctgtgagcatcaccacagacaagtatagaagcagaacctgacagcataaaggaccaggtcccaaaaggaacatctgtgagcagatagagaaatattcacaatgtgatcaccgtggacttaaggccaggctctttctttactgttcaagaatatataagtgctaaggtccttgcatgattcagtagagaggaaaaagccccaataaaaatgaatattagaattcttcccctaaccgtagctagtgaggcttagagccgagtttgattttattttcaaaaataaaaataaaacgtgaccttcctttaccttatcttatagtcttgttcctgctgctacaatagaattaccaaagacttcataatttatggtgaacagaaatttatttggttcactgttctagtggttgggaagccacagagcatggtgctggcatctggtggaaaggcaaacaagcacacaagacagagagggaatggggactgaatttcatctttttatcaggagcccactctgtgaaaaccagcctactcccaagagaacattaatccattcatgagggcagagtcttcatgacttaatcacctctcaaaggtcctacttcttaataccatcatgatggcaattaaatttcaacctgagtttcagatgggactttcaaaccacagcatacctctaagttgtaaagcattttgcagtttctctagatcatttgtgatactgtggtaatatggccaacttgtgctcctacccaaaacttctagaagaattcctccaggatggggggtagaggcagtatcaagccagataatgtgtgggagggtgcccaaggcatggggacagggaagctgggaagctcaaaggaaccagcctcaatggcaagctggaagctagtttttattttcccttctctctctctctcccactgaatccctgccgttcacatcaatcatggatatccttggacatcctctatttatgctcaaattccaagtctaccaaaaaactcaaggggattctgagaaaactggaaggaagggagactgcaaacactctaactactaagccaaaactgccagctgaaaacctacaaaatgacattgaaaagccccaggttacgccaaggtcttaactacaactccaggcttgcctcacttcaggctcctgttggtagctgccaaaggggtctcaggaaagcaacagcttcatgggaaatgtcctagtttccataatagcctgaaactaaattacagcaaggctggtaaactttccaaacactgaaagtttcaggtggttggcaactcaaaacataatgagagatgaccgactagaagcagctgcaaccagaggctcccatcaaaaagaaccataatagcgtgtaaatcctgcaccagcaagcaaggtatccagattctctcaacagaagtgactaggctgctggcatgatccacagagaggaaggaagagcagtgtggtgcagcagcccacctgagagccacacggggcaaggaagcccccaccccctagccaaggccggcggtgagtgagcctgctacccagccatgcaacccatggatcagaagatcccactcagggacccatgcctccagggcatagggtcccaaccttgaagtcctgcggattctcaacagcctctcagctagaatctgcttaagccagccaagtttcccgggggaagggcaatcagcaccacagctgtggctgcctgctgtcaaagccatttgagctccttgggagaggggccacagccagcactgggactcataactgcctaacatgctaagttccctgggtcggggaagggcagcatccctctctatagctccaggtcacgcttttcccctgctagagccagggaggctggacagcttcatccctagaggtgccccccacagccccacacaccagctgtgttagacggcggccagagcgcctcttcaggcctgaccctgactcatccttcctcacggggcagggcctccctgaaggaactccagcaactccagccagaggctcagggacagaaccctgatctccctgggcctgagcccctagggggaagggtggccgcagtctctgcagaccgtcatacttagcctttcctcttggtagttctgaggaatctgggcagcccagacaagtgggtttccccccaggcaaagcataccctctccaccagggaacagtcaaagtgcttcattaagcaggtcctgttccccatgccacccaactggtatagcggttgtcagacaccctatacgagcattcctactggcatcaggttggtaccccacgaggtcagagatcccagaagaaggagcaggcaccagtctttgttgttctccatcctccttgagtgatatctccaggcacaggggtgaaccagatgaatagggcctgaaatgaatccccagtaaagacagcagccctccagaagcgcaacctgaccattgaaagaaaaacaaacaaacagaaagcaacaacaacaaaagtccccccaaaaaaccccatccaaggttcagcagcctcaaggattgaaactaaacaaactcatgaagatgagaaagaatcaatgaaaaaaatgctgaaaacccaaaaggccaggtgcctcttctctcctccaaatgatcgcagtgcctctccagcaagggttcagagctgaactggggatgagatggacgaattgacagaggtaggcttcagaagatgggtaataaaaaactccactgagctaaaggagcgtgttctaatccaatgcaaagaagctaagaatcttgataaaagattagagaagctgctaactagaataaccagtttagagaagaacataagtgacttgatggggctgaaaaacacaacacaagaacttcaagaagcatacacaagtatcaatagctgaatcaatcaagcaaaagaaaggatatcagagtttgaagaccaccttgctgaaataaggcatgcagacaaggatacagaaaaaagaatgaaaaggaatgaacaaagcctccaagaaatatgggactatgtaaaaagaccaaacttacaattgattggaatacctgaaggagacagggagaatggaaacaagttggaaaacacactttaggatattatccaggagtacttccctaacctagcaaaacagaccaacatgcaaattcaggaaatacagagacaccaccaagatactccatgagaagatcaaccccaagacacataatcgtcagattctccaaggttgaaatgaaggaaaaaatgttaagggcagccagagagaaaggccaggtcatctacatagggaagcctaacagactaacaacagacctttcagcagaaaccctacaagcaagccagaaaaaattgggggccaattttcaacattcttaaaagaagaaatttcaacccagagtttcatgtccagccaaactaagcttcataagtgaagtgattccagacaagcaaaggctgagggatttcgtcaccaccaggcctgccttgcaagaactcctgaaggaagcactagatatggcaaggaaaaaccagtaccagacactgcaaaaacacaccaaaatataaagaccaatgacactatgaagaaactgcatcaactagtgtgcaaaataaccagatatcatcatgatgacaggatcaaattcacacataataatactaaccttaaatataaatgggctaaatgcccccaattaaaagacacagactggcaaattggatacagtcaagacccattggtgtgctatattcaagagacccatttcatgtgcaaagacacacataggttcaaaataaggggaaggaggaaaatttaccaagcaaatggaaagcaaaaaaatagcaagggctgcaatcctagtctctgaccaaacagactttaaaccaacaaagatcaaaaaagaaaaagaatgacattacataatggtaaagggatcaattcaacaagaagagctaactatcctacatatatatgcatccaatataggagcagccagatttataaaataagttcttagagacctacaaagagacttagactcccaaacaataatagtgggagacttcaacaccccactttcaatattagatcaataagacagaaaattaacaaggatattcaagacttgaagtcagttctggatcaagtggacctaattgacatccacagaactttccaccccaaatcaacagaatatatgttcttctctgtgccacatgggacttattctaaaatcaaccacataattggaaataacacactcctcagcaaatgcaaaagaactaaaatcataacagtctcttagaccacaatgcaatcaaattaaaactcaggattaagaaacttactcaaaaccacacaattacatggaaattgaacagcctgctcctgaatgactcctgggtaaataatgaaattaaggcagaaatcaagaagttctttgaaaccaatgaaaacaaatacacagcataccagaatctctgggacacagctaaagcagggttaagagggaaatttatagcactaaatgcccacatcataaagctacaaagatctcaaattgacaccctaaaaacacaattaaaagagctagagaagcaagagcaaactaatccaaaagctagcagaagacaagaaataaccacgatcagagcagaattgaaggagacagagacatggaaaaccctccaaaaaatccatgaatccaggagctggtttttaagaaattaacaaaatagatagactgctagctagactaataaagaagaaaagagacaagaataaaatagacacaataaaaaatgatgacggggatatcaccactgacccacagaaatacaaactaccatcagaaaatactataaatacctcgacacaaataaactagaaaatctagaagaaatagataaattcctggacacatacaccctcccaagactaaaccaggaagaaatcaaattcctgaatagaccaataacaagttccaaaattgagggagtcattaatagcccaccaaccaaaaaaagcctagtaccacatgcattcacagccaaattctagcagaggtacaaaaaggagctggtacaattccttctgaaactattccaaacaactaaaagaagagacttatttctaactcattttataaagccagcatcatcctgataccaaaacctggcagagacacaataaacaaaaaaaaacttcagaccaatatccctgatgaacatcaatgtgaaaacctcaataaaacaccggcaaaccactggcacatcaaaaaacttatcctccatgatcaagttggcttcatccctgggatgcaaggctggttaaacatatgcaaataaataaacttaatccatcacataaacagaaccaaagaaaaaaatcacatgattatctcaatagatgcagaaagggccttcgataaaattcaacatccctacatgttaaaaactctcaataaactaggcattgattgaacatatctcaaaacaataaaagctatttattacaaacccacagccaatatcatattaaatgggcaaaagctttaagcattcctttagaaaactggtacaagacaaggatgccctctcttaccacacctattcaacgcagtattggaagttctggccagggcaattaggcaagagaaaggaataaagcgtattcaaatacgaagcaaggaagtcaaattgtgtctgtttgtgatgacgtgattctatatttagaaaaccccaccatcgcagcccaaaaactccttaagctgataagcaacttcagcaaagtctcaggatacaaaatcaatgtgcaaaaatcacaagcattcctttacacaaacaattgacaagcagacagccaaatcatgaatgaactcctattcataattgctacaaagagaataaaatacctaggaatacagctaacaagggacatggaggacttcttcaaggagaactacaaaccactgctcaaggaaatgagaggacacaaacaaatggaaaaacattccatcctcatgggtaggaagaatcaatagcgtgaaaatggccatattgaccaaagtagtttatagattcaatgttattcccatcaaactaccactaacatacttcacagaattagaaaaaaatactttaaatttcatatggaatcaaagaagaccccacatagccaagacaatcctaaggaaaaagaaaaaagctggatgcatcatgctacctgacttcaaactatactacaaggctacagtaaccaaaacagcatggtactggtaccaaaacacacatatagaccaatggaacagaacagagacgtcggaaatacaccacacatctacaaccacctgatctttgatgaacctgacaaaaacaagcaatgaggaaaggatctcctatccaataagtggtgctaggaaaactggctagccatatgcagaaaactggctagccatatgcaggaaactgaaactggaccccttccttacaccgtattcaaaaattaactcaagatggactaaagacttaagtgtaaagccctaaaccataaaaaccctatgagaaaacctcaataccattcaggacataggcatgggcaaagatttcatgatgaaaatgccaaaagcaattgcaacaagagctaaaattgacaaacgcaatctaattaaactaaagagctcctgtacagcaaaagaactatcattagagtaaacaggcaacctacagaatgggagaaaatttttgcaatctttccatctgacaaagatctaatatccagaatttacaaggaacttaaacaaatttacaagaaaaaagcaaccccatcaaaaagtgggcaaatgatatgaacagacactttgcaaaagaagacatttacatggccaacaaatatatgaaaaagagctctacattactgatcattagagaaatgcaaatcaaaaccataacgagataccatctcacgccagtcagaatggcaattattaaaaagtcaagaaacaatagatgctggtgaggctatggagaaataggaacacttttacactgttggtgggaatgtaaattagttcaataattatggaagacagtatagcaattcctcaaggatctagaaccagaaataccatttgacccagtaatcccattactgggtatatacccaaaagaatataaatcgttctactataaagatgcatgtacatgtatgttcactgcagcactatttacaatagcaaagacatggaaccaacccaaatgcctatcaatgatagactggataaagaaaatgtggtatatatacatcgtggaatactatgcagctgtaaaaaggaatgagatcatgtcctttgcagggacatggatgaagctggaagccataatcctcagcaaactaacacaggaacagaaaaccaaacaccacatgttctcactcataagcaggagttgaacaacgagaacacatggatagagggaagggaacaacacacatcagggcctgttgggggttggggggcgaggggagggaacttagaggatgggtcaacagatgcagcaaaccaccatgtcacacgtatatctatgtaacaaacctgcacattctgcatatgtatcctagaacttaaagtaaaatttaaaaaaaagaaaaaacataatgggataaaataattaagaagcaagctgttctccagcagtttctggagtgcccctgctggtcacatgcctcaagacactggacctacacattataggtaaacttaatagatgcagaattggaactattggggcagacacctgtcccaatatgattgagaaatttgaccatgaagaagtttacttttgataacttgaggaatgaaacaggaatcatggttaatcattattgtttttgttttcctagaacctttctggtcactggaaaccattattcctgcataaaagaaagttctgaaagaaccagtgaatcacagaaacccaatccactattctagatagatagatagatagatagatagatagatagatagatagattcatttaaatatcaatgcaactctatgaaatatgcactgtgattatctcctttatataaatgggaaactgagaccaagaaaaataaggtaacttactcaaggaagagtggcagagccaggttctgaactcaggccgtctggctccagactccaggcatttaaacattaaatgacactatagctgtcactcataagtatataaagagcacaatgaaaggtaacctgctaattttgttcactgacaaacagggagtctggctagataactaaggaaaaagtaaataacacaggatctatgaaaaactgatgtattacagagtttggaaagctcaatttgcataactcagaaaaggagtatatctgtgacaataatctaaagatggaagcagaaaacaattttagataactatttgtcatccccaatatcatagtacaaaaaggtatagtctctatgaaatagaagagtgaaataatagggataaactaaactaaaattttactacacaaaaaaagagaggtactggactagataaggaagacttacaagaaaataaaaagtacaatggctgaattaaaatcaaattagaagtaaagtgtagaatgaaccttgaagataattgaggcaatgtgacagttaattttgtgtgtcaatgtgactgggccacaagatgcccaaacatttggccaagcattactctgagtatacgtgtgagagtgtttctggataagattaacatttgaattggtagactgaaaaaagcaggttgccctccccagtgtgaaagggcctcatccaatcagttgagggcctgcacagaacaaaaaaggctgtcaatcctgcctgactggcttgagttgggacattaattcttttctacctttgcactcaactgaaacatcagctctttctgggtctttagcctgccagccttcagaagagaataataccatctgctctctctggtcaccagactcccaactgcagatcttgggacttgtcagcctccatagttccatgagctaataatttttataataaatctctttctatatttgcataaatatacgtcctattggttctgtacctctggagaaccctgactaatacaggcaataatgtagaagaccaatttaaatgttctttagaatacagagaaaataactgaaagagtactttactataataggaactcctgaagaaaagacagaaccaatgaaacaagagttacaaccaaagacataatagaaaaaaactttcctgggttaatcttcaaatgctatgattttctaccagcaaaactaaaaatagaaccaaataagaagtcaggaaaagaaagtaacaaattatattattttaaaaattactttctcatatatcaacaataagcaagacaatataatagggggagacagtcttctaatagcaacaataaaatataaaatgcctagaaataagcataacaaaaatcatatcaaaaattaataaggactagtataagaagaacacatcagttcctggactgtgacactcaatattgtaaagatgtaaattatcccctatttaaccataaagttagtataatttcaacgggactttttagaagtatgtcaaagatactctaagttttaccttgaagaataaatgtatacattcattatgttgtttctaggaaaaagaaaaggacagcaatgaaaagaaacttacccaatcggataataatatgtacattaaaaagctatagtaaatacaataatgttatactaatgtaggacaaatcagacacatacatggattagaattgaagaaaggaagaacagaagtaaactttagaatttaatgtaagaaagtgtggcatttaacattactagagatagaatcttaagagttggtattatattagttacataacaagtcagtaaaaaaaattaatttagtgcctattgtatgtaagacaccaaaataaacaccagtgtattaaagatataaatgaaaagcatagagccaaatgaatgctttaactatttactataaatagttaaagaaatatttatatgtagtggaaaatatgttctaaacatgaaacataaagaattgagaagtttgattttctcagaattcctatatgtcaacacacaacataaaattaaaagtaaaaaaacatacaatggggagattgcaacatgtataacatttaaataggatagtgttataattcttacacttcaataagacaaatatatattgttaagaaacacatatgaaagaagaaattcaaatggtctataagactataaaaatgtttgacttcattattcagttataaaatgtaaataaaaccataaacatttctcaaccatcaagttagcatggattttgttttaatgatctcggcctaaatgaggtggaacatggactatctcataaactactagtaacaacgtaaacgggtatcacagctttgggggacaatttatcaatggcctaacatcaatgtactactagtgcaagaagaggtctttgataaggtaattatccatctaggaatttattttaaggaagtaatcatatgtgttgcagggggaagcttgccattaaacaatatgtatcacaatattacatattatggtgcacatgtaccctagaacttaaagtataacaaatatatatatatatatatatatatatatatatatatatatatatataaagaaaaatctaaaaaaaacagaaaatgagaaacaacctaaacagccaacaattgggaatatgtttataaaacaatataatttgtgcagtcattataagtgatattgacaattagtcatgtgaattattttctacaaaaatagaccctttttcctctttctgtcccaacctcttataccttgaaaaaacagaattgacataaaatatcactgtcaagactgtgtttaatctgttggttgtactagagtaaaaaaaagaaaaaatggtagagaccaccatactgaagatgcacatttactgacagaggaaaacatggcactcatgcaaagagaagattatcaggcagagtaatcccacttttatttgtttttgagaaaacatacacaaatagtaaaaagatataaaaaatattgcaatgattatatctgggtattggaattacattttttaaattttatttttgattaacttgtactcatttcaatatattaatatatacttatttgctgatcaaattcagcatattaatgtaaatgtaacatttttgtaataaaaaatacataatttcaaatttgttaaaatataataaataaccctcaagtttctctttgtcatgaggttaacatcagtagtggtttatcaaaagaagaaaagttcatgctaacaaactcactcttgtttttttcaattaccttgaggttaataccagctttcctcagattcaaaactttttgcaagtactttcaagtcactctacattaacttgaaaaaacacataaatagtcttctaatagtataacttctttattgcttacattcaaagactccaaattgttttaatggatttctgttttttcttctactgagttaggacagaaataatttttccaatgactctgttatctcagtttagtattaaaacagagcacacattgttccaatataattagtcctaacgttcttttacatggtactttacaaagttagagaattataaaattgtgattttaagcttccaagtttttcttccctgttacctggaaacaatgtacctcccacaataatagtggaaacatatttttaatatacaagtccaaaaaccaagctaactccttactttgattatttttgttttattatctagatttccctttttggttgttgtttgtttttattttcagaaaatagtgcctcaatatgcaaacagaaaaggcaggaccaacagaaaagttatccctttcgcattcaaaacaactatctttccctctcactgcagaagctatctatctacctttggatggaaaaatgccacagagttttttctggaataaatggaaactaacatttcttcattacaaaacataggaggtaattaagacaatgaaagtacactacaaattaggtcaagacatgaatgttaattagggactttctcctctcctccctttctctccttcctctctcctccctgctttctctctccctccgtttcctgtggtattctggaaaaagtacctcactctcctaagagctaggatactcaggtactactgtcctagtatgatcattatttgtatgtgtaatttcagcgtaatgaattcctctctttagctctcttgttcctcaacctcaaaataatctccacagtccttcacttccttaactccctatggtccatcttacaaactcttcttgtccctgtagtattcaccaaaaaatctagccagcagggaaacagactcccacacgcctctcctttgcttgaccacctctggtgcaggagataatgaagaatttaaataacatcaccatgcacatcatgttgaagaaaaggagagagtcaacaatcctaaaaaattgtaacctctctccccttactcccttccaactgggcaagtgatgacaaaaagtataagagcacctcctcatctcatgatctgcccaactcccatcataataataatggtaataagtacatacttattactaacttttactgggcattttgtgctctacaccctgtttcatgttccctttaggtcccttcaagttaaggaggtcaggataaatctatgtgaatcgagactgacacattccaccaaagagtgctggaactttcccacaggttatggatctcttcatggtttctctacaagaacctgtacacatgcctttctcttagtgtctcaggagttttaaattcaagcatcacctttcaaaatttttcttgaagcaattacactcactcttggagtgagagcccctgtcacacacacccattagagcatttatcatgcaagatagcactgaatgccagacagacgtttttgccagatagacatttttgaatatctgattctactagtctgaaaacacaaggtctgtatttaatcacttctatatctccaggatctggcccagaacctagttcatggtagattctcagtaatgatttatttgttgtttggttggttgatgggttggatggatgaatttaaaattttaaatatttaaatacttagaaggaagtatcagagcttccttgagtctccaataatgaatcagtgacccttagaagccctgatgaaaccatctcattagagtcaatgaggcctattgggcctaatccaaactttgccttaggataatttacttatattgaatttcaaactgatctgacaatatgattcatgataagataacccactgggtctatcttccctcctcttgattgccattgtcctagttcagcttctccttttctcacctctagactagagacattgccttccaaatgatttcacattcatttcttcattcatttaacacctctttatttaccaaaaccaagcattgttttagacactggggacacaacagtgaatgtgacaacagagactctaacttcatggagtttatagttgggagacacaaagaagttagaaaacaatagtagaagtaatagtggtaatagtagtagtagtagcactagtagtagtagtagtaatgtgcaatggcaaaaagaaggaaatgatttaacagacaatgattgttaaatcattgtttgattggcttgtttgaatggttaaggaagggctctctaagaagataatattaaggtaactgctgatgacaagaaggagccagcatatgatgacttaggtaaagggtgcttcaagcagaggaaagattaaatgtaaggctttgagcagaaggaagcttggtagagccaaggcacagaaagaaagcagcagagctggagcccagtgagcaagcagcaaacgggatccaggtgggagccagccatggacaacctcctaggtcaaggtgaggagaaaagacccttttataagcaaaatgggaagccattggaaggttttaggcaatacggtggcatgatacatatttgacttttatcatatcggttaagcagggtgcagtggctcacgcctgtaatcccaacactttgggaggccaaggtggattgcttgagctaaggagttcaaaatcaccctgggcaacatagtgaaaccccatatctacaaaaaaatagaaaaaaaaaattagccgggtgtggtggcacatgcctatagtcccagctactcaggaggttgagataggaggatggcttgagcccaggaggtcaaggctgcagtgagccatgatcagaccactgcattccagcctgagtgacagagcaagactttgtctcaaaaataacaatgacaataaataaaataaaatatcagttaagttgctacccagaaaattgttgggggcaagaatagaatcaaggagtccagttcagttagaaggatattttagtaatcagatgaaaatggggatggcttggactagagtggagaaaagagcaaactgaagatatattttagaagtacggctagtgagaacttggtattagactagatgtgggatttgtgataaaacaaatcaagaataactccgagatttttattttttatttgaaaagtgaagtaaagagtgctgccatttactaagatagggaatattaagagagataaaatttaggaaaaaaattataagttctggtttgaatatctcaaatttgagatttctattaggcatgcattagaagtattaaataaaaaagttgaatatttgagtccagaactgaaaagctagggtgagggtgcaggtgggatgggcaaagtaaagatataaatttggcagtcatggacatatatacagcgtttaaagacatgagctatatctgcttctgacatacagaagagcatgtctaacaaagtgatccttagcaaacaacagctataaactctagaaagaatttaaaaagcaactacctgaaggctctggagactagataaaggcaggaaggttttggaggaagttgaaactggagcaagtcaccagtacagagtaaattctccctcttttggagcttcattctgagggatgtcatagtggtagggaagaagatagtgaagacacaaatagaaagcctgccagttttttggctgaaggaaccaggggaaaatcctggggcatccactgctgccagggagtgaggaaggaccctgaaccagtgtataaatttagcccaaatgtctggatgaccccttcacttgcagctctgtcttaaagtactaaaatgaaatctgagtgaccacccaccacacgcatgacagcttatatttagactatgaaccaagttaattgccagctaaataaaaaaacatcaatactctttggggcaacataacaaaatctagaatctctgcaatacattgttcataacgtccagtatatatatgagaaaccaggataatgtgatccatcctcaacaagtcaatcttaacccaaatatcataattaccagataaaaagttgaaagcagctattacaaccgtgcttatggaaataaaggaaaacatgctcacaatgaatgaaaagacaggaaatttcagctggtaaatataaaatatatttatatcttataaatataaaaagaaacataataggaattttagaattgaagaatactatacctgaaatttaaaatttcctgatggacttaaccacaaaaagaatatgactatggaaagatttggtgaatttgaaaatagatatcatagaaatcatctaatgggaagaacagaggggaaaaatgttgaaaaaaacttaaagatcctcagagatctgtggaaaatttcaaaaggtctatcataaggtagttggagtcccagaagaagatttaaaaattggccagaggaaaataataaaaaagatgccccaaacttcccaaatttggtgaaagacaaaaatgtacagattcaggaagtttagaaaaccccaaaaagaattcattcaagaaagccacacatatcttcattctagtatcttgaattgagacaaaagacaaagacctgggacagattaaatcacttaaaatatgggtagagaagaggcccaggatgaagccctaagatcctctaaaatggagatgtcaactagaaaatgaagagccagtaaaggatatggagaagaaatagccaatgaggcataaaaaaaatatatagaagaatgggatgatcacactggtcaccatggaatattatgcagccataaaaaagaatgagttcatgtcctttgcagggatatggatgaaactggaagccatcatcctcagcaaactaacacaggaacagaaaaccaaacaccacatgttcttactcataagtgggagttgaacaatgagaacacatggacacagggaggggaacatcacacaccagagcctgtcagggggttggggacaaggggaaggagacagataggacagatagctaatgcatgtggggcttaaagcctagatgattgattgatgggtgcagcaaaccacgatggcacatgtatacccatgtaacaaacctgcacgttctgcacatgtatcccagaacttaatgtgtaataaataaataaataaatagttaactgtgtagcatgcagtaccatggatcaagtgagatgagaccaaaaagtggcaataagatttgacagcatgggaattggtagaaaccaagacaagagcaatcccagtgaaagggcagaataaaaagggcaataagaagaggctgaggaaagaaaagaaggccaacaagagacaaagacttcctgggcaccacctcccaacatgccagtctagaatgaacactaaaacaccaaggaaaatgtaatacaatagagaaaactgcatttaccagaactcctctcatgatgagccctataggatgttggcaagaatactttgaaaaacgtttaaggcagtgatggtgagaagtgagagttctcaaggatcaaccaacaaaatgaaaaagcaacctacaaaatgagagaaaatagttgcgaaccatatatctgataaggggttaatataaaaatatataaagaactcatacaactcaatagcaaaaaaatgaaacaaacaaaaaatgttcaaatggcaaaggacctgaataggcatttttccaaagaagatatacaaatgaccagaaggtataaaaactggtgttcaacattactaaccatcagagaaatgaaaatctaaacaacaattactttacacctgttaagtggctattatcaagaagacaagggataaatgttggcaagggtgtggagaaaaggaaactcttgtatattgttggtaagcatgtaagttggtgcagccattatgaaaaacagtatagaggttcctcaaaaaattaagaatagaactaccacataacccagcaatcccacttctatacttctagtatatatccaaagaaaatgaaattcatatcttgaagagatatctatacgttcatgttcattgcagcattcttcactacagccaagatatcaaaacaacctaagtgtccatcagaggatgaatgaataaagaaagtgtggtatattattcagacacaattaagaagaaaattctgccatttgcaaagacatgatagcatgcagtaacatggatgaacctggaagactatgctaagtgaaataagccagatgtagaaatacaaatgctatatgatttcacttaagtggtatctaaaaaggttgagctcatagaaccagagagtagaattgtggttaccaggaggtagaggtggggaaaatggggatgtgttggtcagagggtacaaactttaagttataagatgaacaagttaaggggatctaatatacagcatgagtggagaaggatgtgctcattaattttactacggtaatcattgcacagtgtatacatataccaaatcatcacattgtatgccttgagtataaaatctctatctgacagatatttaaaaaaaattaatgcatttttatttatttatttatttatttttgagacggagtctcactctgtcgcccaggctggagtgcagtggtgcgatctcggctcacttgcattattttttaaaaggagacagcatgctaaaggaagcacaaatagcactaacaatcccactaaccctaaactaatcatttatccatttttttgcttccctgtgcccagagtgtctagcacatattaaaatacccaataaatatttgctgaaagaataaattggttccaaatggctcaatgttacaccttccttggattttatactttaccaaaggactatttctaatgcatatttagttataaaggcagaaggggccaaaacaggcatgtaccaataatgggaaggccggagctgctgaaatgttggtgcatgttgagatagctttagctcaattctttgcccccaggataaatctacactacatcataattaaacagaggaagtgtctgggcctaacacaatctaaaacatctccctcctttcgcaaaaattatcttcatctgaaaaggcatggagagttcacttgtttaactgaagtagtttgatgttgtttgtttatcagtccttaatagaaaagaagaaaacaattatgcccaggagattttctttttaaaccccacatttatacagcattgcattctttttatgcattcattcttgatcacagaatcatgtattcactccatcattcattcatcatttattttatccctgtatgtagttatccagatggagcataagactatcatagtgtttttataaagtaaaagtctgcttcaataaagaccctacacaatgttaaacccaacatgtactgtgaagggaagtttgcttccagaaaccagatttcatgctgcaagcaaagatgcatagcaatcaatcacagcaatctaaaaatagaccaagatacaccccagccccagcacttccattcttcattcttcagtaggaaaaaccccagagtcacctgattcctcaagggctgtgcgactgcagcaccttttgagtccatgctccattttctaggcaacacaatgaaaccaatccctgtcatatgcttcgcttaggtgtcaccattattaaaaagcaatgtggaggctgcctgggaaaaagctgattagcaaccatggttaaataaaagccctaaaataaaataatcaacctgatggggaatggtctcatcgccacctgttgtatttcctccatcccctggagaagcagcagaagggtaaatgaccaaggctgttcatcatcagattaaataacaaaaagagccaataatcattttctacttcaatatttgttatacaatttattcgacctattattcaagttttgtctacatcagttgaaagagtgcttcctgtctggaagcaacattaatagtgaataggtaagagaaaagagatgtgtctatccattcaattccccatcccctcctccttccctccaattctctttgacatcatcccagtgtgtacaaggaaatggttacttatagtaagtaagaggtttgcatccatccataagtgtttacatctctgattggtcaattgtgtcataatttagcataccttttatgtcaaaatccccaggtttttccaggattacttatggattgagtccatttatttttgtattttacaactccctatgagaatttagcatggccatttgtcagttatctctggcaaagaggtaaaatacaatggtgtagtagaaaacaaagaatggcagccagggataatataagtagcaataaattttgaatcaggagtcctgggttcaaattctagttttatatccttttgaaacatgtgccatatatatttagtgagaattttttcaagctgagttcttactttattaaaaaaatttatcccaaactaatgtaccacatagtagtaatctattttcttgtctaaaaagttgggataataaaataacttagaggtgtgttatgaaaaataaatgaaataaatgtgaaagggatattccaatatgagatcctattattaataatgtcagtacataattatatcaacagatcctcagaactccttatgcaaactgatgttctcccaccaaaccttcacccaagacactgacaagctgtaattttttactgtttgaatttagcacactctccttgccccatcatctggccgtaatgaaggtgttagcagctgggaaacacagaatactgggcagaccaagataagagagaaaacaataaggtcagggaccatcactccctgaatacccaagagttgaggtttgtgggcattaatgagtaataaaaattattaattaattaattaaaactcactgcaaatgtagttttgtttgtagttgaggattgttaattccagcttatatagataaactgacaaataacttacagtgaaattttctaaatgttgacccatagatcatttttatcatttttttcatcaatttacccatccaaattattaaattcataaatagacattagtaatcctgagtctctcacttcctcagaattttttaatttgaaaggtttagagaaaagtgctgtgcagtaaaactttctgcaatgatggaaatgtttcataatttgcactgcccaacagtacctagtgtaatggaggaaaatgtacctagtgtaatggaggaactcagtttgtaattttattcaatttcagtttcaacataaataattaaccagagttgatatgccagaaactattcagatacctctatcctggtggaaatttgaaaagagggagtaatcaatctttgttttttagaaatagggtctttctccatcacccaggctggggcacaatggcatgatcacggctcactgcaaccttgaactactgggctcaagtgatcctcccgcctcagcctcccaagtagctaggactacaagcaggcaacaccaaaatcaacctttttttttttttttttttttttttgagaccaaatcttgctacattgcccaggctggtctcaaatcaatcattctttagacatgatttagtgagagtccttcaaactctgtgaagagaatgaaccaaacaaccaattcaaaagggaggaagaagtatccatattttaatcaatcaggccaatagccagcctcatgagttatctcagtgtccctgtttgcttggacatgcaaaaggtttgacgtactcagatgctcctccctcttaatagaatccaggaatccaggggtttttccaggtaaagtgtaatcattgcatcagaggagactgatgcttccaagctttgcctcaggaattgatcctgattggtataaacctattatggtggcccatgatttagacactaactttttgatgtaattttagccaatgagacatgaagagtagtcagctggagaaggaaggatgtgggtagggttatttttgaaaataggttcctcctccttaacgaagacactggaagagatatctcatcttctgccagagctgtcatctatgaacatgatgcttggaacctcaacagccatattgtgactgtgaggagagctggtctaaggcctaaccatcatgctgaggatgacagagcagaaagctggaaaaaacctgggcattggatgacaatgctcagcctctgaaccaaccaatcctggagttatcctactactattcttctacatatgtgcaataacataaatattcttttgattcttctggccactttgggttggattttctgttacttgtgcccaaagcattctgatgcagttgccatctattaagtgctggataggcacttaacaggcattatttcatttaatccttatgacaaccaaccaaagcaaatttcaaactccattttgcaggtgagaaatctgaggctcaagcaagatgaagttacagtggtcacctgactaagaaatagcagtgtcaagactgaaacttgggtatcttgatcccaaaacccacatacttctcttccagcctctgcctcttagaaccgtatgtcacaaagagcatgtgaattagcagaccagtcagagtggcctgtttcctgcactcagctgcattactttcacatcatctgtggattctcacgtgtagaataaagtgatctgcctagatgatctcatccaactatgattataaatggaaaacaattaaagctgtgattcatttcaatttttatttcaaaagcattcccttcacacttttcctgacagctgagaaagcaggctttgaagcggaaactctacctcccatcagacattctgcaggtccctctctgactttctgaggccttaagcttggctaggtaggtagggtatgattggggctgttacaagacaaagcacaccttttacccacttcccttaccagccagcagggtgcctcagcactttggcctgccacagaggctggtgcctcagcgtgcccactcgagagtgaggatgtgggatgtataatagaggcagggagtgaatccagcagcatcttgccactattagccaactccaaggtgtgctacttcacagaataattatatgctaagtggttcattcacttgctttgttttgattccctatggactctctctcttacctgtggaataaaaatttctaagactcctcatttggttgccagggaaatagctttaaggccaaaatttatgtccgcctttcaggctgaagtctatttaaaaactttgaaagcatttaagtggggaagcaaaaagaataggatgttccaaaataagtagctattcctcctgccaggaggtggagcttaatcccatccctcataagtgtggctggacttagtgaactggtttccagtgaataagagtatggaaaggacatatagtcccagctactaagaaagcgagagaatagctcaaggacaggagttcaatgctgtaatgtgctattatcatgcctgtgaatagctactgcaccccagcctggacaacatagcaagatccccatttctaaaaaaagaaaaaagagcatggaaaggggaatacggtaactttaaagtagagaaatttggcaaacactaccttaattaagtgatcaagtctagcaaagtgagttagtcatgtggataccacatatgcctggtaggttgtgatgaggagagaacttcacttctgtgatcttcctcctaagatcataaaaccctaaactaattgggagaaaaaatatcaacaaacccaaacagagagatgatatttgaccagtattcctcaaaattgttgaggtcatccaaaggaaagaaagactgagacactgtcacagaccaggggaaacttaaagaacaaggacaactaaatgcagtgtggtaccctggatgggatcctagaacaaaaaaaggacattggtagggaaattggcaaactccaaataaagtttgaagtttagtcaatagccatgtactaatgttgctttcttgttttgacaaagataccacagaaatataagatgttaacgttaggagaaactgggtgaggtatatggtgacactctgtattgtctttgcaacttctctggaaaactaaaattattcccaaataaaaagtttatttaacacccaccccccaaaaaataatagaaggaaatgaaatagctggcctttttttagtttgtccatgaccacacacatgtctgtcgctgactctgtgcacttacaccttctgcagttgggttttgagtgggaatgaaaagtaggttatgagaagacaaagagaataggacaattttaaataaagaggaaaaggagaggagaagaaggagaaagtgatagataaggaagagaagaagaaaaggcagaaggagaagggggaaggaggaggaaatagaggagaaggaacaataggaagaggggagaagggggatagaggaaggtacaagggcaaaggcactcaaggaggttttattcttgctcaagagcaaagaataacatcgcaatagcagaacatagtgagtgcagtgcggcctgtgcacaggccctcaagggtgtcaatttccctgcagcctgatatgtttggggtactttgctcagaatggccagagggtgtagaaatgggacaaacttctccagaagggacgtgaaagtgactggccagacactcaccaatcccactttcttgtccagggcccacagaaaaactgcacttcccagccattttgcttttagacagggacactatcactcagttctggccagtggtgtgcaggtggagataacatgcaccacttcccaggctagcctctaagacatcccacaccatccaccatcttctctttttctctcctgttctctggatgtacagctggaagctaaggcctctgagatggcaaagccccactatggaagctgcccagattcctgagtccccggttggaggtagccccaaagaagagatgctcgagctgcataagatggtggatgagtaagaaataaagtatttgtgtgttaagccactgagacttgagggctatctggcagctagcctaacccaacacaaaatatatatatatacaaataactctcatgaccaaaacattttagggtagttcaaagtgtggagagaccagttcaactggcaaatagcttcagagaggaggcagcatttgtctgtaccctcaaaaaatgacagcttttggtcttgcagagtcgggaactgaatattgtaggtggagagattgccgtaagagaactacaaagacaaccacagcagggcatggtcaacagcagggattggcacctgatttgctttagctgggacactatgggaaggaatggaaagatttagaaaaatgagtctgtgaaagaaagttcaggtcataccatagtgagtcttaagtgatgctttaaagagatcccttaggtacttaagttttgtaagcaaggcagtaaaaggaacagagctgaactataagatcattctgatcccacatacgagatgactggggagccccatgaaaagacttctgcagtattctagtgggaacggcctgacctagggaacagcgagaagggtagaatcctgagagacattccaagagcagacatcccatcagctatgcaggacgcagtgtcactgaccgtgactttacgtgactcagatggaatcaggcttgagcttctcttcttgccattcccatgtgctgtgataaattcctcctgtctggggggctaccatatattctgcagctgtcaagtgcaaacagttcccagaaaaagagattaaataggtttaacttgttattcaacaagttgttcccatcttcctctgcccacagccaaagctcaagactcacattttaaagggcaaaatgtactttttctcttttattttctatctttcctccttttatttgtcctctttttctgccaaatttagttcaacaaatattacatgtctattcacagaagttgtgcgaagtattacagacataaattaaagtgtctgaaatttggtgtcccttacgtaaagagccagaaattctaacgcacatgtagctaactgtaagacaaagtgcaatgatgtgtgtgaccccacgctacaagagcacgcattctgcccaggtagggtgggaaggcactggggatatctgacccagacctggacagataaatagaatgctgctgaattgagagatggagatgggcatcccaggcaatgagcagaaacacacaagcataaagggcttgccatggtgggcagtgataaagagtctagtgtttcagactcttgatttgaggtgacagaaaaggaactcatggtgacttaagcaacagagagacagagagacactatatcagctcacaaaaccaagctttatctaccttcaaatggatccaggggctcaaatgaagccaccaagactttgtgtctctctgtctctcttctgtgccagctttgtatacaggtaggcattttccccagggtgcaacaggacccctggcagctccagacatgaatactaccagcttggcagcctttgtggaaaggcagcaccactttcccagtaattcctgaaaaaccacagataggttttgattgacccagccagaaacacctgcccatctccaggcaatcatcatggctggaggaatcctgtatttcttctggccagtcacgggattcaggacccatcctgaggggctaagaggtgggatcaacctatgagctggaagtaggggagccaaacttccccaaagggaaaccaggctgctgtcaccatggaaaggaaagatgcatgctgagtaggaaacaaatgtccctatacctgctgtggctagggagcagcatagaagtacggaaggcaggtatggttaggggtgagagggcgggagcaaaaccaaactggcaccagataatgaatccctttgctgacatgcaagaggtagtggattttattcttcgagctgctgggtctcaactatttcccccttaatgtaaatgatgaacaccaccatctgcagtcatggctgggtgttgtttgtgaattttccatgcgttagctctaattccacccttactccacccttactctccctggatagacagcaatgatacagtgaaccttgctgtaattggtttttaaagagtaaaacaaaaagtataaattattcacagacttctgctccctaattattagcaatagcaaattactttgattcaacaatgtctcccagtgcctctgtcaagcacagatgttgtcggcaatgggaagccactaaaggtttttaaatggtagaatctgttataagaagataactgtgatggcaaaatgtaggctggattggatgaaaagattctaaaggcagaaaggtcatttgggaggctatcatggtaggaagggagaggaacgagggacctgagccaaaccaataaagacaatggagatggagcaactgctcacagaggtattgcgcaggacatagctacttattaaataaaggacaacaacagagtaatgatgcttcaggtttagctgacacgttccagaccatccattctcacaccctttttcccattagctgtgtcacttgccagctagcacacacacactgaaaaacagtaaatgagatggacagagatgaggattcccgtctgagcaaagctcccactctcaggttcaaatgagtgttttttcacatctacttattaattgtactttaaaatacaatacagtaatttatagtgataattgactattttgatgtgattattcatgattctgtgggcatcactaatgatgcctataattataattattacaaaattattattattactaataactattcaaaatagtgccttgaattttatagccctttacaaagcactttcatctacctctatttattttattttcaccataattctgatgcaagtattaccaatcccattttacaaaccatatcagactgaatgaattgccccaattcataaagcacacaaagtggcagaggcagggttgaacgtccagacttctgactccgagaacagtgatttttccactttgtttttgtgctcattatctgcagtaaaaataaatcagtgaaaactgtaccctcaatctgagaactggattatctgcgggcctttagatttttagctagctacatttttttccaaggagaaaatttaagtaaggaggaataagaaggggtagttagcatgggggaactggaagctaataataacagatggatggacagatggctgccgtgtggctcagtttcaaggacttcccaggactctaaggttattctgacaccagtgccctgtcatggtgcctgaaactctgcatttctgttaacagcactctctccagaacaccccacctaatgtgctatttgggaggagtgtatccatttcccattgccactggagcaaatgaccacaaccttagtagcttcaagtcaacacaaatgcattattttacagttcttgaggttagaggtccaaaatggatttcactggggtaaaatcacagtgttggcagtgcctcgcagaggaggacccattcctttccttttccagcttctagaagctgcctacattccttggctcatggccccttcctccattttcctagttagcagtgtgccatcttcagatctctatctggctatgatcctcctgcctccctctttcactcatcaggatacctttgattgtattaggttctctgagataatcctggataatctctccatctcaagattcttaacctaaatacatctgcaaagaccctttttgccatgtgagggaacacactcacaagttccagggatttgcatgtggacatcttagggaggaattattgtgccaaccacaaggagtaatatattaacagatactgatcagattaggtagctgtcatctttctgaaagcaaaatatgaagcgaataaggcatagaaaaaatgagtttttatagaaattaagaaagtcaggaaagtttactaaaacagggattcataaccaagggataagttggaggtatttttccattgttgttctcatatattgtttataagagtataaactatgataaaaatgtcaaaaaataatttggcaatataaatttccattttaattgatctggcaattcaactgctaaaaatgaacaaaaatacttcaagatgcaagtacaaagatatatactaaatccccaccaagaagtcatcgctaagtaaattagaaaatattcacataatggaatactctggtgtcttttaaaaggatgaagtaaatcaatcagcatacgctgacatggaaaatcgcccccagaaatttaaaaaattgttttcagaaaaaaaaagatgttgaagagcccatttagtgtgagctcatttggtaaataaaaaagaaagaaagaaaagaaagaaagaaagaaaaaaagaaagaaagaaagaaagaaagaaagaaagaaagaaagaaagaaagaaagaaagaaagacgctgtttgtaggtatgctttgtgtttgcataaaatgtttgtctttgggaaaaatatcagtggccattagccaaaaggaagacttcttaaatttttctgtactatttgaatttttaatcacatacacacattaattatgccttttttgaactatttaaatatgcatgcccaggccttttttctggagagtctggtccaggaggtctagtgtagaacccacacatggatattttgaaaaagctcccaaagccattctgttgggcatcccaggaggttctcagttgggtcactattggcattttagccaaaacaatccctccttgtgctggactctccttccattttaggaacttggaatcttcctcccaccccccctccaagcattgagacaaccacaattcccatatgtattttctccatcgccccctgaggggttgagatagtcctgcaggatacctgggcaggatctgggtttgaaagggccttaactggctgagacttccagacaaggcagagagctaaagctgatgccattgggagttgggggaagccattatactccctaataacaggccccaaactttctgaccactatgcctttgcaaaaactacttcctctccctggaacttgcctctcaacccatttatgctaaaaaaaaaaaaaaaaaaaaagcctaacctttaaaataactatatcttgctttcaaaactcagttaaatgacatcattccaagaagccttgctgaactccctgctggtggaatgattctgttctccccacaaccctaaaattcccagagcattctgtatcacaggcaatctgtgctaatctcactactatgaatcacacatctttttatttttattaccattgcccattagaaatataatgcaaaccacatatctaattttctagtggccacattttaaaaagcaaaaataaatcagtgaattcatttaacatattgtatttaaccaatatatctaaaatatttcagtatgtaattaatattaaaattattgagatattttatttgtatatattaagccttagaaatcagtgtgtaatttacacttacagtgtatctcaatttggcagataagttttcatcagaaagacttgatctatgtttctatttcataaaatggaaatttgagaaaagtagattcacatactcaagttgttccaatagtaggtgtttttcaataactaaattgatcttagcttctaaacttatatatttaagtttcctaaaattaaataaaattaaaaattcagtccctttgtgacactgtccacatgtaactaatggctaccattctggacaacgccactatatatactaatagactgtaaactcctcaaggatttacagagccttactcactgccgtatccccagctcccaggtcattgctttgcacatagttattactctataaatgtgggttgaataaataaatcaatgaattgttcatcttagtgttacccacagcatccaggaggccactttgcatatatgacaataattgtggatttcagttacataacactgtacagtttaccaagcttattatctaatcatctcacaagcactcactgagaaagatattttcacttttcaggtggaaaacaagattcagaaaagttcatcgctatgtgtaaagacattggtaaaatggcaaaaccagatgttgaacctagattttctgactcccaattaaagtaccttcaattgaccacacctgctcttcagttaatcaacaaatgtatggagattaaattaaacactgcagagtacccaaagaatgctgagtaaagctgagaaaggaaaagctgagaaaggatcctccccaacgtcctatgtcaatagataacatgaacatcgaagttagttagatattatgcttctattaggggaagggtcaaagcaaaacattctaaaaccaaaacgattacagttaacacctgtttgttaagaaaatgtcaagtgaaggagggttggaacagtgtctgaagaaggacaacagagaaattattagccagaacacctctgatctcagaccacactgctcatctgggcaattccacaaattctgcctgaagtatgagactctatcccaagaaaattattctaaatctacaaaaatctatttgaacaaagatgtccatcacggcattgcttatattacattgcaaaaacacttaaataacttcagtgtccagatatggagagacagttgactaaattacagtacatccactaaggaacatttataatttttttatatttgtggatgtttaaacatgggagaaatgttgggcgggttataatggtaaattttagaacgtgatactatgtgatcaaaggagttaaacgttcataaagaaagtccatcaaattttaacatttggaaagaaggaacaatgagtggcattttctccttttcccttttccatgtgcatgtatcacttttataacaaaaaacttcttttaagaaaactgtctttaaacaaacaggcaaacagggcttagccttcctgcccacccccactccacccccattgtgggtaatgaagcataaataagagaaagtaatgatcccacattctgtctggaaaacgggcttctactctaatcaaggagataatctctatctctaagttgttgatctaagttcctgggtgggtcaagaaagatcatccctctttggaaggatgtggcaaatattcaatcaacagtctaacctgatgcccaaggtcacacagctctgcagaactgactcccagcaccggattcaactcaactatcagagcagagctgctcatattcccaaagtgccctggctggcttctggcagagccactttgctccgggtcacatcattgttgggtggccttacatgtttggataatcgcagcccagctctgggagatgttactcacactgtgtaagagagtcagccacattaagtcctcagtgataaagagcctagaatgtcaaatgcccttgcatttgccagcccaaaggctggcagaatttccaaaccctcctgggctcccctctggcctatgaaggagcatcccagcctccctttcttcaaaggtcagtagggtttccctagggtgcattggggttaaagatgatcttccaagatgacagaatctcacaccttcctgatgggcatccagagaaacaggtggaaccattaaaactcacctgagagattaagcacagctcagggattaatcccttggattctgaggccagactacaggggttcaaaatccagctccaccacttgagagctaagtaaacatgacaagttacttaactatgtttcagtactcccaatgagttaatgtatgcaaagcacttcgaataggaccagacccatactaagaaccacataagggttaggtcttcgttcatttgcaaatattggttgaatgcttcctagtactaggggcaaccattgtagtccaccagcaggggcctagctccatgctgagctttaagtacagtatctttttttaatgcttacaaaaaccatgcaatgtaactctgagtatttctgttctatacctgagaactaatgctgagaggaggaagcagcttgcatgagttctatatgacaaagtccccattcaaacctaggtctctggggactcaaaaacaaaatgttttcccagatgaggtccctattcttcaaagaatcgtatctgtaagaaatcctaaaaacattacttactctggccaataatcagtatttatttcctaagcaataaaccttctttcaaaccaaacggtctctgtaaacacaatagtgtttcttagcaatcacatgtgcaaagtccccaaaccagctatttttaagttagaaccagccccacccccacaaacagaatgataaaggactccccaagacaaagatattccacttaccaactgttcccatgaaatacttcaattcccttcactccatagttatttattgcccagaactaatttcctagcctttatgaagcagattgtctcttacagttcctgagagttaattgtgtgcatctcttcccaactccattctgtgaatctattttggaaatttgaaattcgaaatggtgggaatatttatattacagaaactggcaaatgctaatgtccaccaacagctgaatggataaataaatcatggtatatccatacaacagaatactactcagcaacaaaaagaaatgatcatacatgcaacaacatagatggctttttaagtagttatactaagtaaaagacaccagatttgaaaacagaatacatactgcataattccatttatatacaaatctagaaaatgcaaactaatctatataatcaatagcaacagaaagcaaatcaatggctgcctgggacagactggggatagcatgaagaggcaggaagaaggagttacaacagagaacgaagaaatttttgagggtaatggttcattatgttgattatggtgatgggttcacaggctcaaatgtcacacttagccagttgaatatttgaacatgtacagttttttctacgtcatttatatcttaataaagctgtttttaaatgttcttctgtttattcctatgatgacatttttattttaataagtgtaaacaaatgctacttcactatgcagaatcattgatttacttctctatttctctcaccatattctaggttccttgagggcaacaacctccatgaagtctttcctgggcacatgctttctccactcttgtaccccatctccttgctctggagtagggcatgactccattctctgtgctcctgtttccaggtaggtcatggagtggagtggaaagcacaaaggcttggaggtcaaaatgatgcaggtttcaccctccgctctgctgctgttcagttgtgtgtccttgggcgtggcatataatttttctgaacccactttgctagggcataaaagagggaagctatggatccctgccaggagcagaaaagacagtgactacagtcctcacatgagcagtgtgtcagcgaaaggcaccaaaacagcataggcatcctctggctttaacaaaagggcaggctaccttggaagtaataattttaagtagtcacttcaaagctgtgacaaatgatcccagttgcatgaaacctaagggttccaggctgatgggaattgctggaagaagccccatgaaaagggctactcagggcccctcttttaatgaggattatcaagtggagatgcccttcgacccagtgtttctattctagttatctgcccctacgatgcagtttaaattacctagatggatatggacttatatcatagcattcctttaaagagtgaaaatctgagaagaatctaaatgtccagcaatagtgatgtgggtaaataaatgctcactcatcacattcaggcacatacatgctacgtggcaacatggcaaaatgactaaggtaaaatgatccatgaaaaaattaggacaaaaaaactgtagccacactataattataactatgagaataaggcatagatattaagacttcagaaagccaaaatgatcatgaggatcatattcaggacattttatctctcatcatttatcagcagtctacagggcatgcatattatttttatggcaaaatttcactttggaaaatattaagaaaggagggactaagaaactgaggcaatgtctcaaagtcagcctatccagagggaaacgcggcagccactgaaatagtagtaaaaatagccagtgcccagcaggcttttgaaagcttctacagatcacgttcccaaaagaatacatgcaatttgcctgcattctgttgaattggcttttggaaaaagacaacataagggacatttggtgacacttcagttatctaaaatggcatggacatatggcatctcgtggggtgggaaagctcattctgtgatcattccaaatctttagatgcccattccagataaatgctataaacctgtgaagagaagggagcaaaatctttatctggtgactacagctaagatgggccttaatggtcatgaaagaaacggtgacctacagaggcagcacccgtcaaggcagtgtggatggagaagaatgaaggaaaacaagagaaggtcaagggggagcctggaacaagcagagtgggggttctcagccctgctgcatggcagcagaatgggacccaaagaagttttaaacatgcacttcctggtcccacccagcgaggctggtttgatagctcataagtctactatgcagcctgagttaagaatcagtgaaatagaatgtcaatcagaaatctgaacaggatagagcccacgtagtgtagtcaaaggcaagattttcaagtgggagaagataaaattatttcagcaagaaaaaaagtgactggtggctgctggtgttgccattgatgttgttcaatgtgttagaatagggaaatgattttagaatttgtttggtcgccttattttaggtggattcctctctctctgcctttttctctctctttccccccacaacacacacatcaaaaggttgagcttgagccaaataacagaattcctagtgatattttataatttttaaaaaagtacggccaggcgcaatggcttatgcccttcattccagtattttgggagtccagtgcaggtggattgcttgagcccaggagtttgacgccagcctgggcaacatgatgaaaccctgcctgtacaaaaaatattttttaaaaattagccaggtgtagtcacttgcacctgtggtcccagctaactgggaggctgaggtaggaggatcacctgagcctgggaggttgaggctgcagtgagctgtgattgcaccactgcactccaccctgggtgacagagcgagactatgcctcaaaagtttaaaaatttaaaaatttaaagttaaataaataaataagtataattaatggagattaggcactacactaaatgccttttttaaccttttatttaaatgattatagacacacaagaagctgcaaaaatggtacagagaggtcccaggtacgcattatccagctcacccagtgataatattttacaagactctagtacattatccaaaccaggaaattgatgtggacataacagaattacctaaactacaacctcactcaggtttcaggagtttttatgcctagtatttttacatacattttctcattccatcctcccatcattattgtttccattttgcagaaaagaaaactgagtccaagaaaagctgagtaacttccccaaggtggtaagttacagagtcacgatggaatctcagctttgtctgactccaagctctagtgctaacctaccttccctaccaccccataccatacagtgggcaccactgtggtcacagcagagaaagggctctggtgagaccacaggtgttgctggtgacttgctcacaggagaggtcttcggaggcaaatgtgtggcagacatgagcccacagccaggtgggcagtaagtctgaagaagggcttcctagttctccagcccagcagctaaagttgtattcttagactgagcaatctatggcaggaggcccaggcaggcagggagtaaggccaaggtggctggccagccagtgctgcagtgagagtccacaccaggcatgaggaaatggcaggaaatgagcaggctggtgtggcaccggcattggatcagggtgcagaggcaggcaggaagcagagacctcactgaaaggcaaatccacagcagcatcaaaaccagagaacacagaccttctgcctcattgctggaccagggaggccgtgtggcccagtggttaactgtgggttctggagccaaactgtctggctttgaatcccagatctaccaactgatagtaggatcttgaatatgttcatgtctttttacctcagtttctccatctgtgaaatgaaagtaataaaaacacctgtctcacagggttgttataaggattcaacggcttaacacatagagcttgtagaaaaatgcttaacacacaatctctagtcaggttagctattattgtcatcatacaaaatgtgactggattagggataagaggaaaactctagaaaggaaagagagaaaccacctcaaaggtcccaggtggcagagtggttgctcagtgctgatggcccagtgaacgtggctgattaacccagaaaaggttaattcctccacacaacacagcccagagctcacagtgcaccttccaagcattgagcaggatgctgacactgaatcatatcacttgcaaattataaagcatcagctgcttccagacaccatgctcaccgcatgcatgcctcctggactcctcacaggtagcccctgagggaaagaacatctaatcctgttaaacagatgaagaaactgaggctcagcttaaatggtgtgctcaaggtcagacagcaggcaaggggtgtaactgggattaaaccagagctcagtgttcccactacacccatcattaagacaaacagaacgctctgtaacaatggtgtctggcacagccatgggtcatgggtcagcaggagcagggagcagcacaactgggcagaaacggccatgtgagaagactgggatgattcacccaaactcctttctctggctaagtaactgcctcccccaacccattccatgagtttctctctactctgcaatttcctatacttccaatggcatcagtaaggccagataaaagacattgttttcttttcattttattttatttttacttattttaagttctgggattcatgtgcaggacatgaatatttgttacataggtaaatgtgtgccatggtggtttgctgcacctatcaacccatcacctaggtattaagcctcacatgcattaactatttatcctcatgctctccctctctctacccccacaacaggccccaatgtgtgttgctcccctccctgtgttcatgtgttctcattgttcagctcccacttatgagtgttttctatcagattaggggactccacaagagcccccgttggccattcacatcaccagcaggacagggaattagacctggatctgctgacacacatcttcatattctaagtcgaagttcatttctaccctttagggttgatgtctctccctctagggttgatggaccaccccacctcgcctctgctgggcctttgtgacctttctctcacaagcaactgcctggactccaggtagggtgaaaatacaatggcttataaaacactggatgaaagaagagtccagagtctacactgatactaaaatgtagaaagggagagaaagggaaagctcttatttacagtcaaatatcatccaatacatagaaaagaagtgatagggttagaaaataccattgattcagccaagtgccattaagtgatgctagaaccactgcaagtttgttgggaaaaaggttatttacagagtctcaaagtgtctccccaaaggtgatttaatcacagttaaggtacccattgattgtgacaaaggtaccctgacagtggacaaattgtgagaaacaactttaaccagtgatcaaagtcaacgtcacccataataggataaatctccttcctcattgctgtgccgagaaggactcagtgtcacttatgtagtatccctgtcaaatggatgacctgaggactctagaggcaacgatcagaaaaaccaaattgaggaacattctgcacaacaaaacacatggcctgtttgcttcaaaatgtcagtgtcatgaaaggcaagaaaggctgaaaaactgtttcagttaaaagagactatctttttgtactcattaaccaacttctcttcaacccccctccctatttcaaatacagttagaaggaataagttctagtattcgatagtacaatagggaaattataattaacaataacatattgtatatttcaaaataactagaggagaaccatagagttcccaaaacaaagataattgtttgaggtgatggacatccccgttaccctgatttgatcattgtacattgtatacctgtatcaaaatatcacatgtaccccaaaaatatgtacaactatgtcaataaaatacaaaaaaaataaaatacgggaacctaaagaaccatgacaactaaaggtgatgtgtgcttccagagtggagccagccaaaaaatatggctgttaaagacattattgggacatttggtgaaatttgaacacagactgtatattagataatagtgtaatatcaagattaagtttcctgactatggcaactttactgtaaggaaatgaccttattcttaagagatacaagctaaagctgaaaggtcatgatgtctacaatttaggattaaaagatttggggggaaaaatggatagatagatgataaacctaaagcgaatgtagcaaaaggctaaaaggtgacttacatggaagataatgtagctcattttattagtcttgcaattgttctataagtttaaatattgtcaaaatattattttaaaaaacaaatgcaaaagcatttcttaaatacaagtacctgtaagttggcttagagttatacactacagccagattgagtgctatccggggaaatttaacaactaaggaaactcaaccctgatttgagtagatgaacttaaaataattagcagaacgttgcacaaacatgtaattatacaattataacacaggtccccttcacacacagttttcttattcaaaaccggggccattttcaaagaatgagaatgttaaaccaatgaaagtttaaaattttggatccctagaccatgtttactctttgacatattcctatttctgactttgcagagttcatgagtcacgctctcaggcagtttatgatatgcccgcctcaagtacttgagcctcgttgcccgagccagagttatttccccttctaaatgaggacaagcatgtctgtagctcctgtacaaataacaatgctcccataactgagctgacttccagggttaggaggaaattggacctagcaaattcacttctggctgcacttaacagtaatcaataaatggggatctgcagctaggatacagttgtagggctgtttagtcaatgaccattagctactacagcatttagaaggatgtaatttaaaaaatggtctttgttccaaccatgtgggaaagcatattttcacaagtttcttcccaaaattgtccacgtacttcctccaggcaccgcagaacacccagtgtttaatcactgcactgttctccagctccattatttcatctctgtcacaggccaggaaaccttcatttcgatgctacgtgtgcaggagaccaaggcatggaaatataattcctaattctgtaacttaatttaaaaatatatacagtctcctttctgcttactcaaagatggagagctccgaagatttctgcctgcggaataaaactgaaactctttctcatggcaaacaaggccctacattacatagtcccaggcttacctttgctttacctggttccaaactttacctgcctcttgttcacacacctcagtcacaaatcaaacagttccttcaacataaggcatgtgttcctctctcctggccctggttcaaactgttccttttgcttcccttttatgtccaccataatccagggtgatctgttttatggttataccatagtgccattcaatatatgcatcgatctctgtgaggtctgggagacggggagagggtgggggaggacaaatggggcctgcagtggtctgactcacctcatgcagcttcagtgcccaacacaggatgtaattgtagagtatgcactgagcacatgaatgggaagagagcatttgttatcagagaaattttaataagaaggaaaaggatcattttcctctagcaaggtcaaaatccctgccctaatgctgtaaataggaacaaatatttctacagagtaaaacacagggttaaattatcataaggtaatgaatcaatcacaccaatcaagggatatacagatttgccttattacagggcacagttttaaaggggtctgctttatttttatttagggtaccttaatttcactgcaacaaacaaatgcagttaaagtcattcatcatggaaagttgtaaggggtgacatatggtgtttttgagatatttcccagtgtagagtcccatatcagtaggccaatctgtctctttacttcatccaccattaagacttagccccaagcctggtactggggaggagggggctataagggaggagaagtagaaaggcagaggtgcagcttttctggcaggggagatgacagggagaagagaaaccagagcagaagaggcaagggtgagacctgagtgtcctcttctctctctggagggatatccgcccaaaaaccggaagctctacaccaaagtgaactcagtggccagtagagttaggtaaagggaggctgagttttagctttgccaggttgtctgtaggctctttgtggtttggacaggccccagaggctcccacaagctcctgaagccaaatctcagaagttacctgggattgtgactgagagatagtcctggaggttgccatggggacaaagtggccacgggctaaaggctggaccatctgatgctgaaccacataagaatcaaaaccagaccatcctcagggcctaaagcacagccacaggaggagtggaaaggggctgggagggaaataaaggcgggaaggggagtcagatcacacctgccagcagagccacacaaaccagacaccatcttggtgagctgcagggtgccagaggggacttctgaaccaatgagcattttaccaaaagaaactaaatcatcagaaaaaaaaagtatcatccaaatggtaagttcatatttgactttaaatgtagagtttctccctagttccccttaaagtgggggctccagaggaagactagttcaactaaaaaggaaattaagaagcaacattttctcacacatcttggggtattgacaaagttgcagccctgttacacgggtatttctcacattagggctgacaatctataaagtacattttctggatagtaactcttaattccctattaattcataagaataaaccctctatcctccaataagccaagtcaagaaattttagtgaagaaaggaatctgggccaggtgtggtggctcacgcctgtgatcctggcactctgggaggtcgaggtgggtggatcacttgaggccagaagttcaagaccagcctggccaacatggtgaaaccccatctctactaaaaatacaaaaattagctgggcgtgaggctgaggcacgagaatcacttgaacccaggaggcagaggttacggtgagctgagatcacaccacagcactccagcctgggtgacagagcaatactctgttgaaagaaagaaactaaaaacaggaaagaaaagagagagaaagggagggagggagggaagaaggaatatgatgggagaaagcccctggctagctgacttctgcaaaccactgcctatattttaggcttccaaagtctgcaatgcattttcaacagcattactcttgctgccgtctctcccaaccaggaatttctctaatgcctgagatggactgaatttatactttcagctcctagaattacaccatccttttcataggaggttcgtgagctaaaccataaaaaatgaattgggctgcaaaactacaacccattcattcaatcaacaaatacacctgaagcatctatgatataccaggcaatccaggcagtgggtccctgccacccagaaaaatttgtatctaatgcaaaatatgaataagaataatgtgggatgtgctaccatgggccagtggtagtgtccagacagcacacggataggaggttgggcagcccagttgtggaggtatccaagagagcacagagcatccttgacattgggctacacccgtgatctcactgccaatctcctctactctactgctcccaccctcatagcttattggtgctaccttcacacatcaaatactctattgaaaatctcttccctgtaagtctacaggttgtgtacaatgaagttattgctcatgcaactggagacgagaagtgcatttacctcgcaccccatactgacccccaggggtagtttggtccaagctgatctcaaatcttcacacttccttcaaaggaaggaacttcctttgtttagagtttagagagaacttcagggattccctgcatattttgggtctttatgtgggctggaacagcagttcctgttgctaattaggaaacatagagaagtttatccacacttcacattggcagggtgagttaggtggaagctccagaaagagtgtcccgctcctcctcccaacccaacagcactgaaagcttcctgagggttattctaggatgaataactcacactttgtaaaatgtgctgctaaaatttattgtggttgaggcatatgctgaggggttgaggacacctcagatgagctacattcctgggggtggaagcctggatttctcaacggcccaagaagaatgtgctctggttggaaaaaggatgcattctctagggggagtcagccctagagacaagcccactggctaggagccaggtgtgtccatcagcagaccttctgtatgaaggtcaacatttgtgaacctttcttggacaatgaaaacaatcatattttgaggataattacaattttatccttatgttgtagtttctttaatctcaatgcttccacaaaatcccctgtaaggcaataaaagtacaagatactaaagaaaattgtgacttgccccatgttccctcccactagagcccatagggaagatactgcatcaaatataaaattaaatatagacagactggcccagaatatccaggccagtagcattggagctatgccccccgtgccaagctagaagtgatgcaccagcagagaactgcagtgtgatgggagactgtggtcctcctagaagcagatgtcaagacaggattagacatacaagaaatgtattggagtaaaatctgtaaaaacaaatgagtaaaaagctgagcgaggctgagaaagccatcagacctggatgcaggtctgactcccagtaaaagaaagttgggtggcagtgtctgagactgtactgcagctctaaaaaaagttcagcaaggccgttagtgagtctgaacaccaaagtcaccatcaaaggagttccatgtctcccaggaacagctgaccttagggtccctgccatgctcagtcatcgccaatgggttccaatgggttcctctgggatgcacagctttggccatcacagggataaatttccccacacacaagctaggaggccatgcgtcaagttcactttctgtgatcagagatatgaaaggtatattctcatggccaccacagagataagccctcccttcccaaactaccagtgagaggaccaacaagaatgcaagaggaatggtgtctacctcatatatacttggtcattttttaacactggaagatctgtctctaaaaacttacaaagagagacctaaatattgcctttatgtgaagccaaggttgcaataaaaacttctctaggctttaaaaattctcagaattcattctttcatttttccccttggcaaatgatttggatttgcaaagactaaaggtgaaaaataactccaggaaggcaacactaagtcaggagagtaggtgtccccagaagtttccaatgggtgagcaacactcagtaatagaaaaatatgtgtgaccagacttcctatgagctaattgggaattttaacccatgactcatcccagggcggggccgaagctccaggggacgctaccccacaccatgccatatcatcagccagactgcacatttcctgaaagtaatcaagtcagaaactgacattttggcagcagcccctagtggaaaaatgactgccaaaagccaaaatgaggatgagttcaacgatttaattctgcatggaaaacacaatccattaaatgggatctgacaaggccttaatctcatccgtagctgagggtgttggctcaatgcgattctgctctctggaacatattcttagtaagctatctatagaatctagaaagcctttgccaaagcccaaataagtccatcctaagtgggaagagaagctcaccaagcccccactgactctgtagggagtaagcacatgattcttccaagtgcaaaattatcaaaacctggcaactcaacctgtgttgggagtcgcatgattcaaagcaaaggaactgagatgggcaatgcactgagtggcttcagaatttccaccactgcccaaggaggtcaggcccacagccagcatcactcacaaagcatccatagggctcatattccctggctggggcccactgcataatccagtcacaaaagaaagagttgggggtgtagaggatcagtcttctcccaaacagggttttaaaaactgaagtgagaaagaattagaggctgtcaccttctttggcccacttaatcctaacagcagcccccaaagcccattattttactgtttgcatgtgaaaaatgaggaaagagaacaaaagcattactcaaatcatgtagtttaaaagattgtttgcaaattcatacttgtgggattccaaagcccatgtctcaccactctgaaggtggtggtcctcagactattgcatcagttggagcttgttagaaatgcagattcacaggctgcaccccagacctactgaatcaggatctgcatttaacaggattccccaaggaattcatttagacataaggtttgagaagcagtgccttcaatggcttctatccaaaaagggtaggtggattgaaaacataagtctagactagaaaaagatttagtgcaatagaatagggccagtcttataggatatataaaatatgtatcaaaatataactcaaactatatatccaaagtgcacactcaaattagtataaccaatcacaccatatcttttttcaccaacaacaaatctagagacatgaagtccaaggttatgtggtgctagtagaatatgctgaaggagcatggctgtagagctaggtagacttggttgaaatctccagctctgccacctgctgggtgactttgggcaagctgcttgatctctctgagcctcagtttcctgacctgtacaactgggataacaatactcaacttgccagccttttgaggggattaaatgagcaaatgaatgcacagtcctcggcacatagcagatgctcaataaatattggcttctcttacttgtggtaccatctgagccaggtccctcccacctctgggaatgtgtacaccagaggctggggagacaaacctctctcagcagccagctctttcatgttctcttgggtcctctagtggcaggtattgagattcctgtcactaatcagactggatggacttgtctgtcttccttagccccaggttcaatttattctctattctcttttaagaaaaacctgagcagagcaacaggtttaaagggataaaatgtgagaaacaaggaaagaggcacccaaggtgagttcccaggagtgtctattttccaggtaccaaagcctttttctttatttgtggttcccactttcttcttttcaaaaatctcaggttttgaaaacagacctttcatgccacaagtttagtgagctttcagggcccacagtgtctgcacgtggagccacaaaacccatgtttgatcctatttaactttgtatgtgtaggcttcaagggcatgtaaggattccagtgagtgctgagcacgaatacaaaattaatacttactgagctcattctgggtactggacactgtgcttggctcattcacatgcgttatctcctttaaatcctctccaaaccccaggaagggggtctctttatccccatttcaaagattttaaaacaggccagaacaggtgagtaagtttgttctcacactgctataaagaaatacctgaaactgggtaatttataaaggaaagaggtttaattgactcacagttccacatggctagggaggcctcaggaaacttacaaccatggcagaaggtgaagaggaagtaaggaccttcttcacatagcagcaggaaagagaagagtaagcaggggaaatgccagaagcttatgaaaccatcagatcttgtgagaactcactcactatcacaagaacagcatgggggaaatgcccccaaaagccagttacctcccatcagattcttcccttgacacatgggattacaattcaagatgagatttgggtggggacacagacccaaaccatatcaataggtaagtgacctgctcaaattaacatagcaaaatactctcgagttcaaagggatcctaaatctcatctagtgcagtggttctccaggtgtgatcctggaccagcagcatcagtataacctgaagcttgttagagaacaacatccttgggccccacctagatctgggatgagcccaacaatctgttttaacaatccccccgggtgattgtgatgcacactcaagtttgaatcatcagaccactcttcaaatccaacctcagtatgacagttaagaaaacagaggttttgccaccaaaaaaaaaaaaagacattatgtgaagcggtggatatgttatttagcttgatttaatcattttgcaatgtacacatgcaacaaaacatcatattattttacattgtaaaattttatttgtcaattatacctttataaagctggggagttgggtggtgggggagagaaaaacagaggtttgaagaaatgaagtaattcgccgggggcaatagagttggaactgaaacccagtacaaccactatcagaagtccaattttcgcacctggatagcttaaaatgtttgtttcttggagagtaaagactaaagcccttggtacaactgagcactaaactgtgttgccttccagcaatattggctgggatctggacctgggcagccatgaggagacctcaagccctggaagcatgctcccaagactctgctaaactgtctgctccaatacatagagtatgcctcatcagcactgcccaaccaggaaggggataagagggaagactgtcagggaccatatccagagttgagatggtgtttgcacaaacctcaactatcgacacacaacccctagggaagaaaggtggtgccttcattttccaaaatctttatttctaagtcagtgtgtcaaattctcactttcagctataccctctggcattattagtaactgacattaatccagtgacaatccagagtgtttgcaggccatacttagggatggcagcctgattggaagacaaggcccagggacatgtcttgacgctgcatttgaatcacaagcatgctttttatgtgagtttatagatgatatacttatttggggtggggtgataaagtaagacttaaagtctgcccaagctactccttgctgctgcattggagaccagcaatctaccagcaattttttataggctttctctctccaagccagtttcttcatctctaaaatggacagaatccttgagttttttgggttaagcctggcaaataagaacggctattgctgatgtaacagggagcctggtggagactgaaacataaaaatatttgaaatttttttgaaaaacacccatcattgataaatttataaacacttcgtatctttggaaacagaaagtagaatttagctttagagcagactgtccctttgctctgaaaagaactacttaaatgaaaatactaaatgcaaatattaaacaagtgcacacattttgtcctggtagtagcttgtatatatttgcctccaccttgcagagagctagaaaagatttccgggaaaagtggaattaagtatctaaccccttccttttgagaatcaacattattagaatatgtctgagaaaaattgtggttgtgctgaggccaagtatcaggaaaagacaacagaagccacagagaggagtcatcacaaggaagaggtaatctaagctggtgataaaaatgcctaatttcactgaggtcagaaagtacatgctcaacatgagacctcatttccctagtaggggacaaaaggcataacaggataagcgatgattcttgaacccagcctgtcaataaggctgggggtccctgtgaatagtgagggacaagaaccccaagaaaagactggacctcctgataatttggcacattgggcttattgacattgtcatttgtatcttgtttggtaagaggtgatgaccatatttcatggccctaaactccaaatgccctccaagcgtgaccaaggaaaaagagaacgaagtaatcaaagctatcattaacccttattgtggtaccactcaatggtaatgaccctacagaggagctgtagggtaaccttgattatgctctgatttattcattgataaataaactcttcccatacctgagtactttacttgtagtaatttatgcacaacaaatctcacagctgatcatgccaccacagttaaggacaattgcagaagagaatatttaccatttagcactgtcatcaaaatcaaccatcttctttggaagaaaggatagttacaaaatagtacacagttgtattaagggtaccaataaataaataaataaataaatgctaatggatttcttgtctcaattgctaaagggttggcatatacctgcatgcacctgctgtctttttcctacagcaccaagtgttacaaggaaacagaaataagtcctgatattcaatttataacttaatctctttcagaaaccaagacactgctacacgttacaactaacagaccaaatgacattcatgggcatcaatattaaagctcatgagctctctattaaagagcaccaagagaatgcaaacaaaacagatgatggtaatggagttcggtgagcaaataagatgttattttcatgagagtaactctttgcctgttcattgaagaaaatgatgaccctggtttagggtggaaggagtagttataagaaaccttaggagaagggattgactccataagaaatgctccaaggtgagaacacatagacagagaaagccattcatggtcccctctttcaccacagtcacttgctgagaattgcaggttcataagacgtattctctcaggtgagtgggttttattttattcaaaaccttatgatgcaataaccaagcccttagtaggaataaaaacagcatttacctgcaattcttgtctcactaatgtactcgtcacactgtataaagaaatccaaacccctatttagcactcctttcagaactcatctgtaattcaatcaacactaagaatcttcacacaatgaaatggctctcactgagcaattacacatatcacctggatacaaaagagagtatatttttcaaatatatttcatggaactccaacagctgtctgaattgtttatggggagagaaaaacgaggtttatatgttctgctaaccatgtggagagtatgaaagtctatagtggaaagaaaagtggaagaagtaaaattgacataacaggaagaaaggaggggcagaaggcaatctggaaaaatgattgagtcttaatttctgataccagtagtactgtaaatatactgtttcaaatgtgagtctgaaagacccatttggggaaaaaaaaatcacgtttttacaccacactcatacccagattgatttttatttaatatgggtgagaaggcaagggatggagttgtaatgaaaatggagtgcaatgccgaaagaaaataagagaccttgcaggaagatgcaagactaaacaatgaactagaatagagtaaacagccacctgggaaacaacatgagaaaattcttgcttcatttccgtcagcagcagctcttacatcttttacaactggaaaccttcccccagcaagagactctaaatacacagggctgaattaattcccaacacgtgctttttctctatgcccttatctggatgtgtcatcctcctttgaagcaaaagactcattaatccaattcaaattgccaacatcagtaaatcctctacctcagcatttaaatgccaataccaattaaataccaacagcaacttaactactgataagatcttcactacattcaggaaatacagccagaagtccagctagcattgattccaaccctccttcatcaattttaatttattcagtgcaaagaaatgaagtaatttgctggccacactgactatgcatctaactggattgaaacaactccacaagcaaataagaaggaacacattgagttgcaatccaccaaacctgaaggatgtcttcaccaagacttctgagctatccagctgtggcaattcatcagctaggatctcctctgggggtcgagggtcatggacaattgttggccttggcttctccttgacattccctgtgagcccatcgatgagggagttccacagacagttctgtgacttagaccctgaggcatggggaaaagagagatgcaggtgaatcatccaccagttgactccatgtcctgccttccccaactcaggatcttccaaagcagagcagggaaatttatatatttctcaccatctccgccaacattacagagttgtaaccaggaatttttacatttatatgcagaaaataggctaccactctgagtattttgacacaaagctaagttattggatatatcttgtctcattgcagtggtgatcagcccaaactcctgacagagccacaggtatctatgtagatgtttattcagcagttggaaatatataaagcactaccattttagggaactgtgaggatgttcaaatacaagtctcccctataaattcagcttgctgaagcccaagactccattctatggagacacccaccccaaagagggcaccacctttaagaactagaactcaccatatcaagacccaggaaaattacatgtagtttatgcatgtaaaacttcaaacacgtgagataaatattaaaggtgggcatcaagtggaagcggtgtctacaaaagtagagcctgatctgccaggtgatcaagatcaaactcaacagtgagaagttgtgttgatagtgtgtgcccttgatatgatgtcatgaaaatgtcacttttgctttgtgtattaggcatgtttctagcttccacaaacttcatgctgtaacatctgccctacatgcatgtgcccaacacagctagttctggacaacccaatagtatgcctgagtcacctgaccttggcctcctgcctcccttgtcgccccactctcccccaacccccaactcctcaggagaagtcctccttccaggggtgtgcttttaaaacaaaaaccagccaatccagagtccacaccccatctacctcccttataggactttctcacccctgaccactctccactgggcctaatcaccccagggcctggtaccaggcaactaggtattaggcagcccctaggctccagccccctgaagtcattcaaactagccagtcccaaccctgcctaccctgccttgcctgttccttcttgcagaaaccacaacaaaggttcctgcccacaatgtcccaccccacctcctgactgacaccagtgcttccccagatggccccgtaacatgacatggaagccctctcctgggaactgtgggtaataaattatctttacaatggcatttgtctccttatctgttgaccttaccatacctaaacagtaataaaacttattaaataatcagtctaaaacacccaatctagccatggagaaaacattagataaaccacttgaagaacctgcgacagaacacctgacccgtgctcttcaaaacagtcaaaggtaccaaatactgctgagcctccatatccatgggttccatggattcaaacaactaaagaaggaaaatattcagaaaaaaaaaatctgtagtaaacatgcacagactttttttgtcattattccctaaataatacaataactatttacttaatattattattttacttattattattaaaattaaattattaaaattaatattttaataaaattttattattttaacaaaattaaattattaaaattgttattgaaattattattttacttaatgttattattatattattccctaaataatacaataactatttatttaacatttacattgtattaggtattacaagttatctagaagtgatttaaagtatatgggaggatgtgcataaattatatgacaatactacatcattttatatcaggcacttgaacctctgtgcattttgttacctgaggtaaccaattcccttggaaatagagggactagcatataaggaaagtctgaaaaactgtcacagccaagaggagcctaaagatatgatgactaaatgtaatgtggcatcctagatgggattgtggaacagatgtaccatgctaaggtaagaggttaataatacaggaaactgcgtgtaggccgtatgagatctctatattatctttgtaatttttctgtaaatctaaaattgttctaaaataaaattcataaaaataaaagtaaataaaaatcataaataaatcatatataattaattaaataactattattttaaaagtctatgagcaaaaaattttttaagtagagcctgaagacattaccattaccattaaccaattgccgttggcttgttctggttatgtctacccagataaaagaaaaattttgtctttgcacaaagacactgtcaggttgagtgaacaggcaacctatagaatgggagaacatttttgcaatctactcatctgacaaaggtctaatatccagaatttacaaggaacttaaacaaatttacgagaaaaaaacaaacaacaccatcaaaaaatgggcaaaggatatgaacagacacttctccaaagaagacacttacatggccaccaaacatatgaaaaaaagctctacaccactgatcattagagaaatgcaaatcaaaaccacaatgagataccatctcatgccagtcagaacggcaattattaaaaagtcaagaagcagtcaggcatggtggctcacgcctgtaatcccaccaccttgggaggccaaggctggtggatcacctgaggtcaggagttcaagaccagcctgaccaacatggagaaaccccatctctactaaaaatacaaaattagccgggcatggtggtgcatggctgtaatcccagctacttgggagtctgaggcaggagaatcgcttgaacccaggatgcagaggttgcagtgagccgagatggtgccattgcactccagcctgggcaacaagagcaaaactccatctttaaaaaaaaaaaaaaaaaaaaaaggcaagaagaaatagattctggcgaggctgtggagaaataggaacacttttacactgttggttggagtgtaaattagttcaaccattgtggaagacgatgtggcgattcctcaaggatctacaaacagaaatataccatttgacccagcaatcccattgctgggtatatacccaaaggaatataaatcattctactatatagacacatgcacacatatgtttattgcagcactatttacaatagcaaagacatggagccaacccaaatgcccatcaccgatagactggataaagaaaatgtagcatatatacaccatggaatactatgcagccataaaaatgagaatgaggtcatgtcctttgcagggacatgggtgaagccggaagctatcatcctcagcaaactaacccaggaacagaaaaccaaacactgcatcttctcattcatgagtaggagttgaacagtgagaacacatggacatagggaggagaacaacacacaccagagcctgttgaggggtggggtttaggggagggagcttacaggacgggtcaatatgtgcagcaaaccaccatggtacacgtatacctatgtaacaaacctgcatattctgtacatgtatagcagaacttaaagtaaaataaaaatagaataaaataacaataaataaaaattaaaaattaaaaaaaaaacactgtcagatcactaagccatgcaccatagagctgtgtctatgcaaaatactgcatttttctaattcacacaaagcctccttatggggcatgagggatgggcatgaaggagtgagaagcagtgctagctaacacacaccatgcacatgggataggcagatagaaaatggatttgtgtgcacatgagaattcctccctgagaccttggccagccacctgcagcccaccatagaagaaatcaccctggcttgttgtgccagaaggacagctctgccaggaagactgaaagaacctcacacacaagagggagttcctcacatggattcctgagcctacaagcaaggacacccatgggtcagcaaacagctctttcaatgcccgtgccataactgacctcccttggggtgtccatccaaactgcttgtgtctatcaagagaaaattaaagtacatcagtggaaggaaacagattcctcaaacccctgaaagacaagacagctttttttgttttttaagggccctacacatatatcttaataagatatggtcctattaatgaagtctggttctgcattaatgaagatcagttctatgttaatgaaggtctggttctgggaagaagaacaagaacagcagcctgttttcttaaacctgatctaaatgaaggccttacaaaaaagttcctgcacatccccctttattccttcatttttttcattcagtaaacacatattgaattccctcaatgtgccaggtttcattcttcgccctagaaatggaaagatgaatgagactggttcccaagggaacccacaagcaatcataataaactggcaatgcaccataactgaggggcaaatagagggctatgggacccagaggagagctcacccactctgcctcgggaccctggggaaaaccacagagagaacatgacatcggatatggtctaaagcatgagacgctcttcagccggtggaaaggaggggaaaacaatcagtgcagacagcatatacaaaggctcagaggcgtaacaaagcagctcctgaggctgggacgaagccacaggggcagtgtccagagatcgggtcagaggctggttgggccatttgcaaagtgccttgaataaaatgctactcatttaagaatttatcctccaagcaataaaaagaaaaaaaaagaaaagaaagatttttgagcaaggttgtggtgacacagctgtacctgtatttcagaaaggagactggtgtgctgtggagtagtgacttatgaggaatggcaggctcgtaggaagagctcctgaatccatagggtgccatgcatttaactgtgggtgaaattacatcttacccataaatatgtaactaatatttaaatatatatagatgtgattaataaaactacaaattcatctaaaactattaatgaattcataagagctttttcaccgttttctcagtcaatgaatcagaaggatcatgagacccaagccacctctacattaagggctcccaaatgaaaatgtgatacctccaaagtaccagcccccacaaagatacacattcatgagtttaaaagaaaactgtggttgaagagatgactaggattcactcaacactcactctcaactcccctctcacttgccttcatcttctaaaaaggctagaaaacaatatacaggcatacataggagatatcataggttcacagttccagaccactgcaataaagcaagtatcacaatataatgagtcacacacatttttttggtttccccaatgcatataaaaattatgtttacactgtagtctattaagtgtgtaatagcgttttgtctaaaaacacaatatacatatcttaactctaaaatgctttattgctgaaataaaaaatgctaacaatcatctgagccttcaagcagaggtaatctttttgctggtggagaatcttgcctcagcgttgatggctgctgactgatcagggtggtgttgctaaaggttggggtagctgtgacagtttcttaaaataaaactctaccatctctgcactcaagaagctttgaagaggcagaaaaacacaaggcagctgctaattgatttagactagagccagtctttggaaaactgaattcgttttccctagccctctccttaatcccctccataaacaattttccaatccatcgaagtgtttgaaattgaccaaaaactttcatgagcgtcctatctatctcacccatctgaattgtcttcacttttcactatcttggaactactttacaatactgtaaattggagaaaactgatagcaacacaaatgaatcttgtccatagaaatgtaaattgtgtcccatggaatgcaattaattatggccctgtagatattgataagtcttgccatttcacatccattaagtaaatttcagcacacctgatggatttacatatttttctgctctttggattttcttccaaactagttgttacatcttactggtttattcatcaatgtgttgaataagatctttgacacatgttcactttgtacttgtatgaattttcaaaaaattatcctttaacagtaccaaagtcctcatgctgctcccctttgagaagtctcttgtagttagcctaactacatctgaattaactatagtacatttatgtaatggattgctatgccactgactaatatcccaaagcgaaagatctctataagctgataaggagtgatttccaagatccattataagtgaaaaaaaaaccgcatgagtctatttatattatgctccctcttgaataagaaacaaggggaaatatatttgtttatttttgcaaaagacaaagaagacaggaccagaaacaatgaaaattacccacaaaggatgagttgggaataagtaagacaggttggagatgaaagacttcacatttgtatatagtttttacttttgaataatgtaaatgttttaatattcaaatatatagttaacaaaaaaatttacaaatcctaaaattgaatagaaacagaaatgaacctaactgtatgtgatattagtaacataattataatggaaaataatgattaatttaaatattttatgaatacagtatccctactgtatatcattagagagatcaactctaaatatgcacacacacgtactcacacacacacagcagagaaatcttgaacctccctgagtaggtttgctgttgttgataatcataaaggagcagttctaaactatatcacatatactgtaggacagagcaaataagcagccataatgagggtgttgggaaccacagctcttattccaggagacagaaaatacaaacagacagtaggagaaggtaaagaagcctgttgtgttagatttgaactagaactatcagtgtgaactcatgattacatattcagcaggctctgaagagatgtttgctgaatgaattcataaatgatagactatttttcaaaaagtaaaaaaactttaaggcaaaaggtgagtaataataatattaacaattttaagtaaaaaacatgtcacaggaaacactctaagaaagacgaacaaagaacactgccgtgtgcggagaaaaaaggccttgctcagcccatgctgaactgcgtccaacataaggtcttgaccaagtttctttctggaaagtagattctgagacaagggcttgtggcaagttttttcttttggaagtgattccaggaggcaggagaggagaacacggagagtaaattagggagtaacaagggaaaaccaagacacaggtgcaatgtcaagtcgtcatcccgtgggtgtattcaccatgtttctagcatctgtaaacttgagctgtaacatctgccctatgcgcatatgccagacatgcctggttccaggcaacccaataataatatgtctgagtcaccttgcccctgcacctcctcaggcagcagtcctcctctcaggggtgtgcctttcaaatacaaaccaaccgacccagagtctgcacccccaaccaccgcccttatagagcttttgtgttcctggccactatccatgggccttaattaccccaagaccactgacattatccaactagccaatcctaaatcagcttaccctgcctcgctcactgcttcctgaaccacactgaggctcttgcctacagcagcctgatcccccctctgcccagtgaccagccccagtgcttccctgtatggcccacatggtatgatgtgccccttctcttggaatctgtgcgtgtaacacactatcttttcaatgtcagtcacctcctgatctgttggccttactgtatttaataataaaccctaccaagacagggtacctgggctgggttctacagggatcacagagaaggtggggagcatgctcagaattatccccctgaggaattgaagagggagcatttatctgcaggctctcatcccccatggtcaaaggtaactccacagggaattaattttctagccctttggggtctacccacacataagtatggggcaattcccacataatctgggtggaaatgaagagaaattaagccggagcttaaaaataggaccaagaggaggtgaagccaggccaaagaggtgcccaggatacagggtatccacacagcttttctgtgctagaaaatacagccagaatctaatctgctactcattcctgccttagaaggatcaccatgggcctctgccatggctcatctcaactcaatctggtgagtcttttggagtaagtactctcctctgtgaactctgagagagtggaaaagaacccttcctctgactctccacaaatgtgggcagaagactctccaggggcactggaaaggtctgctctgacaaaatgaaaaataaaaactccccttctctgatttattttaagctgatgttgaaagcatgaaatgtttctgactaaatagagccaaaaatacacaaacagatagattcacacaggtctttctcaataatatcaaaaaccccatgagggaaatcttaggtaaactaagccttcagggcaccaaaaataatgcagctcaggtgcaggaggtgagcatctcccttcaacccactccatctcatcagcttctcctcactcccctccccaaccttctctttcctctctcctttgacttgttcctgactctcattcaatgcctattacattctcctttcctcttacctcccctctgtccctgccataaatcctctccgttctcttcacaaagacaacttttcatggacccataaaccctccggactggttataaatcctcctgactggcagcatctgtaccactgagctcatcaagagagcaggggctcagattcagatgtagcaaacatttgttcagtacttgctgtgtgctgggctccacctgtgttagcctactgaatcatcagcccttcaaagtaagtattatggaaactactgaacactgggacactaagactccaagaaatcaaataacctagattacagagttagaaaacattactttgacccaaaattctcattctcctaatccaaggctctgtgtgatacatcacactgtgtttattactttattacagagcaagtaaacagatgcttagtgtagatcacgcagaacatcctgcatttctgaataggaaacagacaattttttacataggaaacaggatttgccttatcgcaactaggaagagtcctgacttagtctttttttttttttttttggagtctcactctgtcacccaggccggagtgcagtggcgtgatctcagctcactgcaacctccacctcccaggttcaagcgatttctcctgcttcagcctcctgagcagctgagactacagacgtccgccaccatgcccagctaatttttgtatttttagtagagacggcgtttcaccatgttggccaggctggtctcaaactcctgacctcgtgatccgcctgcctcggcctaccaaagtgctggcattacaggcctgacttactgtcttgcatgcagcagtttgcagcttcctttaacaaaggaagctcaggctgcaggggaggataaataatgccaggtgaatttaatgggctgagaaaagacaagaaagcaagaaaatgagataagaagaatctaaatcagaaataactacagattcattttgtggtgtgcctaagagtggcagcttgataaactgctagtaaaaggagcccaaggtgatgtggtaatcccatttaaatctgacaagtgactcatcaactcagttctgtataagaatactcaaagattatgctggcagaaagctgaaaatttagagtcctgagaagcacagggaaagaaagagacatagttctctgtaaagggaaggaaaaaacattactgaaaaccttcaacggttctcaaaatatctgtgacatagggttgtagccttcctctcctttggagaaataaaactcctaaaattctcagtgggtaggaaatttggggctgggatacataggaattaggaatgaatggagtaaagcccagatgaagaactttatgctcactaaaacaaaacaataatgatggtacaaaaaataaagtaccaataatgttttgaatatcttaaatcagtcacctagatactgttttgttattttcaatatagtagttactggttttaggaacttttccggaattctgtctcctgcaattgcaaaaagatttgaaaatttaactccttatcatacacatcaggggtggggaaaaggactccctcaacaaaatataagaataaaatttgatctgtgatgatacattctaaattcccaaagacattaggatttatttctaagttatcttgttagattaacctgttttcctaaatccccagtataatagtattaagaggtgtggcctttgggaggtgattgggtcatgagggattcacggaaggactctggttcccttttgtcccttccatcatgtgaggacacagcgctcctcctctcagaggacacagcaaccagtcatcatcttggaagcagaaatcaggccctcaccagacactgaatctgccagcaccttgatcttggatattcattctccagaactgtgagaaataaatttctgttttttataaattacccagtctcaggtattttattatagcaacacaaatggcgtaagacacttggcagatataagtgcagaattttccaaaaacatatacctctggcatttgtgtttaagttaaatgctatgtggaattgtaatataactggctttctggaatcataaaagtctcacacactgctgctttctgaaagttacatgggagagaggatttagaaattatgaagaatggactgtgtcccatcttttgttatctgcgagacacaaagtgtaggaaataattcaacagactcagaaaataatagctggaagtaatgaggggaaacccctaaaactgtcacagaaactttaaggattgaaactggatgtgaaatgaagatttgaaacaatcttgtataggtcttaaagggaaagtctacatgatatctggatcatatattaaaaacttatatgcacccaatacaggagcacccagattcataaagcaagtccttaaagacatacaaagagacttagactcccacacaataataacgggagactttaacaccccactgtcaacattagacagatcaacgagacagaaagttaacaaggatatccaggaactgaactcatctctgcaccaagcggacctaatagacatctacagaactctccaccccaaatcaacagaatatacattcttctcagcaccacactgcacttattccaaaactgaccacatagttggaagtaaagcactcctcagcaaatgtaaaagaacagaaattataacaaactctctcttcaaaccacagtgcaatcaaactagaactcagaattaagaaactcactcaaaactgctcacctacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatctaaaattgacaccctaacatcacaattaaaagaactagaaaagcaagagcaaacatattcaaaagctagcagaaggcaagaaataactaagatcagagcagaactgaaggaaatagagacacaaaaaatccttcaaaaaatcaatgaatccaggagctggttttttgaaaagatcaacaacattgatagaccgctagcaagactaataaagaagaaaagagagaaaaatcaaatagatgcaataaaaaatgatacaggggatatcaccaccaatcccacagaaatacaaactaccatcagagaatactataaacacctctacacaaataaactagaaaatctagaagaaatggataaattcctggacatatacacactcccaagactaaaccaggaagaagttgaatctctgaatagaccaataacaggctctgaagttgaggcaataattaatagcttaccaaccaaaaaaattccaggaccagatggattcacagccgaattctaccagaggtacaaggaggagctggtaccattccttctgaaactattccaatcaatagaaaaagaggaatccttcccaactcattttatgaagccagcattatcctgataccaaagcctggcagagacacaacaaacaaagagaattttagaccaatatccttgatgaacatcgatgcaaaaatcctcaataaaatactggcaaaccgaatccagcagcacatcaaaaagcttatccaccatgatcaagtgggcttcatccctgggatgcaaggctggttcaacatacgcaaatcaataaacgtaatccagcacataaacagaaccaatgataaaaaccacatggttatctcaatagatgcagaaaagacctttgacgaaattcaacaacccttcatgctaaaaactctcaataaattaggtattgatgggacgtatctcaaaataataagagctgtctatgataaacccacaggcaatatcatactgaatgggcaaaaactggaagcattccctttgaaaactggcacaagacagggatgccctctctcaccactcctattcaacatagtgctggaagttctggccagggcaatcaggcaggagaaggaaataaagggtattcaattaggaaaagaggaagtcaaattgtccctgtttgcagatgacaagattgtatatctagaaaaccccatcgtctcagcccaaaatctccttaagccaataggcaacttcagccaagtatcaggatacaaaatcaatgtgcaaaaattacaagcattcttatacaccaataacagacaaacagagagccaaatcgtgagtgaattcccattcacaattgcttcaaagagaataaaatacctaggaatccaacttataagggacatgaaggacctcttcaagcagaactacaaaccactgctcaatgaaataaaagaggatacaaacaaatggaagaacattccatgctcatggataggaagaatcaatatcatgaaaatggccatactgcccaaggtaatttatagattcaatgccatccccataaagctaccaatgactttcttcacagaattggaaaaaactactttaaacttcaggtggaaccaaaaaagagcccgcattgccaagtcaatcctaagccaaaagaacaaagctggaggcatcacgctacctgacttcaaactatactacaaggctacagtaaccaaaacagcatggtactggtaccaaaacagagatatagacaaatggaacagaacagagccctcagaaataatgccgcatatctacaaccatctgatctttgacaaacctgacaaaaacaagaaatggggaaaggattccctatttaataaatggtgctgggaaaacgggctagccatatgtagaaagctaaaactggatcccttccttacaccttatacaaaaattaattcaagatggattaaagacttaaacgttagacctaaaaccataaaagccctagaagaaaacctaggcaataccattgaggacataggcatgggcaaggacttcatgtctaaaacaccaaaagcaagggcaacaaaagacaaaattgacaaataggatctaattaaactaaagagcttctgcacagcaaaagaaactaccatcagagtgaacaggcaacctacaaaatgggagaaaattttcccaacctactcatctgacaaagggctaatatccagaatctacaatgaactcaaacaaatttacaagaaaaaaacaaccccatcaaaaagtgggcaaaggatatgaacagacacttctcaatagaagacatttatgcagccaaaagacacatgaaaaaatgctcatcatcactggccatcagagaaatgcaagtcaaaactacaatgagataccatctcacaccagttagaatggcgatcattaaaaagtcaggaaacaactggtgctggagaggatgtggagaaataggaacacttttacactgttggtgggactgtaaactagttcaaccattgtggaagtcagtgtggcaattcctcagggatctagaactagaaataccatttgacccagccatcccattactgggtatatacccaaaggattataaaacatgctgctataaagacacatgcacacacgtatgtttattgcatcactattcacaatagcaaagacttggaaccaacccaaatgtccaacaatgatagactggattaagaaaatgtggcacatatacaccatggaatactatgcagccataaaaaaggatgagttcatgtcctttgtagggacatgatgaagctggaaaccatcattctcagcaaactattgcaaggacaaaaaaccaaatactgcatgttctcactcataggtgagaattgaacaatgagaacacatggacacaggaaggggaacatcacacactggggcctgttgtggggtaggggtaggggtagggatagcattaggagatatacctaatgttaaatgaagagttaatgggtgcagcacaccaacatggcacatgtatacatatgtaaacctgcacgttgtgcacatgtaccctaaaacttaaagtataataaaaaataaaataaaataaaataaacaacttcttggccgggcactgtggctcatgcctgtaatcccaacactttgggaggctgaggtgggtggatcacctgaggtcaggagttcgagagcagcctgaccaacgtggagaaaccccatctctactaaaaatacaaaattagctgggcgtagtggcgcatgcctataatcccagctactcaggaggctgaggcaggataagctcttgaacccgggaggcagaggttgtggtgagtcgagatcgcaccattgcactccagcctgggcaacaagagcgaaactctgtccccccacaaaaaaaagaaaaaaaaaaacaacttcttaatgcaggagaatcgcttgaacccgggaggctgaggttgatgtgagctgagatagtgccattgcactccagcctgggcaacaagagcaaaactctgtctcagaaaaaaaaaaaaaaaaaaaaaaaattaatagtaaagccaacttgcattactcagataggttctatttggtcacgttatattgttactagaatatacttacagatttgcagtgccagtaattctattcttcacctttggtttccattctagcctttagtttcttcttttacgttgtttttatcctgggaatagtctattccccaatatttgaataaaattgcctataaaactcttggaatccaaattaattttagcaaagtaattatttcacaaatttttaaaagtctttgtttttgctgcattcatcttacctatttcttttggaatattttcctttacaattgccattttgcagagatattcaaatttgtttgcataaatttatttgcatcttctgttttaatcttcatctacatattaatatttttgagtatttatttgcttattttcttctctgtctactttctagagctcttctttccaacatgatggccattagtcacatgcggcaatttaaatttggaataactaaaatttaataaaatcaaaaatccacttctttagtctcactagcacatttcaatgttcaatagacacatgactagtagctgctgtattgcatagcaccaacagaattttccaacattacagcaagtttcactggaccgtgctagtctagagatttgttaatttcattgcctttttaaagtggtagttcttgaacttagaaactctgctactttcccatttctaattcgtctttgcttttagatttgatattttcattcccctactttcaatagattagtcttccacttttttccctaatttgtttttttgttttttttttttttttttttttttttgagacggagtctcgctctgtcgcccaggcccgactgcggactgcagtggcgcaatctcggctcactgcaagctccgcctcccgggttcacgccattctcctgcctcagcctcccgagtagctgggactacaggcgcccgccaccgcgcccggctaattttttgtatttttagtagagacggggtttcaccttattagccaggatggtctcgatctcctgacctcatgatccacccgcctcggcctcccaaagtgctgggattacaggcgtgagccaccgcgcccggccctaatttgttttttaaatcagagaatttctatctatggttttggctacatgtcacccgtttgacatgtcaacttctaagaagacagcaatggcaatgtttatttcccagaagttgtctatttttgaaaacatattcccagtagttgtttttagtggtggtgtcgcttaaacttgtcttcttcctttctttgccttttttattttctaggtaacaatatagtcattatatggatagttacataatatgtaattaattaatgtaataatattacatattatatgactataatatggtaactttgtaacagtatagtcagagagtatgtcctacataatctaatcttgatttaatctaatctgattttttgtcatctaactcatgggaatttttgtaactatttcatgggcactaatttaaagaaaaggaccatatctagcatagcacgcaagatctatcctatggctggaataaggtgtagcattttcacatcttcattgtggacggcatccctccttcatcgatagaaaattactcattttgcaatttgttccttgaattctgctttttagaaagttgatcctaccagagctagctcctttttatttgtaattacctgaaacattcttgcctatcatttttggttttagtttttcctcttgaaacaatatatagctgtaatgtgttttaatccagattgggaaactattataattttcttttcttctttctttccttctctctctttctctttctctctctctttcttttattttcagagacaaggtctcactatgtcacccaggcgggcctccaactcctgggctcaagcaatactcctgcctcagtctctcaagtagctgggattacaggtgtatgcagccatgcctggctgatagttatctttaaacttaaaattatatattcttatattatgtttctcttatatttttatcaacatcaataacttaatagtgtccacttactcctatgtgtctgaggtgatgagattacctttcccatctctttctttccctctactcacttttactaatattatgtgaatttttagatattttgctaaattgttattttaatattaagatgtatcactgttaagaattatgatggtatttcacataacattctgttttctaattttatgtccaataaatatttggacttaaagatacatttacctggttttggtgctcaatacttctttaacgtaacaatttataatctagagcaacactgttcaatggaacagatgcaagttgcatacgtaattttaaattgtctagcagctacattcattgaagtgaagacaaacataaataattttaacaactttaagccaataaatcaaaaatctggtcattttaacatataatcaatacaaacaatattaatggaatttttatattattttactttttctcaaaatccattgtgtattttacacttacagcacgtctcagttaggactagccacatttcaagtgcttaatagccacattatgcaggacagcacagttctacagaatttattttgattcctgtttcaattggctgaagtatatccttgaattctttccaagaatggcatggtggctaatgagatacacaagaacaacaacttaggtatagatttattgaattttcattaaattcaacatatttctcagctgtcttatgctatttgcatgctgtagaagagaattaggaataaagtctgataggttttttttctttgcaggcaaacatttttctttatctttgtaattcaaaaatgttgctagtatatatgaaattggggggggattttactaaaaaaaattatttctattgaacacagggagcccttttaatctgcaaacccaggtcttactttcttctgttcaggcaagctgccttcaattttttctttgttgcttcttttccaacttttctctcagcatacatacgattcatttatttatgttggttctttcttttctgacctcctactaccttttctcatcattttcaattttcatctattttccaagacagtgttttcaaatttaacttctaatcattgattaaaattttgttgctgtaatttttatatttcagtgaggattttattttaattcctatgtcacatatttttatttatctctaactctaaaaacacctgtttctcttcttatgtctttctgctgctatcttaccagggctacatcttctcatttctttgggggaatgcaaagtaggatttgcatttttctttgggcttctatattcagaagcctacctttcttctaagtctttaggatggtattttctttccctagttcttcagattttatttgaagtttcattttagatttatccctagtttaatcattctggagtgcaaaaaaactcataaagagcttgttaattttcacaaggcaaggtatgtgtgttactctagattttattcatcatctatttgggcaccatttacttgagctgtcagcagaaagaatcaagaataagactaacatttgtattcaaacagctagttatcacaataagcaatgcataacccaagcctaaagagttagaagcaagaatgggactcaacctgcttcaaagcaaagcattacatctgtccttatccaactgatgtgcacagcccagagataattttcaaagtctatttagaaattcatctggtgcagtggatcactatatagtgagaccatcaattccaagaggaaaggtctccattactctttgtcatacataaaaagaatgaatctgttcagcagagtaaagatgtacaaaagattaaagggagactgttttgaagaacttcaacagcattcatttagtagactaattagaacaaaagcttatctgttagcagtgaaatacacttgacaaacattttcttcatggttagtgtaagttggatacttgagaggtagaagacagcattttttaaaaattttctataatttatactttcactaattcagacactgcctcccccaaaattaagtgaaaattttttaatgcataactaccttgaagtatgccaatgtctgcaaagcatgcaaaaatccaagtcttaccatctgttggatgattcatttgtaaatctgcctagtattcctttgggaagttccagggctgatttttaacctcattataaaaatttggtgggaatgaattcagggatatagtatatatgatgtgctctgagcacttggaagagtgtgccacattaatctgagtcatgtttaaatgggatatgcactgcaatcaaaaataaaagcgtttgaaagtaattgaagatttagggtttttatcaagagttccagaaaaaatagaggctttagggtaatatacagatcacagaaaatatttttttctactttttgcccaaactagcctttgctgataataaagacactaaactcctatgggaaagaactgtgacttactcatttttgaacccccacacccagaatgtcctttcaaggttaacttttgtatctacttctaagatgtcttcttctgaggctatagaaaccacattaaaaacttggttgaacatctcatcagccttgtctttcttccacctgcttcaattacatcatgcatgggctttctttggcttctgacccaactggcttcacatcttcacctcctttcttattagattgctctattggattagggaacctagcttcataaaatgtactgacctggaaattaggcaattatttcatgggtttcaagaatcgcagctgcaaatgtaagaatttcattagggcccccaaaactacacagttgaagagggagttgttcatagcttagtctataggatgatgttccctggacttgcacatttcacagcctacaaaactgtatgtgtttactctgggcttcagtccatggcttagccacggcctaatgcacaccatggcaagaactgtagcacctccttggtctacctgcctgtccaggggaggtgtgctagacatagtgcttggcacactattgagttggtgctccataagtatttgttgaaaaggaggcatcacaggaacttatgactgataaatcatgtggtcttgtgtaaattaataatgcatctgaattctgtctagtagagtaactgagtatgaatctctaagaacttccaggggatgagtggattttccctcctggtttggagttggcacagatcttgaatcttttcattcactctgttttcagtccaattaaacaaacatttattgaacacctacgatacactgactggtggggcagtttctgctttcaaggaactcagaatctagtggggagacagccattaaagatatacttaggatacagtgtgaagcaagcaatactataaccatgcagaaatatatagatgtcaaataaaggagaaagtaattaattttatcctggggagtcaggccaggctttgtagaagaggtggtctatgatcaaagttttgagaaatgagtgggttttcttggtgatcagcagagggagaggattttccatgcagaagggacagcatatgcaaaggcatggagaagtgaaatatcctgggagagcaactagttaaatttttctggggcttaaatggtgaattactgcatgacagaggaggtcagcttgaaggagcttatgtggtactctaagggctttgactttattctgcaggccgtgagaagtcagtgaagatgttttcaaattaaattcttttaatcactccttcttttgagagaattgtaaattcacatgcagttgtaagaaataatatggagattccctgaactgtttatgaagtttcccccagtggtgacattttgtaacaccatagtacaagatcacaaccagaatgttgacattgatgcagtcaatttacaaagatttccatcaccacaaagatccctcatgttatcctgttatagccttactcattttccttccaccctaccccctcttttaacccccaacagtcactagtctgttctctatctttatagttgtgtcatctcgagaatgttatacaaatagactcacacaatatgtaaccttaggggactggtttttttcactcactgtaattctctgaagagtcatccaggttgttgcatggatcagtagctcattcccctttcttgctgagtaatagtccagcacagtttgtttaaccattcatctgttagaatacatctgggttgcttccaatttttggctactacggaaaaagctgctataagcattcatgtaggtttttgtgttaatataagtcttcatttttctgggataaatgcccaacagtgcaattgctggtcgtatggtagttgtatgtttagctttttaagatactaccaagttacttttcagaatggctgtatcaccaaccatgtatgagtaattcagtttctctgcaccctcagcatttggagtgatcaccatttttattttagctgttcgggtaggtgtgcagtggtatctcattgtggttttaatttgcatttcattcttcatgcatttaatttgcattttcccttttcatatctttttatgtgtttatttgccatcggtatattttctctggtgaaatgtctgttcatgttctttgaccatattcaaaatgcatcgtttgctttttactgttgagttttgagaattctttatacattctagataccagtcctttgttgcatatgtggtttgcaaatattttatcccaccttgtagaatgtctttttatcctaacaaaatctttcacagaacatcaatttttaatgttgatgaagcccaatttatcaatttttacttttatagatcatatttttgtgtcaagtccatttttcctagtcctaagtcccaaagattttctgttttttctataagcttcacagttttatatttaggcccatgatctattttgaattattttttgtttaatgtgtaagacaggtcaaggttcgtatttttgtttacagatgtccaatactgaagcacagtttgttgaaaaggtcatatttcctccattgaattgctttttcatctctgtcaaaaatcagttcagcatatttttgtggattcatttctgggttttctattctattctattaatttgtaagtctgtgctttcaccaataccactcatcttgatcaatgtagttatataggccttgaaatcgagtagatagactcctcacacttttttttctttttaaaaatggtttaactgttctacttcctacgattttctgtatacattttagaatactctcatctatataaaaaatcttgctgggatcttgatagaaattgtgttaaatctgcatataattatagggagaactgacatatttgctatgtttcatcttccaatccatgaacacagtatgcatctccacttatttagatgttatttgatttctctcatggcactgcatagttttcagcatacaagtcttgtacctacaagtgttgttagatttacatctacatatttcaccttgttatatgttgtaaatatgattttatttttatacaggaatagaattgattttgtatgtttatcttatatactgtgaccgtgctagaactcatttattagtctagaaattttgttaattagcttccttgggattttctatgtagataaccatgtcatctgcaaaagggacaattttacttctgtcttttttatctgtatgtttttaaatttttcttttcatcccttattacactggctagagctttcaacactatgttgaataggagtggtgtaactgaacattcttgccttgttctcatttttaaagaaaagcatccgtttttgcccttaaatataaagttagttgaaggtttttgtagatcttccttatcaagttgaagaaattcccctaaattattatttttctgagagtttctatcatgaatgaatattgaatgctgtcaaatatttttgtgcatcaattgatatgatcatgtaatttttcttctttaacctattaacatggtggattatactgattgattttagaatagtgaatgatacttgcatccatagaattaaccctacttggttgtgtggcatagactttgttttatatattattgaattctatttgtgaaaattttgttaaagatttttgcatctatattaatgagattttggtctgtaatttttctctttttgtactgtctttctcagttttgacatcaagacaatgttagcttcatacatgaattgagaaatattcccttctcttctattttatggaagagattatgtagaattgatgttaaattttctttagaaatttgctagaatatttgagtcacaccatgtggactcaagagattgcggggggaggacagctttttattacatactacactttcttagtatagagttataaggctattcaaattatctacttcacattggatgagttttggtagtttatgtggtttttttttttggttttgttttgttttttttttttttttgagacggagtctcactctgtcgcccaggctggagtgcagtggcacaatctccgctcactccaagctccacctcccaggttcacgccatactcctgcctcagcctcctgagtagctgggactacaggcgcccgccaccacacccggtaatttttttgtatttttagtagagacagggtttcaccatgttcgccaggatggtctcaatctcctgacctcgtgatctgcccgcctcggcctcccaaagtgctgggattatgggcgtgagccaggccagtagtttatgctttttaagaaaatagcccatttcatctaagtcatcaaatatatctgtgtagcacggttcacagtattcccttattatccttttgatatctgcatggtctgtggtgatatcccctgttttattcctgatattcataatttgtgtcttgtgttcaatctattgttgagaaagatctgttgatgtctccaattataattgtagatttttctatttctcattttaggtctaacagattctactttacatattttccaactgtattgtttggtgcataaatatataggattgctatgtcttccttgtaggctgacccttttattattatataatgtttctctctgcctctgcattttcttcattctgaagcctacattatctgatgttaatatagccactacaggtttccttcaattaatgtttgcatgagctgtcaacctgtctatacagtcatatttgaagtgagtttttaatagcacatagttgggtcatgttttttaacccactctgccaatctctgtcttttaattactatatttagaccatttacatttaatgtaattattgatatgtcagggcttacatcttcttttattttttatttcctgtttgtcctctttatttttcatttatctagtttatttttcctgccttcctgtggcttacttgaaccttttttagaattccactttacctattgtgtatctctttgcatcattttctcaatagttgtactagatattacactatatatacataaataacttaccaaagtcttctgatgttatcattttggaagtgtaagtaaaatgtggaaaccttacctccctttacatccctttactttctcctctttgatataattgtactaaatatttcctatacatacatttagaacattatcaaatagtgctaacatttttgcttcaaccatcaaacataacttagaaaactcaagaggagaaggaaacattattggatttagccacattgttgcttactgtgttctttcttcctttctgatgtcccaaggttccttctcttattgttttctttttgtttagagaactttctttagatattcttttagagtaggcctgctggcaacaaattcttagttttccttcattttataatgtctttatttcccctccatttctgaggaatatttttgctgattagaggggattctaggttgacagttctacccttttagcacttgaaaaatattgtgcttccatggcttctgatcaaaaatctgttctcattcaaattgtgttttccctatgagtaagatgtctcttttatctggctgctttcaagatttctcttgagattttagaagtttaattatgaggctgggttcagtggcttatgcctgtaatcccagcactttgggaggtcaaggcaggaggattgctcgagcgcaggagttcaaaaccagcctgggcaacatagtgagaccctgtctcaaatttttaaaaataaaataataataataataatgaattttggcatgggtttcttcaggtttatcctgtttgaactgactttctatggcacagattaagcaaaggaatatggtgcactaccttattatgccagatagaggtagaagttcaagttccctactgggcttccattgctccattgacacctgaggaaggatgtagctttgttatcgctgggaaggggtgagagtttcagctccccacatggtctctactgacactgtgtatggaatgacctcattatcattgtacaatgctatagtcctgattctcctctaggcctcccctgacactcagctcagcagggaggaagagggatgcttggttactgtcagttagaagtggcagcctaggttccccacatattctccactgacatcatgatgggaggaaggctgatttagatgaaagggccagctctctgtttaactttttctgatgccatgccagcaagggtgttgagataccttgttacagccttgtgagggtggacatccaggtttcccagcaagccttttttggaatgggtgaggatggggccacagctttttctgtgatgtttggagggagtagagtgtttattatctaaaagttttctgtcttgctaggcttcccctttcctggtccttaggtagagagtagagttatgttagggctctttttttgggtacctgttgtcatttccaggtttttatctttttcagctcgaagtctatggtatatgataaaaaaagaaaactcagggaactcatcaccatgttgtttcttgggtcccaagtcgtctagtcactctgtcttcttctttttgccttcagagtattcttttgtttattttgtatataatatccaggggttttagttgtaattcatgggaaaaataggaaaatgtatgtctattttatcttcctagaatgtgtgtgaaggcttttaagagggagaatgacatggtcagatttatcttttaaaagattgctctggcagggaggagaattgatttcacagaggaagacggagactcagtggaatccattacataaggaatgtaaggatttaaaacaaagttgtagctgtgagaataaagtagaatgatctgaataagacaattcagtagtcaggatcagtggaatttggtgactgatgagggagaatagagatgcatatatgatttgtaggttttcagttaatattgcctaataaataggatggcaccaattcagttagaaaacacaggagtaggaacttctatagggatgaggagaaattatgagtccagtttggaaactaacactttaggggtttctattttcttcaacttttggttaataaataagtttggcagtttttttgtgatgacaattttccatcttaagtatgcttccttcaactagaaattcagagaatgggatgctaccccttttcttaaaatctagctctccaaataagatacacgagtgggcaataagcatattaaaatatgctaaacattattagtcattagagaaatacaaatcaaagccacaatatatcaatatttcacacacattagggttaaatttatttaaataaccataccatgtgtagaggaggatttagagaaattggaaccctcatacattgtgaacagaaatataaaagagtaaaaccactttggataacagtctggaagttcctcaaaatgttgaacttagagttaccatataaaccagcaattccattcagaggtatataagcaagctaaataaaaacacatatacactttttaaaataatatacaaatatccatagcaacattattcacaagagccaaaaattagagacaacccaaatgtccattgactgaggaaaggaaaaataaaacgtatatccatactagggaatattgtcctgcaatataaaggaatgatttgcttacacatgttacaacatggatgaaccttgaagacattatgctaaatcaaaaacatagccagtcacaatagaccacatattgtatgacttcatttatataaaatggccagaataggcaaatctataagaaaagaaatatttaaatagccttctaggactgtgggtatggatctcagatgaaaagtaactgttgggcacaggacttctttttggggtgacaaaaattatctgaaattagattatgttgatgatggtggcacaactccataaatatatgaaaaatcattgaattatgccctttaaatgggtaagctttataatatgtgaattatatttcaataaagccatttttattttttaaaactaaatagcagcaatcatcttaatattcattttaatttttaattgtgaattacataaataatggttagtccttgtatcctatattcattcttctttctggattcaacagtcttcctgaggtatatcctttagcagttatcacaggaaggacgtatatgataaattctctcagaatgagtttgcctgaaagatgtctttattttgccctcactcttaaatgatatttctctcaatttaaaatttcaggtcaacagtattcttccctcatctctatacaaatattattcaatttgacttctggcttctaaataaactattgggaagtctacagtcagtctaataattaatctatgatagatacatcagttatgattagttatgtctgaataacagaaactcaaaattccggtagattaaatgaaataaaagcttatatctctgttacataaaaatcagagatagaagtttatatctctgttgagtgagatgtaagcctttcagaactgatatagcagctctgtttcacaaaatctttagattaccattctaccaacccttgggtttgagcattatcactgtggtccaagatggcagctagagtgctaagcattacatttgtgtcctaggcagcaggatgaaaaagcgataaagaagaaaggggatgaagactacacaaaagcctcaagaaagtttccagaaacttttctttgacagctctgcttacattctattgaccagaacttagttacatggtcacacctagctttaactgtttttggatatggggacataggcccagctaaaaactgaagttcttttaacatagaaaaaaagaaactcagccgggcgcagtggttcatgcctataacccagcactttgggaggccaaggcaggtggatcacttgaggtcaggagtttgagaccagcctggccaacatggtgaaaccctgtctctactgaaaaaaaaaatacaacaattcgccgggcatggtggcgcatgcctgtagtcccagctacttgggaggctgaggcaggagaatggcttaaacccaggaagcggaggttgcagtgaaccaagatcgctccactgcactccagcctgggtgacaagagcaaaactaccaaaaataaaaatttaaaaaaaaaaacaaaacactaaactcgtagtctcagacacagtaggtaacctgtcttttctcttcaattatttttggtgtttgcccatcgtctatactgttctgcagtttcattataatgtatctgccaatagattttttattttcctgattgaaactgggtacaattcattagtctgaggattcatatcactagtcaattctgaaaaattctcagccactagatctttagttactattttgtccatattctctctggtctttcattctgaactcctactaaatgtgtgctggcctttctcattctgtcttccgcagtgtttgaccattcttttacatccaccatttctctatgctacattttggatagtctcctcagatatatatttcttctggttcattatctctccttttagtcctattcaacacagttggtaaactgtgtttgggttttgttttgttggggttttatgctatattttacatttcttgaagttctacggattatctttaaaattttccattttttccaaggtcttgttcctttcttagagtttcaactcattttatatcttctgtcatttttaaatagacctagtctttttttttccagtttgtcattataccacaggttgaacatccctaatccaaaaaattgaaacctaaaatgctccaaaattcaaggctttttgagcaccagcatgacatcacaagtgggaatttcacatctgacctcacatgacaggttgcagttcaatgatgatttaatgtacacaaactttgtttcacggatgaaattatttaaaatactgtgtaatgttaccttcaggctatgtgtttaagatatatatgaaacgcaaatgaattttgtgtttaggcctaggtcccatccccaagatatcccattacgcatacacaaatattccaaagtcagaaacaaactcaaaatccaaaacatttctggtcccaggcattttgggtaaaggacactcgacctgcatctcaagttcttaggctctaattatctgtgtttgctgactcttgctcatcatggaggactgctgcctcttataggttttttgttttattttgtttttaattttgactgtgagctcatacttagttggtcttgttttctccatgagaatatcttatgacttgggttgtatttcaaaagatttttcatttgattctgccattagtagcccagaactaatgtttgttaatttcttaggctcaaagtgttcctggacctttcaggtagtttcaattgcccagggaagacttttcctcaagagccagaaaagccaagcaagttaccttattacccctctatgctaatgggtgcattttgttttcctgatctctcttttattagaaacatagaccttgtttcaactacctattgatgcgtaacagatcacaccaaacttgtggcttccaacaacaacaactacccattttgctcaaaaacttgcactttgggaagctctcagagatgggctttccacagggcctctgtttcctcacagtattatggcagtgctctaagaacaagtatcccaacaggcagcaggtggaagctgtttcttctgataatctaactttgcaagtcacatcatatcatctctgccacatttacaggccacccagactcaagggaagaaaacagaggcctcatcatctcagtgggaggcttgtcagcatcacattgcaagaagagcatgtgggatgggagatatagttacaaatatttttggaaaacacaatctgccatatgttttaagagtccgagttaggcagaagtttcagatccaacttctccaccctgcatagccaaaggtcttatctcctctccccatgtagatgttaaaacatgtgttactagattccatggacttaacagcaccacccccatgcagcatagctgcaaaatctgcacacatgttaacagcttaccgtactgatattaaattcttccttcattgctggcacctgtggggttccctttctttattgcaagtttaactgtgcatttaaaagcatttttaaaacatttcactcagcatttctatgtgcttgtaaaaaatgagaaggttttcaggttatcctcgtctgtctcttgccgaaacctaaaacttcatcttaactttattcaaaggagtatatattgagaggatagaggaggaggtgcttggagtgcaacagccaagtcacgtcttccttgccctccctggggttacattacatacaaaaaaaattctattcatatttttcaattatctaagcgtgtacacatgtagcaagggtaaatatttgctattatctcaataggggtacagcattcccattaagggagcagaaactggtctgcatttaggcaaatataagttgaaaggagtaggacgtgagatgctgaggacaagggtgtgagcagatccatcaaagcaagagagatagtcaagtggctgctctgcatgagagatcccaggagtggctctgattcctaaaagggaggtggaaataaagggtaaagaatggaggaggatgaggataaaaggatgtacagtggtaggccaggagcagcatgggcaaagcagtctttaaaatttttattggtggtagaatggctaaatggactgttgaaaatcaaactgaatttaaatggtctgtctgcaattgcagtgcatattgtggctctctcttgttcatcccttcttaatcttcagtcaagctctgctttgaccaatgcctttggttactctccagaaaaaggaggaggaggagcttcgtagcacatctgagactatgtcagagcaataggaagatagccagaagcaaatagaggaaagcaatcgacagaggtaggaaatcagggtcagaagaacaccaccatcccaggtactcacggaagcatcagggagtgctctgaacttccaaatgtcagcacacaacagcagtgttaagcctcttcacctagatctcaatggacttggagcttccagctgacatctgggttacatgtatcatccataaactcttagaagctacttatggaatcatcagccagtccactggtggaccactggctaacatattagggacctagggatatgtctttgtatatatttcaaagactctatcaagcacattcaaaaagagaaggcagagtgagtctcagtgtcctgccccttacccccatacacatgccagtccatcactctgaccacaaccaccaatgctttccaggacacagtgaatattcctccgctggatgggctcctgcaaagagctcatgaccccatgacagggatgtcatacaagggatttgagctttagacagagtggtgagcactggactggatcatttgtaaactctactttaacttgaaatctttcaaatcccaatgaatacatctgttgactgaaccaagctgatcggcttgcctgataacaactgtgtttgatgaaaggggtggagaaatggggtaagataaggtggtgaagtccccttgtgggcaagcagagaaattttgggtcaacacaagttggggtctaactgtggctctgaaacatggatgtgtcacaggtcactgggggagcttcgagaggatgattataagtgtagataagaagctagtagccagctgtcttgtgttcttttgtgttgcttgcgtggttgattgattggttggtttttgtggtatgaaaacttaacatgagagctatcctcttaatgtattttaacgtgaacaataccatattgttaactacagggattatgttgtacagcaggtctccacatcttattcatcttacataatagaaactttatacccatggagcaacaacttcctgtttgctcctccccacacccagctcctagcaaacaccatccaattctgcatttctattagtttgactattttgcttgccatagcaccctacatgtacgtgatctcatctgtcctggatcccttatatggttctgtctcaaacgtagtacatgcccccgagaacactgaaagcccagccaccagccacacagtcccccactcatggcatttctcagtcgttcctcccacatatttcttcttcttctttttgtcttcatccatccccagttcaagctcccttcttttgtcaccaaccctcctagccataacaactgatctagtaaagttccctggctgaactctagcactgtctcggacatgattttgagttccctctggggctccatacatggcatcaccatgtcataggtgctgcctccctctatttcaaccaaccccagcgatcaccccactgcacatctctgccttccatttcccatctctgcagagggaaggtgatcattcacccagcacaaaaatacgaagggccgccccttgcttcactcccccatccaccctaagtactccagctctttcacaggaaaatctatttccaaaaatacctggattcttaattaatctctattttcttattgcttttgataccgctatagtagtcccccattatccgagggggtacgttccaacaactgcctgaaaccagggatggtgcctaacatgattgctgttaatcagaacacgattctgctcatgtctaccctccgcaaatttaataacacttccatcttaactaagcacttatcctgtcctgtggccataacttttgcagctttagtgcaacaacaaaactagcacgaatttctgtttccttctttacagtttcacagatagaaaattcgctctccctgtggatctcagcaaccttggcatacagtttttttctttattaagtcaagaactttcaccttttcacttaaagaaagcacttgctggcttctctgtggtgtatccaaattgccagcatcagtactcttgcactttttactaagtgcacttagaaattgcacttaggcaattactaaataaaataagggtgatttgaacacaagcactgcaatctgataaacgagagggcccctaagtcactaacgtgtaggtagcatctacacatggatccactggacaaagggaggattaacatcgtgggtggggcagagtgagatttcatctcgctattcagagcagcactcaaatcaaaacttgtgaattgtttattcctggaattttccatttcatatcttcagaccgctattagccacaagtaacaaaactgggaaagtgaaaccgcagataagggaggacttttgtattttcttgtccacgattgctcatcttgggggagaaattagtcctccctcaggaaagcaaccagaactccagcatacagctgcccagccacaagagctctgtgggcactgtctccctcgctcgggctcctccaatgccctggactcctgacagaagctctgtccaatgcactgaatgcagcgtcttttacgtcctctagaggagagggatgccaccaaaatctgggctttttctgccacactgtggccacgtctgaacactacatgtggccacgtctgaacactacatgtggccttcattcccttacatgtggtatttggagttttttccaatgaagattagaagttaccttttttacctattatccccattcagaccctcaagcctcagctaatgctcactttctccaggaggactcccttgaattcacctccacaccaggctggctgaagcgtccccgttctgactctcccagctcctcctaccaattgctagcatttccttccacatgctgtattgtagtagtcacttctgtctccctaattagactgcaaaccctttgaagacaaaccaactcatctgtgttatctccatggctcacagaagaacagaaaagtcttcaataagtatatatgaaattaaagaaaaaagggaagaagagaggggaggaaggctgaaaactcaaggtaataacaaccagccacacttattgagcgcttgtggtatacagtccctgtgcttcatataatgaattccaggttatcagggccaatatccacctctgctgccccagcttcatccagcaattaaagggtccatgtctgtcctgtcaggggtctcctggactctagtccttcacatagtccatgaccagcatctgttctgatgttcagtgaccacgtcacatgttttcaagtattttaacattcacccttgcatgtgatcatccacaacaacttggaaataagctctagcattgaggtgaatctggctgggcttctgggttgggtgaggacttggagaacctttctatctagctaaaggattgtaaatgcaccaatcagtgctctgtgtctggctaaaggtttgtaaatgcaccaatcagcactctgtaaaaacggaccaatcagcactctgtaaaatggaccaatcagcactctgtaaaacggaccaatcagcactctgtaaaatggaccaatcagcaggatgtgggtggagccaaaaaagagaataaaagcaggccaaccccccagccaacccgtttgggtctgcttgtgccctgcagaagctttgttccttccccctttgcaatgaattttcctgctgctggctttttaggtctgcactacctttatgagctgtaacactcattctgcagtttcactcctgaagccagcgagaccatgaagcaaccccaaggaaaacaactccagacatgccacctttaagagctgtaacagtcattgccaaggtctgcagcttcacccctggagtcattaagatcgtgaacccatcagaatgaagaaactccggacacatctgaaaatcttaaggaacaaactatggacacaccatctgtaagaactgtaacactcaccaggtgggtccatgttttcatttttgaagtcagcgagaccaagaacccaccagaagaaaccgattctagacgcagtactgttctaggatcaaggtgtggaaaatgtgtttttagaggggtaaggttacctgctcaacgcggcacagaattcataattctggacacagaattcaaaccccggcttgacccccagagcttacatggtggctgctggggactctcccactagcatgtaggagacctttgaggatatattctggggggatttggggattgtgtatgctgataatgggacggctcactgattaggatgcagaggagcagggggaaaggagcagaaaggggccagtttatgcagtcttcaatcagcgtttttctctaggtcaggtgcagtcaaccagacacggcccatgggctcaaggagctgactgtctaatagagaccgacagttgcataaaacagacatgtctagagaggagggtttttagggcctggcactggagggcagcttcaccagcatcccagagagcaggactagaaagggaccccacagccagctgacttcatcccagaagtccccaatgtcaggagccacagtgggttccaggagctcctcaccaagttgaggcctggacctgagcaggggagatcagctgttccccacactgcccttgtggctacgatgcggtacccacatggggtactttccatgcggcacccatgtgaggtgcccaccatgcagtacccacatgaggtattcttctagctcaccctgcccactgcagagcatggcagtgcccacacccggtggctctcgccccaggacagctggccttgtgatagatgccattctcaaaccatctgctggttggaagctggtgtgcctgcattcacacagcgcactcaagtcaaggtcagtctcaactcttcactgtcctggacactgtcattctcccagcatttgtgaggggaagagatcctctctgcttcctttgagttcccttccctcttccctaaccctcacttctaggagaatgacttccccatgttactgtatgtgcccacagttgctaggcagatgctctaactgaagtcaggttgattggaagccactgcttgagcctgcaatgatggggcaggggtggtgaaggggcctggtagatccagagtctcacaggactaactccacagcatccaccaccagaagcagcccttcccaagtccccactcccagatctctgctgacctctagagggtccagccatcacagcacaggctctggccacccgcccccgccaatccccgtcgtgcctgattccgtactgggcaacgcacactgtcaaggctgtcttgttggacgcaaaaattagagaatgttgcagtacttcatcttccagtctcaaaaaaaaaaaaaaaaacttatcatccgaatcctcccaatcttcccaaactgaactcttcattcacaccacacaatgaaggtcagtttcaaggtggtaaagtgaagtaagcatcaatcggacattgctacattaaaaataatttttttgccttcctaaaagtcatctaatctttccctctctagactacaaaaggacttagtagctcacgtgccatctgactttttccggagtatggcaattaactcaggagctttttcgttctccttttttttccctgtatcagtccaacctaactggtttgccactaattactttttcctacacagatacgtgttcatcatgtcctcacctgtctcaagataataagctttgaagacacatcatcctttcaacccagtcatacagttgagaagttcacacaagaagttaccttcctttctctgtgaagggacaaattgcctcaactctcatgcaaggaccgccctccccccaaccttcgtctgtcttgtagtgagcctctgggactcccatgggggaaggggcacccagcacagccctcacagcgtggttgggtcacgattcatgcttatttatttgcctgacaactgctcaggagatgaagaaaaaaatgggataaaagcatattcttcaacctcgttgagctgtgggatgaaatatctattttgcaaataatgattccaggtaggagggcagtgaggaatggggctcatgagaagcgagtgttttattacacaatttctaaaatatgagcacttcatgctctttcattatcgtacattattacagttctataaaaatcatttctaggaaatcaatcccaacgtttcaaagccttccaaaaagagctgggaggcagagtttagaagaagcctgtaaatagagaaattatactttcagctttatgtaataagatttactatggcactgtccacactcagacctagtcaaccctgcatgaggaatgcagtgactagggatttatagagttcctccctggccacaatttcaaaagacagcaacatttttgactgacctggaaaaaagtcagatggcacgtcagctactaagtctttttgtagtcaatactagagagggaacgatgaggtgacttttaggaaggcaaaaaaaaaaaaattaatgtaacaatgtccaattttgaacattttccaggtgcgaagacagaggcccagatagtgtgagtgaaattacttttagtgaaagccagtgaggcagtgataaatccgtttctatttacagttgtacgatttctccacctggtgcatagtgggtttggggagcgtctccactccaccctcatccgtctctagtattttccccccccttctttggaatccaggttttcgttccaggaagtgcattaacttgcgggataatttgctgatcacactggtacagaaaccattgagaggctttagactcctactcatagggatcaagacctggagacaaaggagtcaagggaagccccatggcctaaccacagccctaggaatatccccaatgcctaaggaaacccattcaatccatctaagcttcaaagtgtcaccaaactgaggaaaagccagtggagttagtccataagtccactttgaatggtgatgatgccttcatagctacaagcatttcacgtacctctcctcactttatcttcataaaacattcattgaaagattgaaaggatagtcctagcacagcacttctcaaactctaatgtgaacaggcatcccctgtaaatgtgttaaaatacaaattctgactcaataggtctgaaggggtggtcgggggactgaggcttcatggttctaaaaagcccccaggtgatgtcgattctgctgctctgaggaccatacttggaatagcaaaggcttagagcacaatttggaaaccacagttctaaggattgaaaaggcagtagcaatgagtagctcaccagcctgggctcaagtgggatgttaaccagatgatatttcctgcattactattttattaacacctgacagaattgaagagctataccgcatgggggaaagatctctggagaacattttctgatggagaccaggaaaggagtgaaacaagatttactcacgagagaagcgggccagtggtctggcattcttgtctccagcttcatttgcaactagaaaaaaaaaagaggatgcaatttaaataaataaagcaatgtgtccaccaaatatgccccaatacagccaatcccctggatgctttgacatcgggctgtatttaagagtctttgtaagtgaataaaagcaactttactccctccgtgtctgtatttccaaggctgccctcaacacctaaatgaagtcaaatgtctcaatcattttgattagaatatttggatgaagctagagaggatctcaacaacatccagtttagtaggcctaaagaagttaattggcttacatccacttagtaagaggcacacacaccagcttccaagctagtggacgtcctttggccccaagagtcctctaacagtgctgtctgtcaacatgcaaatgcaccccaagcatcgaaatgaatctggtttcctaggatccataggggcaaagctgaggcaggaatttcggaagataaataaaaagctggctttatgttcagaaagatattaaatttagatgctaacaaacagggaagttcattaatagaattgttcagaaaactgccctagaaaccttacccctaaagcttctcagcagggcaggctacctcctacgaaaagtctccatataacttatcattggatagagtcatatttaatgtcccttataacttatgaacccattgtattgggtaaaagagattggttgttaaggggaaacacaggtttcactcattttaaataccatgtttcatgcccataaacattataccttggttgttgtatgtatacatagcagacagacatgggtatttgtgatctacttggataaatgcctaaagcaatcaacaagaaacacctgttcattctagctgagaaaaaagcattcaatgcatcaacagaataaaggagattgctaacgtcatcatgaatgtatgagaagttgcagcaaaaggacaaaaccaatacagtaactactttctaaacttattatatcgttttacaaagaatgaaagaagtcgaaaaatttattccaccctctcacaaaggtaagtattttaaaatttactgcatttgagcaattttttaaaaattaatggattccatctcagtatattttgtttttctggcattagctttgcctcaccatctacactctattactaataaggccaattactaatttgggcaatttgtctattactaatttgggcaatttttaaaaattaataaattacatcttagtatcttttgtttttctgggtattagctttgctttatcatctgcactcttactatatattactatatataagatgttatataaaaatgaccagcagggggaggcaataattcatccagctcccatcgtctgtcacaccgcagcatttcaaaaaaagaaagaaatgggcctggcgcgggtggctcacgcctgtagtccggcactttgggaggtcgaggcggtcgggtcacgaggtcaggagaccagcctgcccaagatggtgaaaccccatctctactaaaaatacgaaaaattagccgggcgtggtggtgggcgcctgtaatcccagctactcgggaggctgaggcaggagaatcaattgaacctgggaggtggaagttgcagtgagtcgagattgtgccactacactcctgcctgggagacaaaagcgaaactctatctcaaaaaataaaaagaaagaaattaaataattactacactctgcaccaaatacattttaaaagaaaagatttccatttcaaaaaaaagatctagaagttctaagaacaatggctattcttgctgtcttctaaaatgttttgtagaaccaccacatgaatataaataattcacattcatattcctgcctccactcagagctacatccaaagtatttcagaacaatggtcaactatctcagtagaagtctttaaccacaactgcatatcctcacatcaggaaaatttggatgttatcatagctaagtattaaaaaaatcttatgagcacttggaaagctctcaagagttgtctataaccaaagttatcttataataaaaaaaaaggggggggtaagaaaagagagaggggagggagggacggaggaagaacaaatgagtcccagttaggtatagacatgaatttccatggccttgagttcaacttatttcttccatttagacaccgcaaatgtctgaagaaagaaatagagctgggtggggcatagtggctcacacctgtaatcccggcactgtgggaggctgaggcaggaggaacacttgagctcccgagtttgagaccagcctgggcaacatagtgagaccctgtctccacaaaaaaagttttaacaacttagccgggtgtggtggagcatgcctgtaatgccagctactcgggaagctgcagcagaaggatcacttgagcccaggaggttgaggctgcagtgagctgtgatcaaaccactgcactccagcctgggcaacagaacgagaacctatctcaaaaaaaaaaaaaaaaaaaagaaagaaagaaaaaagaaaaagaaatagatccagggttttaccaaaacctttgctgcagaaactttaaaatgacattttaaaatgggattacaaagaccattgcaattgctgagaacacaggcaaccacctaaatgctcagcttggagtgtgcacattctccaagagtgtgcacattcctccaagaataaaagaacagagacaccaatgtcactatttcacacgcagcaatagccacatcttcactcagccgggccctccctgcccaccaccctatccaaggatgggaattgctgacccagatccaagtcacgccaggaaaggcaagaatcaggatccagaccagtgggacaccaggagagtttcctctatccagaaggaatttgaacctcgccaccagcgtgatttccctacaaacatacccaatgccacactccactactagagggtctcccgtgatgctgtagcccctacagaacacaatccagctcacctgcaccaacttattctcccacctcatttcccagagcatactccagcactcggtcacatgcgctagatggacaatcccacacacgcccttcacacactcttcctgcctggctctggctcctgctgcctgctagccttggtgtactcctccctcatcttcacctggccaactccttactcatcctttaagatccaggtggagccattcacttctgaaaagcctcctcgcctcacaccccaccttctccatcccccagatctttgcccatatgcgtaactccccttcccacacctgcctgttgttctcaaacttcagcaggcatcagaaccaccgagcaggtttcttagaatacagtttctaatttgatgcatctggtgtgaggcccaagaatttacatgtctgacaagctcccaggtgatatggtgggtgctggtctggggatcataaaagctaccccacccaaggcaaggatcatcactttttatcattgtaatttccattcttttgtacagtgactatgcattcagtcaatatttttggaactcaagtagactgaatgccacaaacagcttagtagaccagacatctcagactgccttccagatgactataggaagccccaggtgtgttttgtttggtctcactatgctttcaatttttaaacaattgtcagcccacatttaaaaaccaagagatttcaaatagaaatacatattactggcttccttcaaattactggggcgattggaacacaaggcccccgtcccacatgacagccatggatcaacactgagatggtccctcggtggctctgcctcctggatattcagaatgcaactctatgctgactattgttggactatacactctgcatggtctagaaggcaggtgaaaacagaacctcttaaagggcttaaagactgaaactaaaattcaacagatgctagcactacaaaaagtgctgtcgcccggctcgtcaagcccttctgtccccagtgcacaactgcccagatgcgtgtgacagtccaacagcacgctgcaggcctgttcggacacacccaggcttctccactggcacaggagccctcaaacactgctgcttgccttgcatgtttaaaagtatacagcaagctttcacaatacagtagatgttccgtttatcaggtgcaattagagcttaaatgtggtgagatcttataagaatgattatgtaggtttatggaaagttatctatgccatactgctcacaaaacacagattctagttcagaatgcataaggattctattgacgttcagttgcgtgtctaggctacatgtgtatataggcacagagggatgagtagaagtgtggtcaccagatatattaacagttatttctcctgtgtggtggcatttgagaaaatctgtaacttttgaaatacttttctgcataaactcaatagtttatgataatcaggaaaaaatgtttttattagagggtataaaacaattggctattgctctctttcaaaatatacatattattttggatatgtttgtatatatatgtacatgtgtatgtatatgtgtgtatgtaaaaaactttttatacatacacaggtataaatgtttatactatttttatacatacacggacacatatatacattttatacacaagtatatatgtaaaaaacatgtatatatatatataaaatatgttttagattctgatttaagggtagtcctggatcacagaattcaaggcacctgccatctctagtccaagagggctccttgtaagactcaagaaatgcatctcttacccctctctccagggatcccacacattttaggtcagtggtttccagccctggacacacattggaatcacctagggaatgttacaaaatattgatgcccagaccacaccccagaccaattacacagggcctctaggggtaggactcaagcatcagtgttttttaagcccctgatcccagtgagcagccgaagttgagaagcactaataaatggtgcaactccgtacatctttaccaaaggcaggaggacatggctttgattccttcaaaaataattacccctattcacttcttcttttcaggatgctgttgctttgtcaaaatcctgaatcgagcgaggtatatctctgctttaagaaaacttcaaccattaagatgcaaacctaactatggagacctattagtgggcaactctttgcattgtaaacggttctttataaaaggattcacctcacattgcctctatccttcagcatatgtggattgagcaccacctgggcgctgggcagtgaactagactcaaggagggttgcaacaatggattccacccaacctggacatacaagcaagtaagggaggcaaactgtgcctgtcaatctgggtttatccaagtgtgatcagctagggaagtgacttgatgatgatgatgatgatgatgatgcaggttccttggtcctgtggcagatccactgggtcagaatccctgcaagtgaggacaggaccctaggttgtaaaccaggggtccccaacccctgggccacagaaccgagcagcccatggcctgttaggaaccaagcagcacagcaggaggtgtgcagcggggaccgagcatcaccacctgagctctactccctatcagatcaatggcggcattagattctcataggagcatgaaccctattttgaactgtgcatgtgagggatctaggctgcatgtgccttatgatcatctgaggtagaacagtttcatcctgaaaccattccccccaacacccgttttgtagaaaaaatgtcttccatgaaaccggtccctggtgccataaaggttgagaaccactgttttaaacaattgctccagaagccacttgggtacactaatgtctgagaagcagcaatataaaggacatgttcccctggtgtgtttgctgtaggttttccctcccaaaaattggccagaaacaaatctcagagtaagtagttgccatggagaccaatgggagggaggcaggtgagacaggaagataacttggagcaatgagcatcctaaccccagaccacccagggggctctgatgtcacagctacgacacaaacaatacaggccatcagaaaggacaaaggagaataaaggggaagctaaggtgggccaacccgttgtggtggtggcctagaaaggtgcacactgctttgtaaccagaacaagcacccaaaacactgccacccctgttttgaaagccctggcacctgggtgagcataaacacagctggagtcctgggtgccagggcaaacacacagtgagcagcagacccagagcagagcttggcttcctgcaaggaaatctgcccagtgcactggttggctgctgctttgccacagccctgggtctggctcaagcatcttatccaagtgaactcttttgggaaggctggtggctgcaatgccaggcaacacagactcccaaagaagagaacattggaatgaggttccaggcactttcactagtgactatagaaggtgaagcttggaattaccaggtgtttgacctcaccttgtcttaccttcaacttgcaaagacccaagcaatagcagagaaaacaagaaggaatgctggggggaaggagacttggtgcaaaatcatcattaactatcctagctcagatatcgtcttctaggtaggaccttccatgaccacccattaagaccacaggtcccaactgcccccttcctctagtccccatccccctatcctagtttaatcctcgctacagcacttatcaccttctcatatgctctatacttcagtgggtttattgcctttctccttccatgacaatgtaagctccacacaagcatagattctctgccaatgaaaaagctgctatctccccagtgcccaagtgcctggcatacaatatttatggactgaattaatgacaagcctcctagcaatctaccattcagaacgtgatggagccaaggatattggaaggagacacaaaaaggaaggtgcaaggatatcacatcccttgaacactctgaatatccattcagatcttcaaaaaccaggcactgaataaatcatagataccaaataaatctgcaaacatccagtcatggtccctgccttcacattgaataagactgtccttgagtgcagaaagactggctaatttttttcaaggccacacaggttttttatggccaaaccctatgtaaacccaggagtatctagtgccaaagtccatgcctcttccacctttgtctctttgccttccaaggaggggagaccggtaggaaccatgctccagagagggctgcaccgagagaagagccaggctgcagcctttatgcctctagccccagtgggaggagggtaccagcctgcaggcaatgggggcggtcacccgcctggcccctggtactaggcataaggccaggagactgtcaggagagagaggctctttgttgaggtgggcaaagaggccagaactcacagcaataggatccagtagagggagaagctactgacaaagggaggagcttcattgccacattcattcaagagccccaaggtgtctccctaaccctattaagcctcccataggtagaaaatagcaacaaggaaatagaatctagaatcaaatgcatctcagtatgaaccagtacaactcacaaaaacagcccctatgaggcaaatcgtattctctttaacaggtgaggaaagtgacattccaagagattaggtagcttgtccaaaaacagaccaaggcaaagcagtagagtgagaaatgtcatccattccttccagctctgagtccagcattctcagagaagggatgtgccccatctgtttaattgttgcgtgaggatcaatagtaaagcaaaaggcttgacttcctttgcccccatgtggtttgataaatgttgatgcttgacaagcctgggatctgtttcaagcttaaaatgtataaatgcatatctctggcgatggctgaatcgtgtgctgtgttgagaagtcttctgatgccaagactgagcttagcaagatgtgtttgtgacacatgaccaaagcctgccatggttggggttgggggaaaatgaagggaggaggtaggatgggtaaatgggaaaacccagccaggttaaatggaacataaaagaatgtggccatgaaatggataattcacaaaggtaactgacttcattcaacacatagaacatattatcccagttgcttaaaatgagaaatgctatataatacaataacttcatacacccaggagccatccaaacagactgggcatttccagaaggctgtcctctaaaccagacttagccatgcctttcacaaggctgtggtcttgttaaaatgcacattaattgcctgggatgaaataacttgcagtggtaggtccagacatagaagatgggactaccttatttcagaggcagtgcccttcacctcgtgctacccatcacattttcaacatccaaatgttactaccacaccaccagcctcattgccatgaaatccagtcccttgtctcccctccacttagcatcaagtcagaagcctgctccttacgggaacagatctcagcaatccagttgaaatttgtgccccagagccataaaaggcatcacaacccccactctgttcctttcccacttctttattcagaaatgctcagcattgcctcattatgccttccgggccaatttggctgtcaaatccactctgaatcaggcacttgcacaaaagaaaataaaactaatttgtagttgatgatgcatcagggctgataatttgaaagtggcagggatggtgcactttccagacccttctctcctagagtaatgggcaaatccttacagagggcaaggctcacctgccagagggcaggatggctccctggctcgtgcagcccagggtatcacacagacagagggaaaatccaagaggcctttaccaagctgagaagacagcttgaaaaacacatatcctgtactttttcttttagtttggaagaatttgagtcatatgtagaggctcaagcaatctatttcttccctggacctaatttcataagtttgcttatttatctacactctatctcatttcacaatttgtattttatgttttgctctatgctcctatcctttatgcaacaaagtgagatgttaatgaaaattgaaatttacttatttcaatcaattccttgctccctttccctgatcccgctttccaaacttccagatttcaggttgactctacagggccctccattacaccaagatcaaacaatcaattgccatctgtttagtctccctcccatctgttgggctccctcctcacagagctgtgctggatgtgacaatggatgtaacctcatcctcaggtagccaggaatccagctgagacccaaaggcctggccccgagcttcctggtacatatcattcaacttgttgccatatgaatttatcaaggtgtttggtgtttctgtggaaatcatcaggccaagctaccaggccctgacttcaggaaacttgagatctcattgtggaaacataattttcatgcatgagatgacccaagctctgttgaatgctagacaaagggtcctttgtggcctggagtgactagtagtgagaggtttcctggaagacgaggacaggtgagattagagaggtggagaggatgatggagtctgcccagggagaggaaaggggtgtggtgcattctaggacctgggagcagactgagatgcatcaattattcataaatatttccctttcatagcaagaaaagtttttttattggaggaggggagtagtaaaacgccatgaaaggctagcactcagatctttctatctgccttcttccctacttccatatacaaatatgttgcatctgcagatagggatgtgactttatctaagagcagatgtgtctgaacatgctctaaattcaggtgctgggacaccagtccagtgccagcaatcgctccaaagcactgccgcctgacttggatgtgaattcttccttgtggtgatgtcctgggtggcccagtccagccctcctggttgataccctggtggccaccataagcatcaggctgcaggactgctggctcgcatggggccccctgcaatcctggcctcactataacaacccagctgagcaaaccaggcaaagccaatcactagcagttaacatgaatcaaaagtgttgagacagaaatacaatattgatatggtttggctgtgtccctacccaaatctcatcttgagttgcagcttccataattcctatgtgttgtgggagggacccagtgggagataactgaatcatggggacagttttccccatactgttctcatggtagtgaataagtctcacgagatctgatgattttacaaggggtttcccctttcacttggctctcattctctcttatctgccaccatgtgagtcatgtcttttgccttccaccatgattgtagcctccccagccacatggaactgtgagtcccttaaacctctttttttttttaaataaattacccagtcttgggtatgtctttatcagcagtgtgaaaacagactaatacaaacatcaagctggttgctcaagctgtcaactaattacagtccaccctggacaaggcaaagaaaagtatacagaagaggtggagggacactcaaatttattaagccccttcctcatgccaggcaccagtaggaactttatgcccataatttttattcaattttcacactgttccaggaggtaagtagtagtattccctttttcagatgaggaaggtgaaatttaggaaaagttaagtcactttcccaaatcaacactgagaagtgggaaagctgggattgaaacccagtctgtgagcccctttcttctcttttctctacagctcacaccatcagaaagcacattaagaaccctctggtccagccgggcatggtggctcacgcctgtgatcccagcactttgggaggccgaggcgggcggatcacgaggtcaggagatcgagaccatcctggctaacacagtgaaaccccgcctctactaaaaaaatataaaaaaaatagctgggcatggtggcaggtgcctgtagtcccagctactcgggaggctgaggcaggagaatggcgtgaacccaggaggtggagcttgcagtgagccgcgatcgcaccactgcactccagcctgggcgacagagcgagactccatctcaaaaaaacaaaaacaaaaacaaaatcctctggtccaattccacatatcatgcatggatcccctacaacatcccaaacaagtgggcctccagctcatgcctgaactgtctctagggatgggagcaccttccttctggaggcaggaagcagttctccaaaagaaaggaagctcttcttcgtaatgatgccatccttccagaggtcttcatgctgcccctcacagaataggcctggctccctttcctcctgagggcccttccaacatttgaggacaactgtcatgaactcagacccttgagccttctcttctccaaactgacaagcccagatccctcctcctgtgacaaaaatgccccaaggcctttacccacaaaagcaaagttacttaagtcattgccgaaagaagagaatatttgtattttaaataagcctcagcaacacattcttcaaccccactcattcccacagtgatcttcaggctgagtcaaatttccatctccctccatcaagcccctttcttgtttgattcttgggagaagtggaaggcacctaggagccattttcagcatcatacgccccacagccatccaaacaggctgggagtttccaggaggctgtcatctaaatcagctcatctcagacatggccatgcctttgacaagcccgtggtcttgttaaactgcagattcattttcagatgctctggaccaggacctgagagtctgcatttcgaacaaactctcaggtgatggctctggtccaggtaccatactttgagtagctcagtgctaaaggacataacccgcattgaaaaggaaaagccaagtacatgttctaagagctcattggaaagccatggatggttgtgaaaatgcatgctatggaatttaatgctcaattctcttggtttttcttcagcaatgtttttttgagaaaaataactgttaacatcacgactttttaaacctgcctaaggagagatgttgatactgtgtaagtgtgagaaggcatatccaatgcagagggtgatggagagaaactcacccctctcaactggcattcaacagagcagagctgagctagatcactacccacctgggcaagctgccagcaaagcacaaagctcaaaatgtatcaggagatgctcagatctgagataggaaatcaaccttacagccacaacttcacttgaggtgctcctatctgagataggaaatcaaccttacagccacaacttcacttgaggtgctcaaaggcagtactttgagctcatgagatctagcatgtatatacacgcacacacacaaatgcacatatgcacacacatacacactcatgcacacaaacacacctccccaacatcagatcaggcatgcactgtcagcactgtgatgtccaggagcataaatcatcgcatcgttaccaactggcttcaggctgaacagatcaaaatgcatcaaataaacgaaatgaggcacaggacattcccttgggcattttgggcaaggaacttagatgttcactagactgagctgccctcagcagagctacacctttgcatactgtttcccccagactagcacagggcctggcacacttgagctgctcgataaagggccagtcctgaagtcacagaggtcctggaatggagatggaccatgctgctaggaactgtcctcctctgtccagaagccaaagagcctttctaccaaccagttaaggacttgatgttagcttggcatcttatcttctaagccagttggaagttggggacaatttgggggttacaaactggaggcaggtgtgtctggcttgacaagcatagcatttaagaataatctgtctgaatttggcagggactagttctccagggtcgcatgaatgcccattgctaacaccagacctgcttcattccagctgcttcccagagatcttcacacagatgtgcattaggactctaacatcaaacatatcaaagcagaactgtctgtttctcccagaaatctgctcttccccagatttcaccatctcagtaaatggaaccactttccccctactcgcccctccccacaaaattcatcaggacaaaaatgtgacagtacccttgtttctattctttctgtcatactcatagcccttgcatcagtaaatcgtgcgggcttcacttttaaaatagatcctaaactcctaccactccttccagcttctcccctgaaattgacccaagcatgcaaggcccctcacttagaggttccctcagactgcggcacctccctgtgcaaagccctcagtgtttctcctagtgttcaaatcactgcctccaaatcccttcctgtccagagttcatcttctcctctcatctgctcattaactaagctctcaaatctgccaaatgtattcccatttcacttgtttttcaagcctagaatgctatgctgctggtactaagggtccagttgtagtggccaccctgacagaccgttccacgtgcacttacatgtgcaaactcatgcagtctttgtaacagggctttgtaacggggaggcagagctattgttatccccactttactcatgaggcaactgaggcacagggaagttaggtgacccaccaaggccatatagcaagtaaatggccctatccagggcctcactgaatcactgccactctgccccttacagagctcatcgcttgcacagctgccttctcaccttacaggattcagctgaaacatcatgtcccctggtacttctctgaccatcccgtctcaagcacctatcaatatctagaattagcctatttactcatgtgcttacatatttctccatcacaaacacagacacaaaaggatataagctccctgaaggcagcccccagcagcctcattctctgtaccctcagaaccagaatagtgcctggcacaagcccccctcatcaaatattaaccaacctattgcctattttatattagcacctgggtcctgcgggtgcttgagtctccatcctccgtcttgtcctatcctgtaacattccataggctcccggcagcttcctctacagggcagagtccacgcccggatgacaaaacgctgcacaatgtggcccagccatccctctggccttgtccccactcctccctcccagcacacacctgcacatcagctgtcctgagctgctccacctgcggccttctcagatgaactagtccctctctgcaggctcctatcccttggcaccagttctctacaatgaggaatgtaaagatggcaggcttggccgggcacagtggctcacacctgtaatcctagcactttgggaggccgaggtgggtggatcacctgaggtcaggagttcgagaccatcctggccaacatggtgaaaccccatctctactaaaattacaaaaattagctgggcgtgatggcacatgcctgtaatcccagctactcaggaggctgaggcaggaggatcgcttgaactcaggaggtggaggttacagtgagctgagatcgcaccactgtgctccagcctgggcgacagtgagactccatctcaaaaaaaaaaaagactgcaggctttagagtcaggcagacctaacttggaatcctgactcctctgccatcttaccaaacctctctgagtcactttccttgtaggtaaaaatgtcacaatactcactcctcggggttgtcaggatgagggataaaatatgtaaaacacttacaacggtcttggcacatgaccatgatgagctgctcagtaagaggtagatggtggtggtggtattatttgtttaaggtctatttgtattaaagaaacatgtgtagagacacttccttaacattgtttgcatcttcactgagcacgtgtgcgacacataaatctcaataaacatctactgcagaaatgggtaaggatgtccttggaagctgcttccagatgcctctagcatcccaggaagcccaaaccctgctctggtcctttcattttgctattaacaagggaaaaacaattggaaaatggataaaattgcatgttcagcacctttgatcttacgttagaagaaaaataacctaaaaaaaatgggggcaggaaaaacccagctatggtctctggaaggggatgggagaaggaaggctggcaatgaagagatcccccaggaacttgggcatctgattggaccttcaggaatcacctttcttatttaaaaaaaaaaaaaagactattaaaatatacgactaagtatttgtgagtcggaaagaaatgaagcattatgggcaaacctatcgttgtcagttttcaaagaaggcagtttctcatcacatactggcaacctggctggatttgttaaacttccacagtgtcccctctaagacactgaatgacgttaaggggtggtgaggcagcctgtgcttttggaatgcccattataaaccttcatggacgcacctgattggtttttcttttcgtctccctttgtataagtttctacacaggttcatttttattccaaagcattcaacatgcacacacacacacacaaactcacaaacacactcacacatacacacacactcacagcccctaactgcctggagaaccatagcagttttcattttctgtttcacaaggctttctgctgctgagcttagaatccactcgctaaggattccaatacatgagaagtccagggcactcagagacaggaagcttgtaggggttcttgtgttaggtgggagattggaacaagaccctgaggaaattaaatttaagctcacaacgagaattcaaaaatatactgcccttgagtgtccaaggggaactacattccctcggctcatcttcatgcacagccttgagaaaggaaaaaccaaggaggtgcacagccaatggaaagtgatttttctattcactgtgagcaactgagtgtcagcaaagctgtgttatgaaagttgcttctaggccgggcacggtggttcacacctgtaatcccaacacttttggaggctgaggtgggtggatcacgaggtcaggagatgaagaccatcctggctaacacagtgaaaccctgtctctactaaaaatacaaaaattagccgggcatggtggcacgtgcttgtagtcccagctactcgggaggctgaggcaggagaattgcttgaacccaggagggaggggttgcagtgagccaagttcatgccactgcactccagcctgggcaatatagcgagactccatctcaaaaagaaaaaaaaaggaaagaaagttgcttcaattgtgtaacagaggattttgacgtccattgttgtttgtcatttataacacagagtagtgatggagctctggttttacagtcccagggcctggttttaaagccccgtctctatctgtctggccctgactccctcactcagcctctgtgggcctgagctgcttctcctacaaaacaactgtacggtacctgccctatggatcacacagcattgagaagaaactaaatgaactaacataaactataaggagatgagggcctcaaagggacttcctgacacactgtgaaattttatatctcaactaatacaaagaattttaatgttttaatctcttggacaaacactatgacccctttattcatcttcagggtctgtttttaaacatcataacgggtaatgattagtataatgaggagaaatgcaaccagtaagaagatgaagcgggcctggggtttagatgggctggtcagaggggggcccctgatgaggggctttgagcagagacccacgtgtagtggggatgtccacagaaaagcacagcatggggagagagtggtcagtgcaaaggccctgaggcagagtgtgatggttggagaccatgcccactgcagtgtctagcacgtaggaagcacgcagtatgcaggagccactgtgatcatgagcattgctctcactgctgccgaaacaccgagttaccagtcatgggtgagccaaagccagggaaacccaatatattaatacatcaccaccaatgctagttagggccccttcagacagcagctccccagccaacactgcagctctgggggctctttttatgccgctacagaaaacagccaggtgcggtcaggggccgttaggaacaggcacaggtgggcagcatatttactccacttcatcctcaattgctttcttccttccccacatttgcctcctccctttccccaaacgcaccttctgaggaaaggaggtctctgcccgcagccaaccttgcagtcgcactgctcacatgtgctgagtccctagtgtgtgctcaagtctgggctacgaccgggaaccctgaactgcaacaaggtgagatctttctctctaggggctcacagtttggggagaagttatgggtagagaaaaaaagctgctccaaaataataccagcccagctggagaaggagcagggtggtcatcagctcagggggcacagagaagggaacatcctcagggaagcccaccctataccacccacgacatgatgtcccccgtcatatgttctcattgtacccacttcctttcctctctttcctttctggctcttatgaaaactgtaaatgaatagcgatttaaagtctatctcccctggtagactgtcggccctgtgagccagggggcttgctctctgttgttcacacctgtattcctagcacctaacacatggctagaacatggcaggggcactgaaagacaccataaataaatgaaggttgctgaacaacacagcacttcattctgttggggaagtgtgacatctgcctctaagatggctcccaataagccgcctgctagaatccaaaccctatgtgcactcttcccacactgaatcaggaaggaccaatgtcaccaacaaaatactgtaaaatgatgatgtatgacttccaaggcttggaaaatgtccaaggctcataagaaacattgctactcccaccttgctctctcttagatcaattactctagtggggagaccaggcagccatgctataaagacatgcaagcagccctggggaggggtgcatctggggaagaacagaggcctcctgccaaaagccaacatcaatttgcccatcatttgaataagtcatattggaagcagggccaccagccccagtcaagccttcagatgactgcagccctggctgatatctcaaatgtgatctcatgagagactccaagccaaaatcacccagccacgctgctcccagattcctgcctcacaggcatatgtgagataacacctctctactgtcattttaagctgctaggcttcaaggtagtttgttactcagcaatagataactaatacaagaagagactagagaaccttcagagaaccaaactttgaagaacaaaaaggatttcaccaggcccagagacacatgcgttgtgtttcttacagaggtaatgaaacaaggaaactgcataggggattgtgtgctcaagaaatgggagagcaactcaggtggctggagcacaaggtaccaggaatgccattgaaagaggaggttggacctgggacctgcatagtccttgaatattattctaaaggatctgggctctttagaggtgggaataattatttccatcttacaaatgagacaactaaagcttagaaagtttaaggaatttgtccgagggcacccagctactaagtggcagtcctgaaattcaaatgcaggatgaattgacaccagagctggtgctctttccagcacctttgtgtccaagaagctccatggctcctcagaaaggggcctcaaaggctcagaaaacttccaatccccagtcacttccaacttccaaagacttcccacagcccgacccgatgggtgatccagtgcttctgccctgcctgctgcatagagcaaggtgacataacagcctgtgtcctcctggcctacccatgtggaggactccccagggtcaccttcttccagggaggaactcctcacagcccaagacactcttcctttctagccccagctctcctgggcctccccactgcctcacaaccatgatgccactctgcacccccaggtgattaactctgtccttggggggctctcccttccctcctgcagggcaggcaaaggcagcattccaaggcagcttggaatgacctcctgagacagcagcagaagctggagcaagctgacaggatgtgcttcccacccccaagccccactctaatgaggacattagactaccacctgctgctgttttgtaagggagaggtgctttgggccctgaagagcacacctagaaaaagagaaaggaaattcacatttcagagcaacttctctatatgagtcctgggctttttccacattatttctatcctcaccacgaccctgtgaggtaggcattactattctcttttaccaggtgagtaaacaggggtccaaagaagttaatttgcccaaggtcatggacaactgttgtgtacagccaggcaggttgtgcactgcacaagtctagggagcacttgtcacatcatagtcaacagatttatatatgtattgtgaaaattttgcaacagaaagtgacttcagtaggggcaccttttcctatttgcacaaaggaacatttgggtcgcattgattctgtgggagtaccctgttggtcagtggcgatttgaccccatgtctggttgactctaaagccctttctttttccactagacctttatacgtctcttgggataatttcaagcatgttcatatcaagttcttcagaggtgaactgacagtgatagaatcacaggcatctagaccatcccagctggaaaagatgttggcaatctgtaatctacctcaaaactttccctttgcattggaagaatacaggcccaaagagggaaagtgagttgctcaaggtcacacagctggaggtggcacagctgggacctgcatcttgtgcaactgaaggcaggtcagcctggctataaagtcattctaattataaccataaatggaatctaacaagagctaacaagaatctaacaagagctagattatgtaggctagtggtctcaactttcttttgcagcagaatcactttttcgattgtgagtggaggcagtgagtgaagggtcacaagagacagtgtccctcacctgacaactttctgaagtccaagcttaaaaacaaaagaggttgaagggaaggagcgggcagctcagaagcctctccggaatagaaaagaacattcctctgtaggcctgtcaggtcctgggagggaaaacgtcatcaagtgaaagcttctaagccctcccatgtggctctcaaggcaatcgtcatccaccttgaagggaggactcagcccctgcacaagccttcctggctcccatggagcgtctgaaaaccatagtgatggcccccaagtggcaactcagttctgtctgggctcacgccaaggtgataggagccaagggaggaaaaacacagggaggaaatcgagcacttaatttgctcttccttggaagatgccaattaaaatgcttctgtctgagaagaatgcccgttcagcccctactcctactgggctgcctcattaacagccccttccagactccccaaggtgcagcttcctttccagaaaatgaagcccaagtatgcccaagttagaagccttaagaccctctagaatcacagtaaccaccacccccactcccgccaacaaacactggagctcagggaggcagggagacctacctgcctgaaatcactcaactgatccttcttggctcagtggcagtcatgagatgaaattttaggtgcattgaatgaaaacggtcactctagcctcacatgaacccagagtccaccccttttcctgcttgagtcactgatacagaccctatctacagctggttaggagccatggaggtagaagacccaggatgctggcctctcagggctccacaactcacacaacccaggggagcaatgactactgagctccctgaaaactgatgcctgacaaagctttagagtaagtcatagaataagggtctaattagtcaccaacagatctctgtgcaactatcttttcttctggtactcttccattataattggagtccaatttttataaagtagaaagaccagcttaccaccccacaggagctaagtaaatcttaaagcatgtggggataattatttaaatgagaaacaccctgaaagaaggtctgggaaaatttaaccttttcatgatattactaatgagtttagtcccattttgcaagtgaacaagatgaatgtgcaacatttggtcataacatagaagtcactctcagtcaaaatattatccagaacacaaaagaaattatgaaaatcacacccaatccaaaaccatacaacagagagttcactggttcaaaggatttgcaatagtgttctgggaagatgttcaccagcttagagtaactgagagcacaggatagaatgccaacataaatacacacacacacgcgcacgtgcacacacacctttacacatgttaacagtatatagaaaactatggacaactatatgtcaataaatgtaaaaatagttgaaatggataaattcctagaaaaaatttaacatcaaaacagattcaaaaagagatggaaatactatctgaatagaccttataccactaaagaaattaaatctgtaataaaacatttatccaccaaaggaaaaaggatacaagaaaacacccaatccagatagttttacaatcaagttctattaaacattcaaggtacagatcaatcaaaacacacaaactgcaccagagaaaaactgctctccaacactgaaaaggacaacacatgaaagaaaaattgtagatcaattctgagtacagttgaaataatattaaataaaatgttagcaagctgaatgtaacaatgtattctttattatatggcttacacaaattacgcttgtcacagaagtgtaagaataatattagagaatccattaatcttatgttatcatttagcatgctaagggattattgaagaaaacaaagatatcatcttgtaaatgtaggaagagtctttgaaaatattcaagaaccaatcgtgattaaaacaaataaatatgtgtatacacacacacacacacacacacacacacacacacacacatatatgatgaagtctggttccagataagatgaagtaagcacattccaccctatctctcccactgaatgcagctataaatcctggacagaatgcatggaacacctatttgaggatgctgaaaacaatagtagcagacagattaagggaaaaaaaacagaatttgaagcaccaccaaactagtggcaaattttccattttttcctgtcatgtactctgatctcgtctcaaggcaatccaaatggacatcagcgtgaatgaagagaattctaggtgaatccttccagttatggaacaagattgggaaacagatattctaataggggaaatctcctatatttttttctattgtccattcttttgcaccttagcacctagcagactgcaatcccctaagatactgaaaaaggggtatcttcctctctgaccagagaaacagtggtcccaagatagtggagtaaacccccattgcattttttatctctccgtcctcctgcccagtggcctgaaattcaggcacagtcttggaaaatgagtggcagagacacttaaataaaagctctagctttctggtcagaggtctaaaagcagagcctcagggacccaaaacacatgagggacatggtggaaagggagaaacttgggaaagcaaaccaataaagttacatgaacttctggactcatctgtgagcagcacacaattaaatctgactgtaagcagcataccataggctttatgaactgagctaatggatagacgggtatccatcccagactgactactaagtgacatacttgggacagatctgagtagcacagaaagggctttgaaaacaaatttgacattctaatcacaacccacagaaggctggtcaaaactttcaatccaaactcaactgggtcaactggctgccaaaacaaaaatatcaacattctacataagatttaaacaagagccagagtctcatcagataatttttaatgttcagaataaaattcaaatttactgtgcatattaagaaccagaaaaatcaatcttaacatgcatgggaaaaggcaattaacagacatcaacgttgagatggaacagttgctagaattatatgacaaacactttaaagcagctattatgaaaatactccaaaaaaagaagggcaatcactcttgaaacggatggaaaaatagaaagtctcaatggagtgaaacattataggtgaaagaaaataagagataaaaaatgttcaaataacttaagagtaggcaggaaagggaaacgagaaacaacaaatagagtggacaaacagaaaattaataattaaatagtagacttgaatccaaacattacaataacatgctaaatgtaagtggtttaaatacaccaattaaaagacagaaattgtgagacagactttaaaatgacctaatttatgagggctacaagaaattcatctcaaatattatgctatagaaaatttaaaagtaaatggataagaaaaattataccatgcaaacatcaaccaacagaaagcaggagtggctgtattactatcagacaaagtcaacttcagaataaaggaaagccaccagggataaattaggacattacataataataaaagggtcagttcacaaagaagttaaaacagccttaaatacatacagatataacaacaaagcttcaaaatacaggaagcaaaactaacagaagtgaaagaacagataactccacaattttagctggagacttcaacagttatctctcagtaatcaatagaatgattaaccagaaaattagcaagatgtagaactcaatgccatcaaccaactgaataaatgacatttatagaactttctactcaaaactagcagaacagaacattcatcacgatagactaaatcatgggtcataaaacaaagcctaccaaacttaaaagaaatgaaagtatacaaagtatgttttcctaccaaaatgaaattagacagaaagtcactaatataaagataacatgaaaatctctaatcacttaaaaattaaacaaaacacttataaataatctatcagtcaaagagtaaatatcaggggatattttaagatattttgaactgtctaaaaataaaaatgcaatttatcaaaatttgtgggatgcaactaaagcagtgctttaaaaaaattataacatcaaatattttattaggaaaaaagagttattaaataagtaatatgtgcttaccaaactagaaaaagaaaagaaaattaaacccactggagcagaacccaacgaaatatttaaaagaacaacaaagaaaaccaatcaaaccacaacctgattctttaaaaagatcagtaaaattgatgaacctatggcaaaacctgaagacagcaagacaaagaaaatatgatagaaaacataaattaccaatatcaggaaaaaaataggggctcaacacagaccctgcagacattgaaaagataataaaagaccaccactatgaactgtatgcacataagtttcacaacttacataaaacttagaacaactcctcaggcttcagatttccataactcagttaagatgaaataggtaacataaattattctagaactattaaagtagttgaatttgtagtttaaaactttatgaaaaaaatattccaagtccagatagtttcactgctgaattctagaaaactaaaatctaaagagaagttaacaccaattctacacaatttcttccaggaaacagaagagaagggagactctccaactcattttataggtcatcattactctgataccaaaaccaaacaaagacagcacaaagagaaaaacaaccacaagctaatgtctttcatgtacatagatgtaaatacctaaataaagtgttagcaaattgaatatagcaaaatataaacaaacaggtagggtttatgcttggaatgcaaggatggttcagtattagaaaatcaatcaatgaatttcaccatgttaacagcctaaaaagaaaagccatatgatcatatcagttgatgcagaaaaggcttttgacaaaattaaacatctgttcatgatgaaaactttcagcaaactaggaacagaaaggtgcatccttaccctgataaaggcaatcaacaaaaaacctacagctaaaatcatacttaaagagtgaaagacaatgttttcccttattcccaataagggaattcccaataagggaataaaggaaaatgtccactcaccacacctattcaacatcatattggaagtcctagccagtgcaataaggcaagaaaagagggagaaagtgggggatgaaggaaagaagagagagatagagagaggtcaagcatattagaaagaaaaattaaaactggtcttattcataagttacatgattgtctatgtagaaaatccaaggaatctacaaaaaaaaaactcctagaactaatgagcaagtttagtaaggtcagaggatctaagattaacacacacacaaaaataatttttctatatactaacagtggacaattggaaactaaaatttcaaaaacaataccatttacaatacactccctccccatgaaatacataaacatctagtgaaacatatacaggatttgagtgctgagaactataaaatactgttgaagaaaccaaagaagacataaataaaaggagagacatattgtggtccagggctggaagactcaatatggtaaagacatcaattatccagaaactgacctactgatataacacaattctgatcaacttctaacataaatcttggtaaatatatgcaagctgattttgaaatgtatgtggaatggcaagtgaactaaaatagccaaaatgattttaaagaagaataaagttgtagggctcatactaccttattttaagacttaagctacagtaatcaagacagtatggtattaacaaagggacagacaaataatcaacagaacagaatagaaagtccagaaaaagacttacacaaatatggccaattgatttttgacaattgcaaagcactttaatggaggaagaatagtctgtcccacaaatgatgttggaataattgaacatccatataccaaaaaaaattaacctagacctagacctcatacattataaacaaatcaattcaaaatagatcatagatctaaatataagatataaaatctattttaaaatctttaaagaccacctaaataaatgagagacataccacattcatgtattggaacactcaattcttagtgttcttaatatgacaacaaaagtaagatccataaaagaaaaaaataaactagattgcatcaaaatttaagatgttgctttgcaaaataaactgttaacaggatgaaaagacaagctatagcctgggagaaaatatttgcaaatgacatatatgacaaaatacttgtattcagaatacataaaaaattctcaaaactcaataggaagaaaacattcgcccctaattaaagatggacaaaagatttagacattttacatagaagatacacagtagtcaaaaaaagcacataaaaagatgttaaacatcattatctattaaggaaatgccaattaaaaccaccgtgcgatactactctgtatctcaggctatataggatggctaagattaaaaattttgatgatatcaagtgctggtgacaatactgagcaactggaattctcaactcctgctattaagaatgcaaaatagtacagccactctggaaaacagctttacagtttcttataaagttaaacatccacctaatacaagtttttatcctaaagaaatgaaaatttataatcacacaaaaagctgtacacaaacgtttatggcagctctattcataatcaccaaaaactggaaacaacccaaatgcccttcagtgggtgaatagataaacaaactgtggtacacccatacagtggaatactactactcagccatacaaaggagaaagctactgatacatgcaacatctggaatggatcttgtaggcattattctgagtcaaaaaaaagtcagtctcaaaaggttacatactgcatgaatctattcatgtaatattctttttttttttttttttttttaagatggagtctcgctctgtcgcccaggctggagtgcagtggcgcgatctcggctcactgcaagttctaccacccaggttcacgccattttcctgcctcagcctcctgagtatccgggactataggcgcctaccaccacgcccggctaatttttttgtatttttaatagagacagggtttcacagcgttagctaggatggtctcgatctcctgacctcgtgatccgcccatctcggctattcatgtaatattcttaaaaataataaaattataatgtcagagaacagatctgtagttgccacgggctagggattgggagggagtttgattataaaaggattacacaatggagtttcttttgggtaatggaactactccatactcttactctggtggtacacatatgaatttaaatatgttaaaacttactgaactgtatgccaaaaataattctacattaatttaaaaaataaaatttgaggcaaaaaaaatctcagcaaactaaaaataggagaaaacttctgatcaagagaatctactagacacctaccaagcattcttctaagaggtgaacatgagaattccctttaaggtcaataatgaaataaggatagccactatccgcacttggctctgtgtatatatatatatatatatactttttttttttttttttttttttttagacagagtctcgctcttgttgcccaggctgtagtgcaatggcatgatctcggttcactgcagcctccgcctcctgggttcaagcaattctcctgcctcagcctcctgagtagctgggattacaggcatgtgccaccatgcccggctaattttgtatttttagtagagatggggtttctccatgttggtcaggctggtcttgaactcccgatctcaggtgatccgcccacctcggcctcccaaagtgctgggattgcaggcgtaaaccaccacacctggccaaaggttataagttttacctaggaaatccaagacaatccacagacaaatcattagaattaataagagagttaagcaaagttgctggatctaaggctaataacaaaaatctatattgtgttcctttacaccaccaatgtacaattagaaagtataacttttcaaatgacatcttctacaatggcaatacgaatttataaagtgccaaggaataaatctagctaatgcatcaaaaccattatgaagaaacttataaaattttattaaaagatagtaaagaagatcagatattgatcctcttcatgaataggaagacaacagcataaagatgtcagttctctccaaataaagttatatattttaactaagtgtttgtaaagcatttagaacagtgcttgacatataataagtgagatataactgctgttgaataaataaatcaaaattccaacaaaggtttttcatggaacttgacaagcttgttctaaaatttgtaaggcagaacaatggtccaaatatagccaaagcaatcttgaaaaacagaggtgggaggaaggataatgttcattctatcagatattagcacttaattatgaaaccattaagacaatgtttttattggcccaggagtagacagactaatggaatgaaatagagttctaaaatgtttgctatatgaaaacttgatatagaacaagttacaaattagtagatgctggaactgttagttatccatattggggaaaaataaagtcctaattcacaccatttacatctttcaattcaggaagaataaagacctaaacatgaactgggaaatgttatttcctcagggtatgaaaggactcagaccataaaggaaaggattgacaagcaacaacaaagtgttttaaaacatctgtttcagaagataagcagactgggcatagtagctcatgcctgtaataccagcactttgggaggccaaggcagcagaattgcttgaggccaggggtttgagaccagcctgagcaatgtagcaaaaccctatcttcacaaaacattttaaaaacataaggctgaggtggaaggatcgcttgtgctcagctcaggagttgagtctgcagtgagtcatgattgtgccactgcactctaatatgggtgacagagtgagaccctgtctctagaaaaaaaatatatatagccaagcgtgatggtgtgtgctcatactagctactcaggaggctgagatgagaggattgcttgaacctaggagttctgggttgcaatgagctatgattgcactattacactccagcccaaaagacagaaggagactctgtttctttaaaaaagaaaatccataaacaaagtgcaatacaaaccagagagcagaagaatatatttataaccaacaaaatactagtatacaaaatacaaaaagaaccctgtaagtcaatacaaagcaacaaataatgtaatactttttaaaattagataaagtagataaacaggcaactcacaaaagtggaaactaaaatggataataagcttttttaaatgctcaactttactttactaataatcaggaaaatgaaaaactaaaaccacaatgaaatagcatcaaattaagtatagcaatgttctttagaggacagggagagaaatgagaccagaaagtaggtcacagagagctctgactatatttgtaattgtgacaatcactagaaccattcacaaacatttaggttccactccttttaggcacatggtaggattgttcttcctcacacctttaagctaggcaagtatatgtgatttgcttctgccaaggaaatgtatgcagagatgtcacttgtagatggaaacctttaagagccagcatgcaattcagcatctctctttccttttgtcacaatctctcagtgactgacaacaatgctgtcagcctggatcctgaattgggccccctgccaccccatgtataggcatgcaccatgagttagaggtttgtttgtgtggattttttgttgtttgtttgttttaagccacttacatgtgaaagctgtttgttacggcagcataagctagcccattctgagagttaccttttattcctttaactgggtggagggtaggtgtatgcacattatattattcactgtactttgtggatataaaatatttcataatttttaaagaacagtttatggtaatgaatgattatctggattaaatataagacatacatgcctccattctacaaatattaactgagggcttactatatgctaggcactcttccatgtgctagggattcaacagtgaacaaaatggtaagtcccagattttgcagagcttacaagaggaaaggcagaaaacaaacagatacatatttaatatgtcagatggtgttgtttactatgataaaaaataaagcagggttaagggtatagagaggaggaaagtattattttaaacagtgtggtcaacaaagtctctgacacagaaacatctgagctggtgaaaagaatgcagggatttaggagagggaggagagacagtaaggggcaaaaattttactaaaaaaggtgaggactcttgtgtctggagctgaatgagagagctaggaacaagacaagatggggtcctccagaccatagaaggccaccagggggtttggagcagagcagggatatgacctgacatgtttttaaagggtcattctggctgctgtggcaagaatctttaagaattggtgggtggaagcagggagaccacttgggaggctaatacaagattcagtcaagagaaaatagcgatttggtcaaaaaggagagctgaaggtggtgagacatgatccacttcaggattatgggtgggacaacagaatctgtggttgggttggatatgtagtatgaggaaagaggcaggtcaaggatgactgtaaagcattggcctgagcaactgcaagaacggagatgccattatctgagtagaaaagactggaggaagggcaagttgggggagagggccggaccaatttggtttatctatgttctgtctgagagtcctattagaattccaaatggtggcatcaaatagtcaattagatacatgagcctggagttcaggggaaaagttcaggctacagtagtcagcctgcagctggtatttaagccatggactgaattagctcacttacaacataaatgtagatagagaagccacccaaggaattaaccttgacgcagcacagccaacctagaaggagcctccactgaagaagaaccaagagttgtacctcatacccaagtgaagaagatgttttaagaaggagggagtggccaaccatgtcaaatgctgcagggtgtcaaatatgatggcttctggatttggccaatgtggaggtattgggtgatcctgacaaaagcaatgccattggagttgtggtggggtgcaggactggtgtagactgaagagagaaaactgagtctccatgtaaaaaaaaattatgttaagaaatttttctacaaaagatatctaagaaatggggcaatcactagaggagacggttatgtcaatacatggtttctttttaaaaatggaggccattagagcatatatgcatgtgggtaagaataatccagtggaaaatgaataatcagtcatgcagtgggggggcagcacttgcaagcaaagttcctgagaaggtgagagaagataggatccatttcaccagtaaggatgctagcctcagccaccgcctatctgctgtatccacagagaggagatgggtagacacagcaagtgatggaaacaaatgcagagtatgtgagtgcagatgcagggagggtgggagatacagcaaggggagcatgtggaagttctcttctgattgcttctaccttctcagggggataagaatcaaggtcatcagcagagaatgggaagagtgggcaaattttgagaatataaaatagttgtctctcagagtgggagaatgcactgaccaagatttgccagatagcacaaggatccattataagatttgtggtcatgaatttttaaatgaggcagtaagcatggtttacctggatttggggtttgccaagcaaatagaggggagagagagttgaaaaggtatgcaagggagtgattgtaatggtagcccatgaaaacaaaatgggtaaggagggaacttagagtctgatagggctgatggacaatgaagataggttcaagaattcggagttcccagggggttgaacaattgttgaaggtgggcatctagaaggaatgagctgggagcaaagaaaggagtagtcaatgagatgttgctaatggggttattggaagggatgcaattattggtaaaagcctagggtatgcccatggaagcaagtagctaagaaggcaagatcattcgaggtgaggaagtcggttaatgaaaagagaagggtattgggaggattgtctctttggtaaatcaaaatcaccaaaaactatgacaaaaatggtggcctgggtgcaaatgtcttcgaggaacaattggaggtagcatataggtaaccataacaaagaggggtggtgggtggcagagactggtggcaggagctttaaaagagctgtgggggcttctaaggaggatgcaagaacaatggcccaaagcagccatgagaagggagaagttcatctatgagcctctgggcttgggggccatgggagaataaaactgccagtggaaatagtgtcctccaaagacaacccagttttagttgaagcaaaagggtaaagtggccattcagtgaaaatgttgaggacacaagggattttgtctatgagagaatgagagctgtacaaggccctgtggaaggtttaggggaataaggaaaagagagagattgaaggatacagtacagtcagattcaaggatacaagagatacaagggacacgtgtccaggagatggtgatggatgaccttggccttgctggggtgcctgacacaaacgagttactcctggtggacacccagggacagacagtctctttggcagattaggatggtaagtgggagagagtaaggagggagagtgggtcttgcctagatcacacaggtactacacactcttgcacaatgaacatatgcatggtttattatttaggaaaatggttcagagacagagctttctacaaatgagcactgaagaggtccctccataactagggggtttcagtcttcctgggctggtgctcatactgtttacaaggcagggagaatggggaacactcaaattagtcctttgagcccttagagatcagcagcttggggtgatgcttgtgagagggaggaagctgatgacaatggttaaaatgggaggtgaaaattatctgtggttttcaattattcatactctcctcaacccacctatcataggactggatctaggtagacttaaaatggttcaaactgcacaccagacatcacaaaacaaagtagtgcttccatcacacagacctggagaaaagtcaagatatcaggaacatcatggttggagtcggaggtggtgatagtgggatctggaagagtccttccagtgaccagcagtcagaggtaggtcaggcaggcctggatttaaatcctgcctcttttcctgggagaagtcatatttccaaaatttagtttctctgcatgtaaaggtggagtataataatatctgcatttgaagatagttatgaagagcaaagactgttgagcccttagtagcaaatcagtgcagtaagaggacaagagaatgtgggtgttcctgatacgaaggacacttagacacaggagtttctgaactggctgtagaaagaatgaagcacatctcaaaagcctttcaagatgaagatttacatgtcagtgagtttccaaggagacagattttacaaaagctactatgagatacgcttcctctaccaagacaagataacatcacatgctgctctcagtgagttccttctacattctgacacatgatggaattgtaggaggaagaggtctaaaagccagaaatgaaggcagcaccccacacctgatttgtggaatgaatgaatgaaccaatgctgtgttttcccttcatacagagatggtagaaaagaagagggcgggacatgtaaaagtggccacatagggcccaaggaaggaggatagaggtagttggggatgtagttgttggccctgggacaattggtaggtgctggataacaagaaagaagacaagagcccagactggttcttaaaactcagtgtacctaaaggccatgcagccaaaatcacacatgaaagctggcctttcaagcactctcagtattccagaaccaactgccctgacctagccagtcctgcactgaagcagcattttaagaagaggcgtctgtgagtcctgacattgaacatagaaaaaggaattcactttggatctttttcctttgtgggtacttatttccacctaatcaatggctctctcaatcttgggcacggctttccaatgagtgttctgtacaacaccagtgccacgagatggtccatgaaggaagaacaccctgtcagataatgctgaaaaagcctccacacatcttcccatcacagagctataccatgcacattgacaataaaagctcgtgatgttccgctgtaaagaaacctgatgcatggtgtttttaaaacatatgtgacttttctcatacaactatgaaagtgatattctcctggacatcactgccctacatgttgtcctcaaagatggggctcagagggtgtcatgagccaccagagcctgcccagctgcccactaaacagttggtgagcacactgcctatcagagcggtactggttgctcaaaccgtgtcagctcccagagtccctgggaaggcccagctaggcaggcacattggtccttgttttagaaacgaggaagctgaggttctgagaggtgatgtgactgggccaggccttcataaccggtgtgtggttgggtaggacctaggacaaggtcttagggacccccaaagccatgctctttcctatgccaagggcacttcccagggagaaaatgcacccacagcaacacagtgtcctagtccccttggaagttcaacttctcattgtaactaaataaatttgtgggagccatggtaaccctatcctagcactgccatcccatcaacccaagcaggcagacagcccttctctttgtttatctttagctgaaacaacaaaacccctaaaatgccctccaatcctgagatatcttgcatctataaaagaactaagcaatacaattagctcactgattgcccaaagctgatcctaaggcaatttctaaagaagcagaattcatttctgtgagctttgctctctaatgccattttctgtcccttctccagcccaatcctcgttctgcttcccctttcgccaccttcccctcctctactatcctgtcttctgctctccagagaagacctaagacaagccaatcacagcttattgagcagtttatggccctatgttttctctcccaggtgtatcagcatcttagtctgtctgggttgctctaacaaaataacataaactaggtgtctcacaaacaacagagatttatctctcatagttctggatactgggaagtccaaaatcaaggcactgaaagattcagcatctggagagggcccgctttctggtttacagacagtgcctccttgctgtgtcctcacatggtggaagggactagcaagcgctctggggtctcttttgtaaggtcactaatctcaaccacaaggactctgccctacttatccagtcagctcccaaaggccccaccttctaatagtaacaccttggttaggatttcaataagtgaattttctttttcttttctttttttttttttttttttgagacagagtcttgctctgtcacccagattggagtacgtggtgcaatcagagctcactgaagcctcgaactcctggactcaagcagtcctcacgccccagcctcctgagtagctgggaccacagatgtacacctccactcccagctaatttttttatttttagtagaaacaaggtttcactatgtttcccaggctggtctcaaattcctgggctcgagcaatcctcttgccttggccccccaaagtgctgggattacaggcgtgagccaccattcctggccattcgacgtatgaattttgaggggccataaacatgcagaacatagcaatcaggcactgactcttatgcttatgacaaagaagagctctgccccattggaggcaggtaggaggcagtagcagggggcagatgtgtattctcctacccccaagccaactaggtaatttcaagaaagcccagaagatcagacactgccacagcgaacacagccctaactagctactggccatggctggtcaatgtttatgtatttggaatcttcttagaacacagagaagaagcacttagcaaaagtgagcctacacagaatgtgagaacatggaaatatgtaatccctatgatgttctttactgacacatttaaaaaatatttattgcaagcagggaagcatgttcatgaagaacagaggctctggagtccaacagatacaagttcaaacactggctctcctaaatatcagctgtgtgacctcagctatgtttcctcggatataaatgggtttaataatagtacctaccttgtaagactgttatgagaacaaaataactcatgttaataacatcctatcacaatacatagcatgtaagatgacaataaatggtggctataattttgaattaaatgtattgagtgctttctctgtgtcaagcacaatactatgcactgaggctgaagggataaataaaatacagtctgccttcaagaagcattcagtgggagagaagtcatgctaacagatcatcataaccttatagggtcaatactgtaagtacataaattagtgctgtggaaatccagaaggagtgaataacactgggagaatcaagaatggctccacagaaaagatgacacttgaacctataaaggaggagtaggattttaacaaatgaagaaaggtgtcagcatacgcaaaggccaagaagagttcatgaacatggcatgtttggaaatgactagagaggttttgtgcgaattgaagcagtggccacagaccaggtcttgggagcctagggcttcttggccaaactcaaatttttttatttattgtctgtctgtatgagggtaagggctcctgtcttaagcattgctgtgtcctcaatgcccaggataaggaatgatacatggcaaattctctcaagaatcatttgttaaggcaatgaattaattttatcccaaaggtgatgggtgggccatagtaagcccactgaagcaatgggataaaacttggcctggaagaagaaaagacaagtgacatggtgagtagagacagtccccaacttataatggctcaacttacaattgttcgacttacaatttttcaatgctgcaaaagtgtaggcagttaatagaaactgtatttcaagtacccatataatcattctgtttctcacttttagtacagtattcaataaataacatgagatactcaacactgttttataaaataggcttcggtttagatgattttgcccaactatatgctagtataagtgttctgaacctgttcaaggtaggccaggctatgatgttgagcaggttagatatattaaatgcattttcaacttacaatggttttatcaggacataaccccatcataagtctgtactatgtacagactagtacatagtactagtacaatgggcatctgtactagactatggtagtagtgagggcctccagggaggcatagcaataatgatggaaaggaaggaatggatttcataaacatttccaaagtgaaattgactcaactcagtaagtaacaatatactatgtgggcaggagcacaggatggctgtttgaagtaagacatgttgccattcagagtaggcttgggcagctcagatgagggtgtaaagataattatttaatattatacctgttgggtttgaggtccctgtggggcatctaagtagagaggtccagttggcagtgggatatataagttcagagtttgatagaaacaatgggggactccagacagaattcattgcaatgagagaagtcctcgagggaaagaatttagagtggaggagaagaccaaatcctcttcaaagaacgtgcaccaagaatgtgaaattcactggattataaatacttaggtatacaagccagattcccagccttgaatgggtttataacctaacaggggactcaagagataaacatgaaatagggaattaaaatgtagcaggcaaaattgaaatagcagcttgattcagtcccagaagggatttcccagaacttggaagaaagactacccactgaattacacaaatacaaagctaggggtgaccaagggggacacagactgacagaagtcctcccaaggaggtgagctctgcagagacctagaaggatgggtatgatttataacaggaaaagtacaaactctgcaaagaaccattattatctctcatcaagtagacatgccaggaccctctgttgcaacaaatgctctctgacccagatgctgcactataattcacttctaatcacaccgatgaggaaaaatgtcagcaacacttggaaaagaaaacatctggagagaaaagactttgtgaagagcttccttttgttttttgctttgtacgtgaatgctgctgtgtatgggaagaccagacatgagacatgttgggtaggggtatcaggggagttgtttatggcaaggaagagaagtgtccatagtcttcaggtgtatgaagggctgtcatgtagaagagggactagacatattccctaagatgctggtgaacaggagctcttggaagtcaaaatccaggaccactataaagatgttcaatggtcaaaggtatcaggaaggagtgggtggccttgggggcataacaaggtacccttcacagctggcagtgttcaggcagagtctggacaagaagggtgctatggaatgggttcaatcagggcataaaaattcctttccaagattctaaggttctgcaatcaattcttagccaaacaacctagatcatgtcactgcagggggtgcttctaaatgctacaaaatatgtctgggagaactacttggtggtgttttttccttaaggtggtaaacgcaagcagaagcatgcatctaactgctccttagaggatctgctgagcagtaaggtccaaccttcacttggatcagggatatggcatcagtgctggaaacaagggtgtcccctcagcgattgcatgggacactgagggaggagatgccctcttaaacaccaggctaactcagtaaaaaggctgttcatgcctgtagcaagaggacaaaggacacccaaaatctatttctgagagttgatcttgaagagccatcccaccacactggcgactatttttgtcaattcttctttggactgatttaaaactttttatttttaagaactaaatgcctttcacaaatgctatctcccatatccactccacagcccaggagatgtcattatttcaattttgcagataaaaaaaattaaggcacaaaaataagtcaatcatcacgtcttaagtatagtggagtcataccttctgtgggggtgaggttctaaagttagttcacgaggcaaaaatcacatgtgctcaagggttacctttgaaaatcccttaattcaattgtatagtccatgcaataaggtagagtatcaaataaagaatataaatacaaaatatacattttaaatttgcatttccctttaaattatataaaagagagaaaaattcaggatatacagttaacttttcctaagtcaaatgtgcacaggctgccactccaccatatgcagagcatgtttcaatctatagctctgtattaagacaaatgagctgccctaggtcagctggcctgtcagaagctgagtaatgacacaagagctcccatttattagacactgcctgcctgccaagcactgtgttaagcactttattgaatcctcacatccccctgcctctggggtagacagtgctactatccccattttatagatgacacatataagaatgacaggaaaaggagaccctgggtcacacacacagccattaggcagcagagctcgagccagaggtctgtctgactcaaaaacatgggctttgaggagcaattctcaaattaggtgcgcatcagaatcacctggggagggagcctgttaaaaatggagtttattgggtccatctcagaccaattgaatcagacccctggctcccttcccagcctattctgatccaggtggtccacaaaccacactttgagaaaccctgctgtcggctctaattccctacctaatacactttctatgaaatcacatgtcagtgctgtctctctaatgtcgtgaggactataaataaaatgttttatgacgatcactgataatgctgtagccacatcctcttaccactcagctcagaagcaacagcgcacagccccaccataagcacacccagtgaccttgggttcattttaatgattcggggcagagtaaagcctttcaaactatgagaccttttcctgcatgaaatctgtttcatagttaacccaaataagctttttactaaaaggaaatacctcaaagcctgattacaagttcaggtttggctgtaacacaccgcaaaggcatcctgtcatgggcttgcatttctgaatggaatcattctgcttcttttgattgaaaaggcgcatgatctaatgccagatggcgacatttgtacaagtcaagccggattaagtcaggagctctagtgaagcatgatgcagataaagaaaatgacggattatcaacacacacatgcgagcgtgcacaagcacaagcgcgcgtgcgcacacacacacaaggctaatgctaacttctttaaactgtggcaacagattccctgtcacactatccctgttccctggcctttgtccccagcctctaccagctggatacactcccacatttgctcacctgccaccggggtgtccacagtccaggcagacctagacctgaatccggcagcccaggactaggcccgtcatgtcctctcccaccctactttgacctgcacgtttgaagctggggtggcccactctaaacatagcataagtggcctagagctgcaactcaggcaagggcaccatcatctacccggttttccagaccaggcaccttcgtcatccttcactccttttccctcgccttccaaatcaattccattaccaagtcctgtcaattccgcctctagcctgtctgcgcctttccagccaccacttccaggatgatcctagtccctgttccagccaccatgcatcttctctggattgctgtcaccatttcctacctgctctcctgcctcaagagttgtctctccccaccctgccccctcacacaacccctgcacctgcacagtgcctggctcagaggagaataatacacacactgaatatcatccatgaataataaacatctcattgaaatgttcataaccctttgctctttctccattctccattttccaccatgtctgcccttaaacctttgtagctcccccttgcttttaaagctaagtccaaactccttatgattgctgacaaaggttggccatggccatcagcccagggtgtcacctgctattcccctcctcacactcaggtccagccacagtgaggtccttttaggtgagatctggtctgacagtatcaatcagatctccccctgtggttgtaaagatgactcaactgatagacaaccctgaatatctccagggagggttccattttgcacctctctatagagccaggatacttagtggttatgaatattttatgcaaatttcaattattcagggaccaataatctaattgtatattacaagatcacttatgtctcctcctctctgacctgcttacttttagtcaactcctccctaatataagtatataaacaatgcacaaacatattttccaaaacagtcttcatttgctcactcagtaactacttcctgaccatctgctctgtgcccagcactgcacaagatcccgggactataaggcacaaaccacaaggcagtcacaatatcttccctcatggaacatatattctagtaggaagatgggctttaacaacaaatcatacaattaattatttgttgatgattttgtaaaatattatgaaggagaagaaccaggtgcaaggagagcatatagctgtctagtctggggggaaagggatacttttttgagaaactaactgtgagctgagacctgaatgacaagcaagaattaaatccacagcaagggcaggcaaggaggaggcattcaggcagagggaacagcatttgcacaggtccacatggaaggaggatgaatgtttgaggaggctactgtggctgcagcacagaggagggtgggagagaactaaaaaatcaatccaggaaggcagggccagagtcctcaggcctcgcagcccagtgctgctcaaactatgtatttgcaacgtgtcaaggactgacacttttgtgaaatacaataaaaatgagttactagaaaattgaaattaaaagacatacaaaatatgagcccaaatgttttaccactagttttaacacatataaaattattctaccagttactgtaaaagtttttaaatgcttgacctctatttgtgtcccttctcatggcctaaccataacaaacagctcatacaccagctcttgagaccatactttgagtagcacagtggacaggaagccatcaaagggttctaagcataggtgtagcaaattcagagttgtgtttttcaaagatcattctggctgctgaatggagaatggatttggggtgggaggggcaattggggctattggagatgtcttagtgagagatcatgtatcttagaaagaacaatatttaatactcgtgacaacctatgaagtaggcatcaacatctattataaagtggaaatttaaggtcatccccagaagtagaattcacatttccaaaaacagtgaatccagactccctgaagccttatttaaacgcagtccttattaaacaccaccttattggtgaccttataacaagatcttttttgttgcttctgtaaatagcctttctatgccattcacagctgtactggcctttaccgaaaccccacaatgctccaacagccttacgcgccttccagagaatacagctgccattcttcaagcaaatgtctcacaatgaatgaatccccagaggtagaaagagaatctgcttataatagcctgttcttttcactgctctctcatctctcttaaatggatggatttccaaagggtcctgattacttttaggagacaattgagtttatgcagctggggaaagagaggattcagggaaagccaagatgatttcagtctaattcaaatgaatatttctgtggcataagcaatgtgccaggcattgagctagatatggaggttacagacatggggagatgatgtataaacaataaagggcgctgctgcacaacaaacacaatacgcagacacacacgtataagcagagcccaggaaagggagtgtccactctaaggtcagaggacagagatcagagaatttgatcagagatcaatgactgtgatcagagatcagtgactgattcacttttaaaataggaaaagggattttcctaggagataagcctgagaacaccatcctagggagagggatcagcatgacgcatttggaaaacgtaggcagctcactactgagaaaatgcatgggaatgagggaaatggaagaaggcaggacagggacagtgaatcccaaagggtctcatgcaccactgaaacaatgaaatgaggcgatacggggcgtatcagaggatctggactgggctagactccaagagtacatttgaggacaggttattgttggcgcattgttgcaggtgaaagagaacaaaagagtagttctgtccatatgacactcctccatggatacctctagaaacaacaggatgagactctgagggagctggaggtcctatgttatgcaggtgaggaccaaggccagtgacatttgacttgctactatgacctcactggaactgacaggtccaggaaacaagtcccctgcacattcatgagaaggcacagaactttgtgtgttggccctggtggaaaaagcacaactctcctctatcagacctcctgagagagcaggaaaacaaccctctcccttttcctccataactttaaaatgtagccagaaagcccgatatcttccttcactgatgtcatcatattccaaaagcaataaataaatgcagttttctaggtagataatgaagagcaagagattataacattttctctactattcatcagagacagcaccaacttggggaaatcgatgcagagtaagtgtgtatgtttttgtgtgtctgtgtgtgtcatgtatgtgtatatgcatgtgtgtatatgaatgtgtacacacatgcccaagtgagagaggagaaggcagaggagatctcagaaacccctgctaccaaggagttatactccactccaagaagggctgcactactcaggggtctaagaccctgcaatcaactctatgcttccaacaagcacccctcttccaattcccccagaccccacccaaattcactcagtagacaatggctgccccagaaagtccagttcatgcccttaaatctgacttgcaaaaaatcaaacaaacatttttcctttcttcttaggaatctgccaaatgcagccagcctaagttagatgaaacatgaacctttccccattgccaaagtattcccagaagagctcagaaacccaagtctctgttttggaaatcacccacattgataacaagaggtcccagaggctagtaagggcccagcgcgtgaacccagggtggctgacgtcactttgcaaagctcttaagagcattaatgagttcatgggagtcaaggcctctcagatgggagacaccaagataaaccgcctggatttatttctctgccagtggggtcctgtcccacatccttccctctctcactgagagagcagcagacgcaggggaggggaaggagcctgggctttggatttgcatagacctcagtttgcatgtggctaggccacactcaaactttttaacttgagagcgcatcagaaacacttggcctctggcttcaggatcatttaatcatgaaacattagatggagccatagttttacattgggcactggggactaaacacatttgaacagaccccaattctgtccctgagaatatctcaggagcaactacgatgcactgcactaagtatcacattagacatattacgaaaggtcatggaagccaaagagaaaaggatatttgtcctgcatgcaaggaaacaaaaggtttggaaagcttcaccaaggagggtacatttgtgatgggccttgaaaatacatagaaggaagagaaaggacaccccaaatagaaagaaaagtacagaggcagaacaataggtggcaagcttggacattactagctcatcctgtggtgtacccagagttaagcatgcatggtcaggagtggcagaggctggtgcagatacttgtgcagatacagaaagggctggtggactatggtgagaaattcctcatgagggaaagaggacacatcgaatgtctaagtagagaagtgacacaatcccacatgtgttttggataaagcactgcagcaactgtgtgcagggggagcagagtatgaagcttaaaagtggagaaaccattcaggaggttagagctgctcaaagactgaagcagagtgttacacagggcaaggagatcagggaaggaaatcagaaagcatttcacaggaattgcctgaactagttccagtgtgttttgccacttcacctaaggcaagcttcacacaaaaaaaattaatcctcggggatgtgaacatatgaactttagcaaacagatgtctcccagaagttttttctgaagtgcgtagatgacattaacagcttgtttgatggagttttctaaaagtttagcataaacatcctgtttggagccacaaaccaggggctcccactgcagccctggaagtgtcactgtcctatcaggtgactggagtagtaggcccaagagggaggcaatcaggcatctgagccagttgtatggtggcaaagccctggaattcgcaccccagctccccttcctccaaagcataagtgcaagggcctaatggcagccagctcccctgagagcctgtttttccgccagaagcagcaagttccttctgccaacatctctaccagcctagccaacagattcctgttgcccactcagcctcatctggccacaggatttctcagctgttcaccaggttcccccaccctgctgtgggtctgatcagtcccatggagtagtgggagaattactgaatagagagtaatgtggccttgggcaagtcacctcttctgttggccccagtttcctcatctgtaagacagaggcaataacatctattctacctacaatatgcatcattataaagattaaatacaagctatattaaaatgctctgtgaactccaaatcaataatagggtgccactgtttcaacttccaatccagtctcctagtttcagcttcttgttttgtctctaccttctttgagcaggcccccagaaaaggtcattttgaggttgatcccggggaagcagggatgaaattcatcagtccatctgtccatccattgctccctgcattccacaagcatatgcccagcatatttcatgcatcaggcagctgctaggattatcagacacacagtttctgacctcaaggatctcacagataagcctctcaaccaaagtttgatgattagtgactagacaccagtgcaagaaatgaggaaagattgagacgatgaacaagtaaatataagatttttgaagaagttagacagagaaaggagaaaaaaaacaaatgagaaaggggaatggcaacttctgtggtgctgcccaaaaattgccctggcttcctgcgtcaggttcatctctattcacctctattccaaagctaagcctgtccttggaacagagcaaaggcgcaatgaagactaactgatgtttaaatgatgtcccaggaaccaactccatgaattcaaatcctggctccctcatttactgtttgaccatggccaaattatgtggcttatttgtgcctcagtatcctctataaaaatgggtggataatgattgtacctactttaaaatgttgttgtgaaaatttaaatgacttaatatttacaaaatgcttaaaacaatgcctggcaccttgtaattattctgagtgtttaccattattattgctattattgttattattactactactactataattattaagcaatcatgaaacagaagtggtggctatctcttaggcggcaggcagccactcaagatcacaatcacttcaattgtccaaacctagtgaggctaaacaccagaagagggggctgctcccagccaaccagacaccagcaagggctctgcctggtgctctctgacttgcatggccacattttatctctgggagcagaaccaaatatcctcattactcctgacaatgtgtccaaaagaggcagtgaccagccctctcagggactgtcctgcagccaaggaaatgggcatagcaggttacatgctgtctatccatctacctgctcaggcaaattggataatctccaaagagccaaacaggccaattcaaagacaccaggtttctctgcagagtttccaggggcagcagatgaatggaatagtaccccaaaggtacaagacaaatgctttactgcgcttggggccaaaggcaggtttctgctctaagaaggacactgacttagagtcaggggagctgaacttgaatttaggctctgctgcccacaagctggggaccatgggtaagttccctaacctcttagattatatgtgtcttcaattatatgatgggaataataaaacctacttctcggaattaacttatatcctagccaaaggtgtagcacattataggcattcaaagctgtgagatgaaactctgcattggatctggtatcaatattggcgttgactattacttgcatcttccatacaggaaaaagacaatgactcactcaccaacacatattccatgcacttcccttcttgcccatgagagctgggccctgcacgtgggggtgactgatgtgctgagggacaagggcaagggcacgccctgccaaattctccattaacaagctgtgcacatgcccagcacaatctgtaccagccatgggaattcaagactatggggtccctgaggaatcaccatgttaaaaagaaaacaaaacagccaggccaatgaatgaaaaaagagggactggctaagacatggaaactccaggaaacccagcaggcaacagcagccaacttcctgaaacttgattttggttaagcttgccgccttctgtgattttttactcaagccaagtatcttttacccaagggtatctttcttcataccctcaaggaatccttcaaaaggcccagctccttccaggcctgcaagacccaagtcactcaccctcctggagcctcagtcttcccatgtgtgacttggaaacaataggatctgcctcttggagctgctgggaagattgaaagagggaatgtccatggtgcgcccaggactgaggaggtcctcagtagggtccccccatatcacttcatggtttggacattggtgggttattgcacatggtagaacatgagtaaaggtttattaactggaaagacatttttacattcctgatttttaggcatttcacgtggtgtatgtttcctaactccctagacctacaagagatggtgtcagcatttttctcctaccaaacataagttttgataaattgttcttccatactcagaatggagagcaagaaagagccaaggttggggaggggcagcacggagaccccaactcaaggctttctatctctagcttcttttcttccttctcctctctcccttccatcatcagctcttctttaatttccacttacatgctaatatggctgaataagtgcccaaaaggtacaggacaaatgtctcactgtgctcagggccccggcaagtctctgctctagtaagaaggtggggcaactggattaaatttggactctgcctcccaccagctgggggagctggggcaagttcccaaaccctttagagcctctgtggcttcatctgggatgaggaggcattcctgggactctaatccagttctggcttaaaatctcatgggtttctcactaccctgggctgaaattttaaggagtgaaacaaaacaaatcacttctcttaaggaaggattgtatttgttctcctcatccagccccagagaaattccttgagctaacgtcatcatttttctaccctatgatgttgctaaagaagccaaaatggacccaattagtctggagtaagagaacactgcccacagaggccacctgtcacccccacgagcccctcctgcccccaagcaggtgatgaatgggtttactttgcacattcacttctcaaaacctccagctacaggaacccatcaagtgacatgaggtaaacacccggcacaaacctgcagcaggtcctttctctcacccagccatggcttggtgcccagaaattcttcgtcccacctaaacactgggctgttcccaaacaggtgtcatcagactctgaggaccgggcccaaccagtctctagagggctgctacgaggctcttcctgtttccaggcggactgataggggtcacctgaccagaggagacttcagtgtttagggttttggcttcaggttctgactcaaagcagaaagtctacgaaaatgagagttaaagtcacagagggaggcaatgaagtgaagagcactatctgaacgcagtcccaccaaaagtcaatgagcaaatcagtcaacagtggagaggccttgaagcctggctccaccactcagctctgtgaccctggaaaccttattcaacttttctcagttttcacttttgcaaaataggaatgtgtaattatttctagtattcacgactgccctgagcactgtgagatgacgtatgtgtgaaacatctggcacagaaaaggcccccgtgaaacatggccctcaaatttgttcactttgattctttgtttcatgagcagaggggtcagtccatggagggcagccctctgtgggttttctctgtggagcgatctcgccttcctcgcccctgtggtgaaaccaactttgcaaaattataactgaggaaattatgacagtgaaagaaatcagaactaaccaaatctatcttgcctctaacccttaagctgtccttgttcattcctgggcataggccgaactaactttgggaaggaattcagttcatggtttgactctgaaacaaaatttataacagccctttcccgaaaagacccccttcttgcctggggaccagtctgcctttgcaagactaacaaattagctacaagattagaaattggccgggcacagtggctcatgcctgtaatcccagcactttgggaggcccaggtgggtggatcacctgaggtcaggagttcaagacaacatggtgaaacctcatctctacaaaaatacaaaaattagctgggcatgatggcaggtgcctgtaatcccagctactcaggatgctgaggcaggagaattgcttgaacctgggaggtggaggttgcagtgagctgagatcgcaccactgctctccagcctgggcaacagagcgagacttcgtctcagaaaaaaaaaagaaaagaaactacagttgaggggtcatgcagcctctggctccaagagtctgaacctccccaaattgctcctggaggtaacatcacttttgtaaaacctaagatcagtgcttgagatattttgcagacccccacacttgatggatcagctgacaccacccagaccagtaatctagccaaaccagttccgccatcacctacaggaacagaaaacagcaagaaaatctcacttcaaccccctatgattccatctccaacctgaccaatcagcactccccacttcccaagcccctacccgccaaattatctttaaaaactctgatcctcaaatgctcagggagactgacttgagtaataataaaactccagtctctcgcacagccagctctgcgtgaattactctttctccattgcaattccccgtcttgataaatcagttctctctaggcagtgggcaaggtgaaaccattgggatttacagtgggattgacagaagtcagaaagttcccatcaatgatgtatgagttcactgttggcctcttagatcagaagccaggaattaagtcaactttgatttttacattgaacctgcccagaagtgtctataaacgttatagttagaacaatgtgaatcagaaaagctaggcagacattttggtggatataagtcattttgaaataatgcattctctcagcatcagttcaatatcactacttcgtacatttttcttttaatatgccaccagttttaaaatattgttcttaaggagaaaaaacactaatgggctaaaattatcctgaaccttccattctgaaaagcaaaatatttacaaacatggtgtgctgaccctgagaaggatggctcacaccaggggttgctttgggattttttttttttttttttttttttttaatgtgacatctagtggctggtgaaaaaacagccatcaaaaaccaggtagaggggtagaactttgcctgattcacccccactggatgggaatattttttagttttttaatttctaaattgaacaattcacaggagatgaaaagctatatgccagaataatttttgacattaatttgtatttcgttctctgtgattcccacctccactttatacccaattctaagcaaataaccaggtagctaagtctgtggccccctcctatcttctgtaaaatcttaaactcaatgaaaaaattatgctggtgagtgagcaggtgctgggaggaaggaacagggggtgctgattacctttgaaggagagaaaggagacgtagcccccagagagcaagaactccaaactgaagacaggttcctctgaggagcactgccgtgcagcctgccgtgtagcagggtggtggcaggacctcacaggggtgactgcaggaggccccagcatgggagaacatctggcacacagggtctgtgtgtgttgactatggcagatacgcagcaaagccaccaacactactgcagggagccaagctgggacatgcaggtccatggtacccaatgtaaaccagtgagccacagctggggttttctttccctccctcccactctgtgttgctctgattcctaggacatctgtgagctttgggaagggggagcccccgtaacaactctttgaactttctgacaacttttggggatagtattttggaataagattaaagttgatttttagaaaattaaggcagatgatatgtcttgaaggcctaggtgtaggggctaaaccttctacctaaaggctctccttgccccataaggcttctattcccactttagtcctcacttacaaagttcatttcattcaagactctacaaaatttagattcttggttttattaccattgaattataattaatgaatttagatatcaaatgtgattaccagagtccagtttcctcctttcagtcaggtggagctggtgtgatatgaggatctcccggaatgtgttcaacacaccccattcatgaccatcaccccaacatccctgctaacccaggtctctgggagcaggaaaggtagaaagagcacaatgtattgttttaaacttttttggaagtaatttctaacttacaaaaagttgcaaaaacaaaaatggtacaaacgatatccatatacactttacgcagattcacctactattaacattttacctcactggcttttctctcccttgccttctccctcctccccctgcatatatacatgtgcgggtgtgtgtgtgtgtctgtgtgtctgtgtgtgtgtgtgtagtgaataaatttaatttaatttttatttatttttctgaaccatgttaagataagttacatacattatggccttttacccctaaatacttaaggttctatttcctaagaatagagatagcatactacaattatcaacctcttatatttacactgatacagtactttaatctcccatacacactccagttttgtcaactgatctaataatgtcctttatagtatttttttctccaggcagaatccagtctatggtcaggaattgcatttaattgtcatgcctctttagccctatgtaatcaggagcatttccaacagcctattcttgtcttttatgacattgagatttttttaagaatacaccctccccccaacactttttttataagagaatgttcctcattttatgtgtgactgatgtttccttgtgattagattgaggttttgtattctcagccagaactcagcataaacaatgtttccttctggggcctcacatctagaggcacacaatatcagtctctcataagtaattctcattttgatcacctggtcaaggtactgtcagatttttcctcaatatttcactgtcttattttctcccttgcaagagtctttaaggccatgcaaatatcctacccttcatgaaaattccacccacccccttagatagaatatccattgatgattcttgcctgatctgatctttaccacgatggatgcaaaattatgattgtagaagctctacaggtcactagggtgctggtacctctatatttcaaacaattgagaatcactagatagagaattcctaaaacaatgacaggtgctgaagattttaagtagaggagttatgcaagataatgttataggtatttatcaaagaaggaacagaacccaatatttatcaagcacctactattaatatagccaagcccttcatatacattatctcaatgaccctttatggccgctctttgaggtaggtattcttattgccttttatagattgagggattagttaatatgctcagagtcacacatctaccaagcgactacaccgaaatgtaaacctagttccatctgacttaaaaaccaatgccttttacactctgctattttcatggctagcttctggttctctccaaaatggatccaagtgttaggtctattcatcaaactgagtgtccactgggatgggagacatcatgcaggaatactctgtgccatccagaacttcggttgaatgcagcccatgtggaatgctcaagtagtggctgatgaaggccactagcaattatccaaacagattcactggattcggtgcccacattgaccctttcttctatctgtcctggagtgatgaatcaagatgtcccatgcctccacattgtctgagcctatcatggagccagaaaacaaccaaccatatggcctagcgaaagttctactgaggagcctcttgcacttctcctttccttttcaagaaggcttttccaaaatgcccaaacagatccttttttgttcccccagtttcacactacaatgtcctctattgtcttttaagccaaattacatttccctttggaatctgagatggctttgccaagaagcaatggcaacagtccagtttgtgatagaactcactcagaaatataaaattaagggtagtaatgggttcaagcagttaacaaaacagacagagtggccactccagagagagcaaccttagcaagaaagtagcaaaagggaagggaatttatttcactagcaccttgtgctgtctcactaccccttagcccagatatttataatgctactaacatgtaatgagcaatcttgggcagtgcacatacaatctctctcagttgatgaggtttgagtgaagctgctctatccttcggctccaggggtggccacctgatttaaacctggccaatgcatgcatccaactgtcccccagccatagtgattggttcaaggatgggcacatgatccaattcaggccaataggactgtgtcatagacttaaagctggaataacaggaagagaaaaatgttctttctcttttaagggcaatgtaatggacgccactatatagacagggtttgcctgagagtaaagccaacacaaaagaaagtagagccaacagatagaaaaagagagacagggaacaaacgttgagggcataatttgagccactaaatccaactatgccaaagctaggctactttttagtttctttctgtttcatgagtcaagaaattaggtttttcaccaaaatcagttgagtttagcccttgttacttgcaaccaaaagaatcctgaccaacagagacatatacgtatccaaatagctttacagtgtgtcagattggtagctgtcagaaatgaagaacacttggtattacgcatgttcacagaaggaagacatcacttccaatggagcaatcagggaaggctgcatgaaagaggtggtatttggacaagctcctaatgaatttgtgggaacatctggaagacctcccctacaaggtgggaggtcaggtgggggtaagagggaaggagaataataccaaggaagatgatcaagagaagcaaaggtggccgggcgcggtggctcacgcctgtaatcccagcactttgagaggccgaggcaggcagatcatgaggtcaggagatcgagaccatcctggccaacatggtgaaaccccatctctactaaaaataaaaataaaaaaaaaattagctgggtgtggtggcaggtgcctgtagtctcagctactcaggaagctgaggcaggagaatggcgtgaacctgggaggtacagcttgcagtgagccgagatcgcgccactgcactccagcctgggcgacagagcaagactccgtctcaaaaaaaaaagaaaagaaaaaaagaaatcgccttttgagagcctgccataagccctggaacccagttgagaacaagtgggacaaaatccctgtcctgtagtcccagctagtcgggaggctgaggcaggagaatcgcttgaacacgggaggcagaggttgtggtgagccgagatcacaccactgcactccagcctggcaacagagtgagactccgtcaaaaaaaaataaaaagcctttccttcggcgattacatgctaattgatgggtgagggagaggaataaacaacaaaatacaagtttggcaaataaaaataattcagataagctatgaatgaattaaaatccatgatgtgatagataaggtctggggccaggggtaagggttggacttcttcagacagaatggtcagtgcaggcctctctgaggttctggcccttaaacagagacctgaaccaggagctggagctggcggtgaggatgaacactcaaggcagggggcagtgcaaagacagagtgcaaatgagctccaacaagagtgtcttagcctcggtcctcagatgccaagatgggattaaatgtgcaaagatttcagagctgcaatgcctgcaaataaagtggcgggggcggggtgggggggtgcgctggagaggctggaagagggagaggaagagaagattgggtggaagccccctagaccacccggcattctcacggtccagcaaggccgtctgggagcaaagtcagcagtcagaggagttcagagtgtcccagggactcgcctgcctcagtttccctgccacctggccaagccctgataggcggggcctcgacccaaagccctgagcagcggcggcccctggccaatgaccctccctgtcgttagagacccgaccctgagcaaggctgagtgcaaggagaccgggtcagaaaggaatgcaaaggccccctggcaggctgaggttaggggattttaacctaagggcagagaggaagcacgtctaagggacactgggtggagctgtcccacaggccatggctctggagtttgggagatgtctccaggaatctgtggcgcacaggtggcacaaacacctcggaaggaatgggaacagtcagaacatgtggagtgaaaagagggggcacgtccacgtaaggaacagatgaagaaagtggagtcaggtagaagggggtgacccatcaagcactggggccaaggagggcttctggaagaaggcagaagtgaggtctttccctcaaactacagaaaatgcagcctctttctctctctctcacacacacacacactctctctctctctctctctctctctctctctctctctaacagcccagcaaatgacagtaccccaaccatctgaaagtaagtctcttctctagcacccctggcagtgacagggaaggcatggaacatcacaatgagatgaaaccccctcagaaatgacttctttttctcccagtcactgcctcatttctctgtccagccaaggccatgcatgcctcagacacaaaccacagttatgacccctccatccatggagcatacaggcactttacagggattattctttatgataatcacagccctcctaggaattggggattattctccccattttacggaattggaaacaggctcagagaagcttaatgaggacgactgtgctgaaagtgacactcgtgatctttggtgaaggaaaagtcaggctggcactgctaacaggatcagccactaggtgcagtggtcatagggcaacgtcgggggttacccaccagccatgcgggtcacaccaggcctggaacccaaatgtggaggtccattcctaggcccagctccaagatacttagcctaagtcctgatgtcaggaattgaagttcagttcagtcttgaagtttctgaatggttcattgctgcattttccaaaaggctcaagaaggtgtcttgctcattgtggtctggtgactacaggggcaggacttggagtcagacctgggtttaactgctgtgttggccccatcgcttactgaccccttggctgtgagcaaatcacccacatctcccgcctcagtttctctactagaaaatgagactaatgatacctttctttctggaatgataggaggattgaatatatataaagcatagcacataaagacacaagaaagacaaagtaagggctctgtacttacttatttctaccttaccttgttccaaaagagatttaaggctgctgatgcacaataaatatttgttaactgaataaatgtaaaatagaaaatagagactaatgagcttgatctcccacagagaggctcaaagagaaaatgagggaaaattgcctacggtgaaattcattaggttgtttttaaaatcaatgatttgagctccagcctttcactggaagggaaaaaatgaatttattatagtttttagctgcagttaggataataggtaacattccaaaaaatatgcctcttttcactagctaatagcattgaactttacatccccataccccttttcttcctgggtcctcaaatgcatgcatatgaaagaattcctgaatgctgtccagggagggggcaagagagatcaagggaccagatagctaatttattaccagaataactgataataagttattagttcttctaatacagaagaacctctcacaatttacaaagtctttaccatgagacctgaaagaggcagtgagctataaaactcaagtcgctcaaactgaattcatgttgtcacaacagctgtggcagtagcagcacagaggccttcttaaagatgcccactaaatgttcaccatagtgttgtttatagttaaaatacaggaagcaacctcaatgttgctcaatgaagactgccttaaaccagtgcttctcacactttaatgtgacatgagccacctgaggatgttgtgaaaacagcagattctgagccagggggggtgagatgctgcatttctaacaagcttctaggtgagaccagtatccaccgaccacatttatgagtagcaaaaccttggctaaaataaccagtaataagtttatactggaataatgtacacctcttaaaaatgatgatgtgaatctgtatatatgcatatggcagggagtgtaggatatatttttttgatgtttttgttttgttttgtttcgtttttcggttttttggttttttctttttagatggagtctcgctctgtcacccaggcaagagttcagtggcacagtctcggctcactgcaacctctgcctcccgggttcaagcgattcttctgccttagccttctgagtagctgggactacaggcacatgccaccatgcccatctaatttttgtatttttagtagagacggggtttcaccatattaaccaggctggtctcaaactcctggcctcatgatctgtccgcctcggcctcccaaagtgctgggattacaggcatgagccaccgtgcccggcctgtttgttttttaagagacagcatctcactctgttgcccaggctggagtgcaatggtgtagtcctagctcactgcaagcttgaactcttgggctcaaagaatccttccacctcaacctcccgagtagctaggactacatgcatgcaacaccatgtctggctaatttttttttattttttgtagagatggggtcttgctatgttgactaggccagtctcaaactcctggcctcaagcaattctcctaccttggcctcccaaaatgctgggattacaggtgtggtattgttaagtgataaaagtagggcacccaattgaaaagttaaggattttaaaacagagtataaaataatatgtatattatagttctattttacatgcaagtgtttgctttgtaaaaaaaaatctaaaataatatactccaaaatccgacagtatttctctctaggtggtgaaatttagagtgatttcatttatttttcttttggcgcaactgtgttttctttccttctttctttttttttttctctttttacaataaacaagtagcactgggtgatataaaaggaaaaatctgcaagaggttataaggcccaagaaaatgctttttctctagatgattgtgtaagaatatatatacacaatcagtcaagaatagaaaaatataaaaggcttctcaggaagtcaagctaatttcaaatgtgaccactccacccatcaaggcaccccaaagaccgttagaaaaggaggttggtttccagtggcttgctgtgaggaaaggactttgtacaggacaagttgaaactctacgtgtaaggagctggttaggaatagtgaagaagataatggctggcctagaggcccaaggcgccccaagcctacggacaggggctggatgctgtgaccctagagatctggggatgggatctcttggggcatgaggatacacagtgcagagggctctggagcacgtgggatccagatgcaaattccagctttgccatttagcagcttaaccaccttgtgcctctgtttcctccaatgcaaaatggacatacaaagaggactctgtgaccaggcacagtggctcacgcctgtaatcccagcactttgggaggccgaggcaggcagatcacctgaggtcaggagtttgagaccagtctgaccaacatggtgaaaccccgtctctactaaaaaaagaaaaaaaaaaaattagccaggcatggtgacgggagcctgtaatcccagctactcaggaggctgaggctggagaatcacttgaacccaggaggcagaggttgcagtgagcagagatagcaccattgcactccagcctgggtgacagagcgagactctatctcaaaacgacaacaacaacaaacaaacaaacagggctctgctgagggttaaatcagataacttttgagaattgttccacaatgtcagccaccttgggcaagtcttctggacagtctaatctacttgacagggatggagccagtggaaagagttttgctttttgtttgttttttaacttcagcacatattattgtgctaaattagatacatattatttcctttagataatttcatatgaagatgtaatgccacgctattctagaacagataaacaataagaggtatcatttcttaaagagaagtgtaggggagaaaaagtttaaaaataagaatatttaacccaggaacacgatcatatccaaaataggaataatgctgtgagtgggtagtttttactagaaggaaatctactatattggaagaagatatagtagcagattagttagtagaaattaagtaacgttcttgtgaaaatgtagaaaactcacagccccagaagaacttattgacaaacagacaaaacaggacgaagttcacacacctgttacaggttttgcaccatccctctcagtcttagcaacagggcctccacattatgataataataataacacatggggcaaatgtttgcaaagaaaatgaacatgagccagaggggcagccttgtgatctctctactccaccttggagaacatccacagagacatgcagcaggactttttgctgcaaatacaggaagatgccatgaagggaagactttggggagataaactgggctgtcttgcttaggaactcctggggtgttgcaacccgttttttctgccattgggttagttacaacaaatgccaataagtcacctccactttgtctcacttgttctttgcagcagcagctcagccttggaaggacgttgcctgagaaatgaagaagctcattaacttgggtcggtagattggacagtgtagcacctgtagaccttgaatcttaagatgccttgtgtgatcagccagagaaatgaaaactaatcaggagggtgaaactgcaatggggcccgcagtgaatagtgaggaggcacagccaacaggctgaggcccagactcagtggtagcccttgcaacccagcttgactggcctgtgctgggaaatgcagctggcctaagaaatgattaaatcctcaaacgtctaggacaaacattccaaccatcctaccagactagatcatgtacatatatatccatttgtcccacaagggaatttcagaaaaaaagtgacgtctcattgaactaatgaagatgtcgttctcccacttaagtgaattctggaaactctaaacattcatttgcacaaatcaatagagtctcaaagccaatgtttattgccttcagtgagatttattacgctgtaaaaactttgacttttgaccagcaaaatattaaaaattaagttgcccgtgtcactcttggctatctaatcaacagccattctcccttcaaagactagcaaacagaattctatgtttgggtgcaatggacccagtcccatgaaatgacttaacgattgttctaactcaatagtgacacccccttccactaagccagtgattgatttaggagtgtgcatgtgacccagttctagtcaatgagatttgaggaaataactgctgaggcagccatattgccaccattaagcaatgaactggaaaacaaaagctgagaattgcagagctattcttattgtgtataaatattgaatgtgacaaaggaaaagaatgcattgagcaaaaagaaatgggtctatactataatattaacaagtatttattaagcatctaccatatgcttagttaaccctatgatacggggtatggaataattatcaacctctatagcactggctttgaaatggagatggaggtgacggtgtttcaggttgttaaagaagtgctctagctactggtgatgaagaaatctatttcagctagggcatacccgggaggtgacttctagcacagcactcaaataatattagttacaaaaaagaagagtagttacaatcttcacaatgacagacataggacaaagagtgccccggtgagagggaagacagtagtgttcagcctctcatatcagtcccctgaaccagggaaataggcagccagcattttgcaaagcatattagagaaaagcaaagatgtccattaaaatgaattgaaaaagtcttggtcctgtgctttgagcaaatgtattaacataaaccaagaacttcctgtaattacagcacttctgaagtaaaagtatggctgggctaccccaaaggacagtcatcccactatttctttagccacagtagacatagggttatcacagtaaggggaactggaactcaatttcagaccccactggacttccttcatggttccttgcatttgtttgttagggagacagtattcacttcagggctcaggtggcaggacagatgagcatgggggttttcagaagaggaggtccatgagaaccagagggtaaagtttgaattttgccttcaaagacttgtacaccgatttgtgggggtaccgcagctataggtgtgtctatagtcagcatgatgccaactgactcatcaccaaaatcagttgtgtcaacaccataaatgtggcagcctcgttcagagaaatcaaatgtaaaagtgttttaaatttaaaaacactgatgatttttaaattgtgcttgaggttaaattgttcccctaccttgttgggttcctgagaacaatgcagttagaataacaatctcgctgctgcatcttttccagagatctcaaagcatgacttgagtgtcattctcattacaaaagtggagaatggaggattgcttgggcagaaacatacaccagaggacagcaggaaagcttgaagatagttaaatcttaagagagttctagaactagaaggggtcttagaaacatctagtataacctctcaaacatttttagcagtagaacatttcattcaaatgaaattttacacagaaccccaatatggatataatggcatttatttaggatagttttttaattttttttttttttttgagacgggctcttgctctgtcagctaagctagagtgcagtggcatgatcacagctcactgcagccttgaactcctgagctcaaatgatcctcctacttcagcctccccagtagctgggaccacaggtgtgcaccagcatgtctggcctttttttttttttttcttaagaaataggttctccatatgttgcccaggctggtctcaactcctaggttcaagggatcctcccacctcagcctcccaaaatgctgcgattacaagtgtgagccaccgcacctaatagatagtttatttttcaagtgaaaactttcatattatgaagtgggtctgtgagaccaattagatggtttgttggatgtgaaaaattttaaatcagggtttaaggactgttatgactagatcagcttcagcatccattgtatttctctgatgtgtgttagttacacagaatcgagaaacttctgattggtaagtagggacaaacttgaaagtagggatgagcttcaccactcaccctgcaatctcaggatacttttcaaagaaactgaaatcataggagaagctttattccaagatgaatcagaaaaatagctcatcctgcaacataaattaacgtgtttacaatttgctaacgtgcttaagaaaattgatatggttcataaaacaaggacatgcatataatgtttttaagtacaaatatatttcatgactgatgtttgaatcaaatgtttgcccaatttctaaagcaactctacaagtcgctaagtttctgcagaaccatctagaacacactgatcaaattaaatttcctcttttttataaataaagaatttaggtcctgattggagagattattgcttgaagtcacacagttagggttgcatatctaggactaaaacccagaactttttacccaaaatctacaggggcttcccctaaagatgctgcagttctatgtaaaaatgttctcttttatatagatgccttttctactgctagcaaagaaactaagctcacacatgtcatcagataagacctcgaacactttgacatgtatttccaagctaatgaggaaaaaaaaaaacttctgaataaaaacttctctgcaggatgcccacacccagcccctactgacatcagtggccctgatgagccaagcaggctcctgatgagcttgtaggcacatcacctgcatagtcactcacaccagtgaccactctctccatggcctatactttgcactttctcagtaaatcttgctgaacaaaaagtgagaagccagtgaacataaaagcacattttagggaagagtttgacatcaaacaaataccagcagcaggaaaacagctccacctcctttccatatccagcctctgtctaagacctcccctacctgaaagttagcaggaacatcagggaaaaaaaaataaaaccaaaaaaaaaaagccttaagtctttcaggttgcacctgcaaacaggtcctggaaatgggttgtggttgcacaagggcaatgaaattaagtgaatgtgtagttccccttgtggttcatttatgcacacactcccaaaccccacgaccacacagagttgatgaatcacttgttcttctgtttaactgaatgtctaagacaagatatcattcccattgctgaaaacatccagaaaattcattaacaggatgacataatacagaagcatgctcacttagtatgaccctgtaactgtagataccagcttatcgagttggcatactttaattatgaactgcaagatagataaaactcaatatccaatttatgaaaatgcaaacatattttcatttactttgggtataaatggccatagtgtaagcagaaaattgtattacaatactattcctgataatatcaacaataactatttttgttgattatttaccatataccaagcactgctataaatacttaacatgtattagctctttaattttcactataactctaagaaataggtactatttgtcagcccaattttacaacaaagcaaactgaggcaaagagaagaaataggtattagaagtgacaaaaacaagcataaacaggatttgaatgagtgtgcatttcttcctacctagatattaattggtatgtaatcatgactcagaaaacaaggaagaaaaaaacgtttaaacttcccaaacatacaacatctccttcagctctcatgttagcacaaataagaggcatttcaacccaagatcaaacagtttgattaaatcctatagtttagagattgaatggaacctgaggatctaggagtggggctgggtgactgcaagaaaggcagctctttgcaagactgttctgcgtgatgatcaggtgttgcagctctgaaaccacagagcttggattccaaccctggctcgccacttgtgagctctgtgatcttaagaaagttgtttaatcttttccatggaaataataataataataataactatctcacagggatgttgtgaggattaaatgagcctgtgaaggtgtgacatagcacccggtccacaagaaccactcaatacatatcagttactgttactatgatcactactaccaccaactggagaaataactggaaattaaggtttttataagacagaaagaacaaaatcctggcttttatgagacagttgtgtactactctgttcttagactcattcataagggggaaaaaatccctataccccatatcacgcaaaagctgcatgcagcacaggcacagtggctcatgcctgtaatcccagcactttgggagactaaagcaggcagatcgcttgagcccaggagttaccagcctggacaacatggcaaaaccccatctctacaaaaaatacaaaaattagccaggcatggttgtgcacacctgcggtcctagctatccaggaggctgaagtgggagaatcacctgagcttgggaggtcgtgatgggcttgagccatgatcatgccactgcactctagcctgggtgatggagcaagaccctgcctcaaaaaacaaaaacaaaaaaatctgtatgcatgctaagttttccaacaataagcaacatatgacactactcatacatgaatagtttctttaatcttctataaacccacttttattaagtcttctcaaattgccaatgggcatttagaaatttttacagaagctttgtaaaatgagatatgatggatctggcccaaaatggtataaagccacaaatcctaaagcagatacttctgataaatggcaacaaaaacatagaaaaagatttttaaaaataataacagaactaaaattgatcatagtctaatactagaacctgggagcaactgacaggactaaattaaaacaccagcagctgagacttcagctcttgatgtagtctggcttcgatgaataaaacagaggtcaccagacaaaaggaagaaagagaaagatgcttcaaacctcctctttcattcctcagcttcatgtctgttctcctatcctcatccctaactctatctccacctcttccaaatctaagcagaaaccacaaattctagaaaatataacactaatgtgggtaagaagagacttgatggtagcacaacacatttgtcttagataaaggcaatataccatcacgatgaaccctaataacaacacgtactggaaattggcttgtccatgttcagagtaccagagaatcaggcagtgggaggagatagaaggtgccacttcattagagcaggacacaccggtgatgtcctaatggaaacaggaaactggactgggagcagtgcataccaatatgccacaagtgtgaaaagggaattggattatatagcaaaaaaaaaagaagctgaaacacgggcagatggaaattaaacacaacgagttgccaaaaaaaaaaaaatgcaggagagaaggaaggattccaagaagataatgtgattacagaagtaatatacatattggaaacaggtttagaaccaaactgatgctatagaaaatctatttagtggtgtggaaaacagactctccaagttctagtagaatatagagggaaagaactggaaattaaaatgactctagttgtggaagacaaagactggaaagtcaatatgagaaaaatgagtgttcctcaaggagaactcagaataaatggaaaaaaagtaataatcaaagatacagtagaagaaattcttcctcacctaaagacaaactgcataagcagatcaaatgggcctttagttttctgaaaaatccattagaagagattcacatctactcacatgcttacaaactatttacaaggataagtttaaaataaaatttaatttaaaaacctataagcaccaaggcaaataaaccaggttgcctagcaaatatgaaaattagtcaggcttcagacttctccagtgctggactagctccaaggcgatgctgtctcaatgcctatagcattttgaagaagaaaaaagttatgatccagtaatttttcatgtatctgccatgttgaaaagggatgttcagatacacaagctcttaagacacacaggagcttccagaaagcttcttgaatttgttgtccagaaagggcacaaagtaaccgataatgaaaaataaaactagttttaaaagataaacaattggcagaaagctggatataaaagaggactcaataaaaactggagtgaggattctttggggagtgagagaaatgttctaaaattagatagtggtgggagtggcacaattctgaaaatttactaaaaatcattgaattgtatacttaagaggaatttattttattgcaaattatgcctcaataaagctgtttgaaaaaccaaactcaaatataaaaactgatcagatagaaaagccaaaatcaaatacactaacatagcgtagcaagtaggaaggatgacagagtgtgttcaacactttatcaccagaggtgccatttcacaagtgactctcacaatctgaaaaggccaatcaaagaacatttttgaaaaattaaaaataactaccactagaatatatgtcttccaaacattagaaaagataaaaggtaaagaaaatatagcccagggagggaggatggggaaaggtcggtcaacaggtacaaagttgcacttagataggaggaataagtcctggtgttctattgcacagtagggtgattgtggttaacaataattcattgtatatttcaaatagctacacaagaggatgctgaatgttctaaccacaatgaaaggatcaatgtttgaggtgaaagatttgctaattaccctgatttgatcattatacaatatatacatgcattgaaatatgacattataccccataaatatgtactattatttgtcaattaaaaataaaataaaacttaaaagaaaatataatctatataccaaaaaagaaaacataaaggaaagagcaacatagcatctttcaagtagaaaatgctgatatgccagaaataagagcaaatataataattataacaattacattaatctcctctattaaaaattttgaaactataaactcgggtcaaaaaaacaaaatactgtacctaaagcaaagtaaaataaatatataagggcaaaaacctaatttcttggtctgatgaaaagtgtaaacattttgaactgagaacttcatttaaaatggttattcaactttatgtttattgcaacagaaaggtgaccatgacatatttgtaagtgggaaaaaaatgtagactatcacaacagcatgcacagaatgatcccacggcaaattgtgaatgtgtgtgttcatgtgcacacacacccaatagaatatataaaagggattcactaaaacatcagaagtagatttggggagattttaatgctttggtctggttgagtttttaacaatgagaatataatatgttcacacacagagatacacacaagatattgtaaatttgtagaaagacagtggtaaataccatttagtggtacttacccaataattttatattggaaagcagtaaaattgatagtgaatatataattctcataaattccatgaaacaagttatagtgtactaaaatatgtataaagctaaaactgaaatacaagaagaaattcataagaaaaaattatattaggataattctttaataaacaaattgtcttcatcaggtcaaacagccaaaaaatagagaaaaagctaaataattgtattaatgtaattactaatctggataatgactcttcattatatcattacaacataattaaattaatttaataaatacattgacgatacatatgaaaacagaaacatactctatttttcagcgcccatgaaacatgtacaaaaattgatttagaattggaccacatagaaagttgcagttatgctcttgactacagccctatcaaaaagtctaaaaattttctaatgaaaactggcaaattaaaagtccatcaagaataaaaatgagcaaaaatagcctgggcgaagttgttgctttgggaagctgaggcgggaggattgctcgaggccaggaactcgagaccagcctgagccacacagcaagactgtctccacaaaaatcaaaaaattatcagagtgtggtggtacacacctatagtcctagctacttgggagcctgaggcaagaggatcactagaaccaagaagtttgaggctaccgtgagctatgatcatgccaccacacttcagactgggcaacagagtgagactttttctctaaaaaaatttaaaaataaagaggaaattccaaaagcagacccaaatatgtatgtgtgtgtaacattagtattattaaattaatattttaaatcagtgcagaaaaaaatgggtaaatttagggaaaaaacaattaaatctctaccttattacaaaatgaattttagatgaagtaaggatttaaatataaaaataaaactataaagtactagaagaaaatattgatgcatattttcaaaatctgttcaatgtagaagtttttctaaacatgaattataaatgaataaaactgataggcttatttaaaaatttaacatctgaacataaacaaggctaaaatgcctatttgcaaactgtgaaaattatttgcaacaaatatcacaaaggctgaatagccttaatttttatttttaattttgatatataaaaatttcatataaattaaaggaagtcaggccaggtatggtggttcacacctgtaatcccagggctttgagaggctgaggcaggaggatcacttgagcccaggagttcaaggctgcagtgagccaaggtggtaccactacactctgggcgacagagtgagaccttgcctataacaaaacaaaactaaactaaaggaaataccccaacagaaaaactagtgaaaggcagcaatgtgctacttataaaagaaataagttgcacagctagcacaggcagtagagcatgagtctctttaaagaaatacagatgcacacgtatgtttgttgcggcactattcacaatagcaaagacttggaaccaacccaaatgtccatcaatgatagactggattaagaacatgtggcacatatacaccatggaatactatgcagccataaaaaggatgagttcatgtcctttctaggaatatggatgaagctggaaaccatcattctgagcaaactatcgcaaggacagaacgtgttctcccgcataggtgggagttgaacaatgagaacacttggacacagggcagggaacatcacatactggggcctgtcatggggtaggggacggggagagatagcattaggggaaatacctaatgtaaatggtgagttaatgggtgcagcaaaccaacacggcacatgtatacatatgtaacaaaactgcacgttgtgcacatgtaccctagaacttaaagtataataaaaaaaaaaaaaagaaagaaagaaatatagatggtcggccgggtgtggtggctcacacctgtaatcccagcactttgggagacagaggcaggcagatctcctgaggccaggagttcgagaccagcctgactaacatggagaaaccctgtctctactaaaaatacaaaattagccgggcgtggtggcacctgcctgcaatcccagctactcgggaggctgaggcaggagaatcgcttgaacccaggaagtggaggttgcagtgagccgagatcgtgccattgcacactccagcctgggcaacaaaggccaaactccatcaaaaaaaaaatagatagatagatagatagatagatggtcaattaacacaggaacaaaacagtttcaatctcacaagtagtcaaataacagaacagttttatgtcttcttttttttttttttttgagacggagtctctctctgtcgcccaggctggaatgcaatggcacgatctcggctcactgcaagtccgcctcctgggttcacgccattctcctgcctcagcctcccgagtagctgggactgcaggcgcccgccaccatgcccagctaattttttgtacttttagtagagacggggtttcaccgtattagccaggatggtctcgatctcctaacctcgtgatccgcccacctccgcctcccaaagtgctgacattacaggcatgagccactgtgcccggcctatatgccattttttacttatcaagttatggctctttaaaggttaaaatcccatgttcataacatcaacatgaaacctcaaacctcacgtgtggaattgcaaactggtaagacattggagagtgggagttgtttagaatgtacatttcaaatgtgtcaaatatagtcaattctttctactcaacaattcctaaggcaaaaaggatttataaagatgtagagacaatgatagttactgtaatgttatttgtggcagcaagaaagcagaaagaacttaaagcacccaacaatagaggaccagctaaatcaatcgtgataccttaaaaactgtgatgaagaagaatattcatatgaaaagacattaattatacattgttagatgggaaaaataaactacaatacagtaatggtcccatatttgaaaaaatagtaataaatgtacattcattaagcaaaaacaactttttttttgttcagggaagatattcaccaaaatgttaatagtggttctgtctacatgttggtatgacaggtaggatttttgtgttctctttgccaatccctattttataaatttttccacaatcatatgtttaacttgcataataattgttaaaatagtaacaatggtagtaatagcatgctgaaattaagctttttctctttttgaagagcattggcatgccagttctttttctccttagcatgaaagaaagcaccatggatccacattaaaagaaagatgtggcttgccatcaccctgagggacactttcagtgggatgattacagctgctatgacaacaagaggaggatgtgatgtcacataatgatccagtgacttcaacggtcccgtcccaatgcagagctttgctgccagctggaaatccagcagagacctcattaagggcatctgttcagtaattactacaagtttcccttcatcacgcatccaaatttgaaaacagccataccgcagaactccaatgcctgattcacagagggctttaatcttccatttctgtagcgctcagactgactgcgaccagaggaccagggtcaagttttggtgcagtcagtaaatactaccttgatcaacagggaccagggcgggaagaagcatcccgaggacatttattaacaccaacaaagactagagcctcaaggtgtttaactaaggtatcttattttgcatcctcctagaacatttaaatattgtaatttccattagagaaaatctaatacacccgtaacccatagaaaagaagggcaaataggactgactgcacagcaagccagagaatcaattgcaaaatatgcataatgaattctcctacaatgaatatgaaatcccaagaccctattcacatggcactagcactggtgctctgcatagaataggggcaaactgctatggtggaaggagccagacagaactggtgtcaagtcccagctctactacttaacctcctaagcctctgtttcctcacctataaactgagaataataatgagtcaaaagagttggaaaattaagcataaaactcttagcctagtacctagtattccaaataaagttagttccccttgaaaagtttcacagaaaactacacagaaatgtcaatgaattaattgcttctttattaagtcttgaccaatgcaagagtctcctaactgccctctctcttgccacacctactgctattatcatcctcacatatcacactactcttatacatggtgttttctctgtctagaatgttcccagaatttctcccctgtccatcccatccccaacctcatccatctctgtgattcctaaacaaggcacacagcagaatcacttagagacctttctaaaaatgcacatgccaggctgggcacagtggctcacgcctgtaatcccagcactttgggaggctgaagcgggcagatcacctgaggtcaagagttcaagaccaactggccaacatggtgaaacccgtctctacaaaaatacaaaaattagccaggcatgatggtgggtgcctgtaatcccagctacttgggaggctgaggtgggagaatcacttgaacctgggaggcagaagttgcagtgagcagagatcgtgccactgcactccagcctgggcgacagagcgagactctgtctcaaaaaaaaaaaaaagaaaaaagaaaaaaagaaaaaaatgcacttgccaggtccaacccacaattatggaattggaatcttcggagcatggagcccagaaatccttaacaaactctccatttggtttttatgcagccagccctgttgctgcagcgtttgagaaccactgacgtggctgattcctcttctttaaaactccattcgaaaactttcatacatcactggtggaatcataaaatggcgcagacactttggaaaagtttggcagttccctaaatgttatacaataatttaccatacaacccaacaatcccactcctaggaacctacccaagagacttaaaacatatgtccacacaaagacatgtatgtaaatatttatagcagcattattcataataaccaaaaactggaaacaacctgtgtccaacaattagttaatggataaacaaatgtatatgttcacataatggaatattattcaaaataaaatagaatgaagtacttatacatggtgatgattgcataactgtaaactcactaaaacttgttgaattgtactcttaaaatgggtaaattttatgatatgtagattacacctcaataaagctgaagaaagggaaaagaaagggagaaaaggaacaggaaggaagggagaagaagaagaaagaaggagagaggggaggagaggggaagggaagggagtggtactggggagaagagaagagaggggggagagaggaagggagtggaggggaggggaggggaagagaggagaggagaggagagagaataaggggaggggaagggagggaaagataaaacaagagtggaaaaaactaagtccaagcgtttgccaacccctccccctgcattatcttcatcctttataaatctctcaaacagcacttggcctcagcatgttacttctcagtgtcagtctccccacaagcccacatgcttttcaaggatgagaaaattatttaatatcttcctatacttgcagggaggtcagtaggcactaactaatgtttgtaagaaaatgtaggaaggaatgagcggttgtttgagctttctgttgaaacacactgtaagaaacattctagctctaagaacttaatactcagtttcccgcttataaagtcataaactctctcattgggatgttaagaggagatgatagatgtcccaaaagtgctttggatttttactgaagatatgtcccacaggtgtaagaagggcactccctctgacatgtcccatgcataatcaagctctcagataaccaatgtagtgtcagattcaaatccagatctctccacttccctggattagtgcgttagtttcctcatccgaaaatgagaaattaaatgagctagtgcttacaaagcccttagaagagcatttggcatacagcaaacactcaactacaaagaaaatagtagtatacatggtgtgtggaaggggtgtgtgtttgtatataaaatatgtgtgcatataattggtgagacacctctgccaaaataggccatgctgtaaaatactcagaaaagtttcacctgcctcatggggcattcaggattagggaagctgatacaaacacaaaagagagcctaggcactaagttagagagaccaagagagctgactaatttaaaatatccatatatacaattaagttttaaaagcaggtactagaacaacatgtatgatcccatttaaatagaactgcaatagaatagtatgtggaccaaggataggatattaacagaggtcatctctggataatgaggttttctttcctgagtgcctaaaatgaatatggatcgtttttataggcaaataaaattaataatgctatcttcattttgttaaaaaatgaattaagtaattaggaaaattaagacagcctccagcccccaaggaccacctactgctctggcagcctaaaagtttgcctggtttgtttgaaagagagaactaatacccagaaggctacaggaaggcccagatagagaggaagaatgcaggccacacagaaatggctagttattattaacacataatagcaagaacattcagcaaatactcaacaactgattctccacagcatagccagagtgtgtgtttataaacagaaatctgatcttgtcccctctccctaaaatgaccaaactgccttccactgctcttggagaaaaaaaccaaaatcctccagtgggcctgtaagacctcatataatcacctctccagcctcttcttaatgctctcacagccctcaatagcccatctcctccctccagccacagggcctctgcacaggctgcctgatccacctggaggctctcccatcgcctccccaacacccttcaccagggaagcccatcccaatccccagacaaattagatacccctgctgggcatgaccacagcaccctggccttgccatcagaggactaagcacagttataccaatgtctgtgggccccactaggctgtcatcaccatgtcatcagggctggcttgtttgctcacatagtattcctagtgcctaacacaatcgctgccataaagaatgcactccataaagacaggctaagtgagtggttacgacccatgcgcaggcagggcactgcaaagtacgggtccagagaaaagcaaaggccaggtcatggaaggcccatgggtcctacctgggaatgtgggcttgatcctgcatgcaatgggaatctccctcctgggttttaaatggaagggcagcaggatcaaaaagcctacagactttaaatactaattagatgacgtgagggtaggaatctgcacaggaaaaggaatctacaatggttcccaggtttctagttcagatgcccaagctttcaaaaatgtagaaactggctgggcgcagtgcctcacacctgtaatcccaacactttaggaggcctaggcaggcagatcacttgaggtcaggggttcgagaccagcctggctaacatggtgaaaccccatctcccagctacttgggaggctgaggcaggagaatcacttgaacccggaaggcagaggttgaagtgagctgagattatgccactgcactccagcgtgggcaacagagtgagactccgtcttaaaaaaacaaaatgtagaaactagattggagtcatggttctgaaacgagtcactccgacttcttggagtagcagtttctccacctgtaaaatggagctgctcatagatctttttcaggggaattggtagcatcaaatgagctgatgtttgggaaagtgctttaccaatagtaaagcctctcattatcatcagcaacatgggggcaatagtttgcataattaccccaaaaaatagcctccttgaaatagtcactaagaccaggcttacagtcttacacaactggactaaattctgcaccttttaaacacttttcactgtcttaaacggttggcctcatgaatgacccagatgagaaagaaagaaaatgcatcctgttggaaaactgggtttctgtggggcccagcagatggttgggatctagtctggctcaagtgctgctggttccctctttaagagatgactgattcctctccaatattaactgactcgatacaatttgaaaagctaaagtagtttccaactgtttaaggtgagtcactagatacagtggacctttctgagaaactgtaaactaattactttaaaaaagaattccattcactttcccactcactgcttaaatcctatggcgttaatgtgtgttccctgggcccaaagtcagagaaaaacaatgccagctttctcttggggcctctcagagagatgaaacttccaaagggctggagggttcccctatttgtgatgactaggcaaacatctaagccagcagaaataccttcaggtttggcatgaactaggaagaagaaaagggaaggggaaggagtcagtatttttcaatatttttataagcacctgcaattgtcattactgggctagaactttacatatgtcacatcatatgtagatattattattcctactttacaaaattaacaaacaagattcagaaaggtaaaaaaagaggtcagaggccaggcacagtggctcatgcctgtaatcccaacactttgggagggcaaagcagaaggatcgcttgagcccacgagttgaagaccagcctgagcaacatagtgagagcccatctctagaaataataaaaataagttagctgggcatggtggtgcacacctgtagtcccagctactcagaggcaggctgaggcagggggatcgcttgagcccaggaggccaaggctgtggtgaaccgtgatcgtaccattgcactccagcctaagtgacaaagcaagactctgtctctaaaagctaactaaataaataagtggtcagctatttcataaatggtgaacataacaacttatcaattcacattttgttttgtccaaagataaagaaggaatattctctccaccatatacactacaaaaattttattgagataatctctaaaagccaatatttctgagaaatgaaatatgtaattcagcagttccaacacagcaaaaccaaaaaaaaaattaagccaggaaagagccctgtagttgaactgcaatgaaacccttacttattactttgaccttgagcaagtcacttctccatctgtctaatttcagcttgtgaatgctgaattagactatctataatgctggtggttactagtccatgcaagtccagaaggggtttcttctccttttctcctccccaagcccgtggaatcgcacctgagccactctatgaagttaccacaaagagaagcagcacagccatttggggaagcagagagaaagtcagcaaatcaattcctgcaatgtggtttcttctcaaactctggcagcagtacctgtgacctaatactccagggcagagtcttgggtgctttggacccttgtccagaagacactgccttccaccaagtgaaaatcaacttctagcaactctgcctccaagcctgcccagggtcccctggggaaggcctggttctcaggccaaggtcccaacacactccagtgcctgtctgccagcagcacaggaagtgccaaccagctctccccaaagcagctggcaccaattaccccaacccagctggaagcacccggcttggctgagacaggcactccagatccctggcctggtcagaaatcctaccctaaaacaaagacagacttgcagccgtgccagaatgctacataagtggctggtggagggttggcagaggcagccaggagcaggcgggtgagcacagtccagggaagcagctgtgggtctggaagtcttgcccacaccctgatttcagaatccctccatcatcacaaccaacagctaccaattaacaggcacctagagcacactgggttcttacattcctcaacctcttgaaccctcccaacaacgcaacaaagaaggaatcgctatccccatttactaatgagggcctcaggggtcacagaggtgaatgatcattcccccagccacagagataggaagtgccagaactgggtctagagcccaggtcttctgtatcacttgcctttccacctggcatcctggcctaggagagctaacattctaacaagggcctggcagctagggactcgctttgcaaaaccatcacaagtgacacagtaaatcctgaaagatgttaacctgctgaggaaatgggaacacatggatccatgaagaacaaccataaagtatcaagagatcattacccaaagacacaaaagtgaagcacatgaaaaatgccaattttgaacaacagaaagcagaagacaaagtcatccttacagtttttcaaacaacagtatatatggtgatttgatcaagcaggactcagagttggttattattattttcaagttaataatattatgaaaatatcttataatggatataaactataaatatataataataaaaacatttacgtagaacttactttgtaccaggtgctattctgagtgcttgatgtgtattaactcctctaacaccctaggaggtaggtaatataattgtctacatttaacagatgagcacattgaaatacagaaaagttaagtaacttgtccaaaattacacagctaataaactgtgaagccaaaattcaaccaaggcagtcaaactccagaatccaactcttaacctctgcacagactgtctctcaaatccaacaagcatttatcaagcaggatccaggttagatgcttctgtatctattattaatttgttattcattcttacatttattctttctaacaaatatagcagcatgaattgaagccaaaaaggtttcatatcacatcagaatggagctagccctgcaggcactcagaaacacttggaaatctccagctagtccccatttcccactggaatctgatagttagcatataggtgaaatagctggaatgcccaagcagctacacatggacttgcctttggtcctttcttgagtttagctcagtggttattaaacgtcactataagtaagaaaactgtacaatgctgtatacacaaagcctagtatgcttacttcatgaataatttcacctctgagttcttaactagtcctgcacgcagtttgcctcctctttggtctgaactctacaaagcatccatcacaaatccccagtgtacctcacttagccattccccagcatctcacctactctgagaaggccagggtcaagacttgaagctcacctcttccgggaggggcaggaatcgcagagatttccttacttaaccagtttgtttacagatggagaaattgtggcccaggttaagtgacttacccgggatcaaagagcaagttagtaaggtgctaaccccatctctgagtccagtatgtgttttctaatagtctgtgcttttctcctctgtggttcccccgcccttctacaatgtctacttcagtgttatgttcagcaaatatttattaacctaccaataataatagttcacaattttgaatgtcttgactgtgccaggccctgtgctagaagctacagtttcattatgactttcatgggccctagaaacttttgcttttgtggttcccttcctccataaaaaaataatttttaaaaatttaaaatatattttaggactacattgaaatgaagaatataataatgttaagttttcttaacttttttattatttgttgaggtaagaacacttaacatgagatctaccctctaagcaaatttttaggtgtacgacattgtactgcagatctttagagcttgactaaaactctatgaagtaaaatattttattcaatctaaaagtttattttttctttcaattataaaagaaattaaaatattttcagaatcctaaaaatattgcagtctgatcactatgcttactgtacccagtggataaatcagccctagtaagtgttctagttgcactatcccatttgatctgctactctagcatggtagacactatttattatgtccattttacagcttaggagtcttaacattagccatgaaatgccacctctctaagatcacagcaaaaggaagatggggttctagatttgaaccacaagtgtctgactccagagactgttatattctggactctactcagtgcaatttacccatcctggtcccctcctcctgctgtgttccaagccaatcccgaagcccagctcaggaccgtcattccttcattactattctctccaccactcccaacttccccatggccccaggtggaccctgtccaggtctgtggaggctgagtggacacgccaggcacactgtgtggctccggaaagtgcatcagcctataggagggcagcagtgtgcccagtacccacttgactcttactctcatctggtgtcaggggccagcacagttgtacagggcatcctggctgcccacccacagagtgcagccacaaaccctggggatcacaccactgatgctcacccactcccagccagcaccagctctactcacagtatgatttcaggcaaagggaagggacattgaacagacacccacagggtgacagccaggcactgtgcatggcccttcattcccctggccatgttcacccacaaggaaggtgttaccacctccatttattcagagaagaaaattgaggctgagggaagctaaatggctcacctaatgggcatgataaatctgcgtgtgactccaaagcccagggtttcccacagcaaatacaacctctcagctggccccctaaaagcgggcactctaattgtttgctgacaatggcaactccattgtgagagctcctcaggcaaaagacagggctgctctcggtcgaagtgcaaatgctgtgaagtggcatacaccggttttaaccagcattaactttccctaataacagcatttggagggcattttagagttaacagcgcagttgtttcatgcataccttcactcgatcctcaccatactgccataacctaaggatcttactccccattttacatgtgaggaaacagaggctcagagataatgtgatttgcccatggtgcagaatggaagaggatgaacagcagagcagagactgcaagcctccgtttgcagactcctcttcccacaccctgccgcacctgactgactctgagatacgactgagggagagaagtaggtccatgagcactgggaggaggccatagaatattttacctggaatccttactgggttctttgctccctgccatcactcccaaccaggtgtaaaagctccaaagttcttgtttccacccagactgcctgcttgtctaagcaggcagatggaaggcagacaaaacactcagctgagagagcacagagaccagtctgggctcagaaagtcgtcaaccatatgccccaggggaggccgggggcctctctgccagggctggagagtgggccacacccccagtgtatgcagccaattcaatcagacctcagccacccaccgagccctgcctgcccagatcccctctgagaggagcatccaggagcaaacctcctcccttcagcttagcctccgtcccctgctgtccaagggtaggtcagggaacccccactcccagcccctcaagcctccgattgctgtctaggggcttcttgtttttcctcctctggtacaacccaaggagggaaacacaaggcagaaaagccagtggctgttgctacaggaaacacatctctgttagcaacacctcttcagtacaggcctagaattttccacaacaccaataggttcatttttgaaggaagcagcttctttgacattcactccgctaacttcacatccctctgagtctctggtttcacccacctccttctgacaccatgcaggtcatcactgagggcaggagggaaatgatgggccctccctcagccccattttctcatctgtaaaatgaacagggaggagcatcaaaagagatcaagtggggcccactcaggtgatttaaaagaaaaaatgtgcttttgtttttggcagacatacatcactttgagggggaggtgtttgtttgtatttcaggcagccttctggagagagcaagaatctgtgaatgacttaatacaaacccaaatagacatccaaactccagaaggaaagttcttctgaaatacaaggtactgcacctacgcatcccaatcattcacttcatatgcaaatgctccttcacaagtactacctcaccagagtcaatttacacttgcacttccacatatggccttcaattatgtcatcaggataattacttgccgcaatcataataagttcaatggtttcccagggatggaactctcaaagcatcaaggcgctttcaaagtcagcacttctgaatgtgacatgtgttcaatcttagtcttgtttccaagaccttttgaccacatacccatttcatgacctgagaaaattacataaagaggatgcaaaataatttgccctgggacagggaagcatgggactgagggagcccagtgaggcagattaactaaccttgtttcttctacctgatcttcctccagggagcagcaaccccaccctgtcccacatgcagcaatggtctcatctctttctggttttgctccagccttggctggttaagcagagttaacaaactcccagatccctctgctgcagaatgatgggctagtaccgaggctccagcagaagtaaagtccactgtgggaggcagcatgatgtgtgggacaaacccgggctgacgggtcagggcagatgtggtttgaatccaactctgccacctagctgtgtgccttctggcaaattatttcctctggagtcttgggagtttcttctcctaaaacaggggtcataacagctacttttcagagctgtcgaaacattgctggtgggagtagaagctggtaaatcttttcagaaggcagttgagcaatacgttttaaagttcctaaaaatgttcatactcttagactaagcaattaagctactagaagtttctctttaagaagtactcatgggtcaggcgcagtggctcacgcctgtaatcccaacactttgggagaccgaggtgggtggatcatgaggtcaggagattgagaccatcctggctaacacactgaaaccccacctctactaaaaatacaaaaaaaaattagcagggcgtgttggcgggcgcctgtagtcccagctactccggaggctgaggcaggagaatggtgtgaacgcgggaggcggagcttgcagtgagctgagatcgggtcactgcactccagcccgggtgagagagcgagactctgtctcaaaaaaaaaaaaaaaaaaaaaaaatgtacttatgatatactcaaagatttagttttttatcactgtttatcatggtgaaaattaaaagcaacctaaatagccaacaataggaagttgattttttaaatactttatatatagcatgaaacaaaactaagggttttttaaataacacatttttcaaacattctgatttcattttgtaaaaacaatgtacatattagaagtacatacaagaaatattaatatttagcattggatgataaaatgacagttgattttctttcttccttttttattattgtattttctaaacttggcctaaaatttcttaaatgcctctctagcaacttactaatttctgctttttaaaatggttatgtatgaacatatcacattgccccaagaatacaaattccttgaacacagattctaagtctgatttatcttcataaactccccatgatattagcttagtgccttgaataattacaattaccatttattgaatgtttgccgtgtggcaggcattgtgctaaattgtatctcttagtatagtaaaattgaataaatgtggaaagggggagggaagaagaataagtagaaagaagtgaatgaataaattctcagcaatctgaaataagttggcagctatctcacttggaagcgaccagctcatttttagagtctcttctgaccaccagaccataccaatctgctagaccaactcttctaacagaaagggaaaatgtcaggaagaggaggaccacactatgatcctggattttagaaagccacactttgaaggataagatctcataaggacaacctggtataacttttgagaattttcttaccagagtcaagaaaaccaatttaacatgacaatgatctattaatgaaatacttttgactttggcaacctttaattcttttctacaagcactcccttagcacccaccaacaccatttgacagggaaagatacataagcagtctcatccttaaggaatttttaatacaatgaggactaccaacaggtgcctaaataactgattcaaggcagggtgtgagctccaacggagaactcagggactggagggattgccaagggagaaattctttctgatggggatggagagtggaagacgtggaaagtgaaagctgggatctaaagcatagacaagatttctcaatgctgtgttgagggaatggctttcctgcctgcaggaacagcctaggcaaaggctcagatgggtaggatttggtacgtttggagaagggcaagtgttcagtccatgccccagaaaccttgggctactttattgagaacaaaagaggccctgagatgagctccttttcttggtctcttcttggccctagtactttcctgatacacatccaagcagacacagcccacaaaaagcaaaataatctaccccctcattttcaaaatctttggggttcagttcagattaagaccacagtacttttggaagtacttgagtacttccaaaagtaggaatcagagtggctcctgcctctatcctgctgttctccaaaggctgacgtcccaaaaagcaggcctccagggctccacctgagacttgggttctactcacctccaaggaagatgtggaggcaatccctcacaagtagtttcaaaacagtcacagcatggggcggaaggtagaagtatcaagcacccacctcttcaaatgctaggcctccagagggtcaaccctgtggtcctgctgctccctgaaggtccccaaaaccccctctggtccccctcttggtgaagggttttgggggaaagaaaacaggagccactgggagtcccaagggcaggagagggaaacaccacctgcagctcagagacaccacagctttttctcaaatactttgggtagcatgacatatgatcccccctccctgcggcctctctctcagactgaattggcctctttttctgctttatttttctgaatctctctgttctcttctctctcttcatgtgtcccttttcctttgtttcaacttttatagaaactattgttcaatctctctctctctctctctctctctctctctctctctctctcctctctctctctctctctccctctctctctctctctctctctctctctctctctctctctctctctcccctctctctctgaattccccggtctctgtctctctcagcctctcctctcttgtttcagtcactgtctccacgtctttgtcactctattagtctgtcttgacgtccgcctctatctctggggcctaggtgtttctatcagtgtccccgtgtctggatgttcctgccgctctgtctgtgtgtctctatcatgtccacatcttcctgtcgctttctgtctccctctctcggcactatcttcatctctccatcgcagcgtctccagccctatttccacccctcctttcccccggcctgccttattaaaatcgcagccaggaaaccgagcagttcggggaggtgtgatgctgaaaaccagcttccgcgcgacgccgggtcggagcccgcgaggggtgccgggggggacagcccagggtgcggcttctgtcccgacccagtcgccgctcccgggggctcccgcccggagagcaccctccggccccagcccgacccctgagctccccctgcccgcttagaaaggaactctgaccgccaccggagagggcgtttgcccgagccaggagtccgagaggggtggaaagttctcacctatggtgaagctgtagccatcgatgctgaaagtggcgctccggcattttttgaagccctccttcctgttgccggcgtccgtcatggctcggccggccgggcaggggcctcgcagcgagac

SEQ ID NO: 57 - DNA, 281220 bp, Homo sapiens
tgtattacagaagtgggaaaaaaagcataagaacaattttaagtctgaaaggaaattggagaaaacaaatgttcctgactcaggaaaggaaccagagactggaatcatcatctttgcggtgatgaatgtcagcatggctgtatcatcagtagccagtgcaaaaatgacaacatttaaagtaacggcattgacagtcataaaatggcaattactgtgtgtgtggcttttttcaggcctctcccagcatatccaggatgtccattctcatcaggccagacagatgccttgaaagccaggtcattagcaaaggattttgaggatgccccttcatgttttgtttctgtttgagtaaaaatctcacgttgtttgttttgctcaggggaatatcccccagagttctaagacctcaaaccaacccccaaagattcatcccctggaaggagatggtgtgagggaaggccaagggtcagggggtggggggcttgtgtttgaaagttgtacaccttctccagatatgggtctttgtggaagaaggagaagaaggagaatgaagaagctcagctagaatgatgcaagacactggcagcctcttttattgtctatgaggtcttttttactcttgtgaatctgaaaaaaagaaaaagaaaaagaaaagtgtcaatgctgcctttccccccgcccacctccaccctccaagtctgaggagaaggaaatctaggggaccaaaaaaaatgggataaccaattaaacatttccatactggtcattgctgtctcccttgtaacaagatttgttctattcataaggggaaaatgtcagtgcaaaactgtaatatcagtacatttgaaatcttaatagttgctgtaaactagattagcaaacatttggtcatgcagtagggatattaagccaccttcttttgcaatggagatgacggttttgttgccagatctggtcaatctgtctcaagggtcagtgggattggaagaaatcagattcatctaatcccaactgttttcatatcaaaagcaatactcctccctctcagaattcttgccccaccctcagaagtttcccagagacatttaaagcaagatgtatcctagcccaaatcattttgcagatgggtgaatcacctgagttctccactggacccagagcaagggggtggaggaagacgacaaagatggaaaaaggactaggttaatgacaatagacaatattgtatttcttttcaactggcatgctctaccccatgtaacctcaaaggtcttaggcagaatttaaaacaacaaccacaacaaacccaccatattatttcttccaattggtgttgcatgctctgcaagtcatcatgccttatagttagaaagtgttcccttctatgcagggctccagttggcttggactttaagaagggtaacactattatctacagagatgttagaagcctttacaggacaaggaaagtttcccattcaactttaaagactaagatactctcctaagatttaggtgaatttagcagaaaactcattgggagataggagaactccttctgatctattgtaattacagtcaattctcaattttccaggggccattgatccaagcttcctgctgttcctctaactttattatgttcttgattgttcattatgtttaccctccattaacaccttcacccatttgagagaaataacagacaaaagtgaggcttcataccaatcactttactccaatactagcactgataaacttgccagtgagagaaggaggtgaaacaaaagctgaaatcaaggatgagaaattttccattgatgttgatagtctatgcacagtttggtccacatggaattgcaatacatgactttgtccttagtactctgaccctgccattatcaacttgggatcatacgtcatgaggcttcttttagagagtcatcataatactaaccaccttcagagatgtccccagaccctcaaatgtaaagcccaattttgttaggatgacagaaggttgggtttgattttttaataacagacccattggttggaaggaagctagagacagatagctggggacagctgataaagaccactatttaactcagtgagcctcacctggccaacaaggagaatgatgcacctcctgcagactgggttagcagagacccacggtccagactgctgggtcccagagatggaaagaggcctatctagggtcttaatgaaatccaaaggctgctaaaacgagatattcctccatttctaatcactgcttatgggtgagatggtggagtgttccctctggctgtggatctccatcctcccctccagctttgtgtcaaggggtgaagggaaagggtgaataaaagaagtttgtgtgtttaagctgtgcctgtgttcattgtcattaaataccaccagcagtaaaagaacaagaagcatatgttctatagctgggtctgtgacgtgatgacctgagtcatcatccctggccttcccaaacacatgccctctaaaagtaacttctgtttgtgaatttcttaagtcacttaagaaataccctaaggtccctatatcatagctacctgcaaaataatgttccaacccagactgctgactctttgagaacagggaaaacacctcatttatcgtttataacacttcttgcatgtagtgcaatgcctgacacatagcatatgctcaacaatatttttaatgaaaaagaagagaattgaataagcatgaggaggatgggactgataaggtgtggtgatgaataggaggtttccctccaccctttttctaattttgactttcacagcatgaaacaaaaatttaaaagaaaataataaacacaccaattatatattttattcaatagtaaggtatgatatgtcaaaatatttacattccctatgaagaaacccaattatggatggctttctatggagctaatctcacagagaaggagcacctgctatccaggcagctttggcatggtttgcaaatcaggcctggtcctcttttcactccacatcctatctttcattgtgttctggttttatgtatttgttttcaatataaactgaaattcagtaagcatcagcaagactacaaagtatatgaaaatgaggaccctgaagacaaagtgttaataggccactctgtgtgtaactgagatgcatgactttttgaaggccacaaaaagtagttaaatccttccactttttaaagagtgactgatgaattgaaatggaaactttcttgccacatcttggaataattcaggaaactatttaagtgcctgccccttgacccaagactttttatacctcacaaggtaaagctgtgagaactttaaatcctgaagtgcaaatacatggtatatgaattcacagaaatgtatttactctataggagcatacaatcatgtttcagcaacttcatttagaaaaatgggagacggacttaaaacaatgtggccttatttatggtaccatgctgctcccaaaggtaagtgcagatgctgtatataggtcttaaaaccatgtgatttaaagataattggttttagaagaagattgaagttcaatttaacatgacttgattctaaagatgtgtttatccattataatgtttattcctggatcacaaatggagtgtcaatgaggcagccctcataagaatttgccactgggcttaaaaaatattttaaatgcatttctcttccatttttcttggatttgatgtttttacagcctgattcaactatcacctaaactcaaagaagtaagttgacttggctgaagagagagatggggttcaaaaccagattttcaggtcctaggaactctgtaccatagctgcctccctatggagtcaactttctgcaaaaacagcaaagtgatacagcacacacctgacaagttataaaactctaaatagaaaaaaacgaatgaagaataagtgtagagaaaccaaaaccaatttgaaatgtcatgtaagacttctattgggcatatgaatgggtcctcgttttttttttttttaaataagaagaaaacattaagaaaaaacaattttaaagtatctgttaggctttatccaggtatggacttaattgtcctaggtcacaagtacatgacagctattttaaagcgttattttcaacatgtgcatgctttctccttgccctaaataatagagcatattattataataggattatattttcactacaaataatatccatgctacagcactgctaagacaaaatcctctcatcatgtattattccagcacagaaaaataaaacagaaggacagatagacagacacatagataaaccagatagatagatagatagatagatagatagatagatagatagatagatagatagacagacagacagacagacagacagacagacagacagacagacagacagatagatagacagatagatgggcaggcgggcaggcaggcaggcagacagacagacagacagacagaagacatttgtgggaatgtaacttcttaaaaccttgcctatgccattaactcctaaaatttacccatttgatccaaacacacagaataagaacagtacaaagaacagttagtttagtgcaaaagtaattgcggtctttaccattactttcaatggcaaaaaccccatttacttttgcagcaatctaatagttcttaggtccaaccctttccctctttgtctttccttttgctccactgcatctgtgctaccactgaaaataacaatgatgttaaactcttcctctctacccttgttgctttctctctttcatttagcatgttctttctttccaaacataaaatatgtgaacaactgtctctgttcttctgtctcacactgcccaaggtgtcttactgctatcatgctctgttttaagaatgtagcacattaacacaaagacaatgattaaaacactgaactctctaaatgcccccaatgcctggcccacttttagcagacaagtaaaagtcaggcatcagtaactcctacaactcctctgatgataagtcaacatccctgattcacagaggtgcaggtgagggtagagttaagcacccttgtctgcacaaaagagtttagtttctgatcagtctttgaatctgtgaagtcaggaagaagcccaggaccgtaaagaaagtccttcagatcagtaagtgaggcttggattttagacatgaaacattctgactactcttcatgtttttctcaattttattatttcaggaaaagcagaaaagattctaaatgatgagaaaaccaaacaaacaatcattttctcatgttttcactatggctccagggcatagaataaaaatagcatatattgcagcggactaatacttaagaaatgtagacatggtcacttggagagcaggatgcccatcagtggagaatgctaagaaaaaatgcaaagaggggaagcttgaatacttgctgaatactgcatttaatagcttttttagcatgtgagcgtctagaaaagaaatggcattaccaatgtagatagtgttaagttctgcctttggcacatatttacttcaaaggttccctttattttaaatatttaaatataatgttaatagagtttcttttggcaaatatattgttacttgtgtttctccaatcccttgcatagaatctgacaaaatatcatttttttccaggagaaaatatttatttcatgattactaagaagctttattttaaacatcttgaacatcagtattaaggaaaaaagaaaaatcacaccttgccccgtagttacaaaattttaattccctctgtcaaaccagattcctttaaaaatacagtggtacattagtagttccacaaagtatctagaagacagagtgaaacaatgaaagcttatgtagcaataattgcaaaagaaaagttgttcagaaagtctaattttatcattaacaaagagttcataatatacttttatttgacatttctactatggagttacttggtaagagactgggatctaaacacctacataaaaaacatgaattgatgttagaagtttcccttagtataacacaatttatttaaacccatcaatctcatataatatataatataatccacatattatggattggttaatagatattccccaaattcataaaataaaaccaattatgttgggttaaaacatcactgaattaataataactctcatggttgggtcaacctacagcacagcttccaaaattaagtacaaaatgacaatgaagtatctaaatcaaaatgtttaatcgaaaaaaccttttagagtttaattagtgaagttttaaccagatgcatgagaataacagacacctaaaaataatattacaattctctcctccacttattgactttttgttttccttggacagggacatatatatatctatatacacacacatatatatatatgtatatgtatatatgatttaagatgtatgtaatatagtttatcatagagggtatatattatgtatatatgatatatattaatatatcttacatgttatatgtcatatatgcatcatatatcagatatatcatattgtatcatatatcatatgtatgatttatgtatgtgtgtacatatatatgtgtatgtgtacataagtgtgtgtgtaatttcagttgctattttcatactacaaacatgaatttccagacacaaaaatctgcaagaagacaatggtagtcacctgccatcttgttcctttataattcctttatattcattatataccatccttgaaaagcacaaggacattcactgaacctaaaagtatataaaaaatgcattgatttgaaatggacgtttattaccaaaagcgctaactgttctgattcactatgactcagatgaaatgctagaaccatgaataagtaacaggttttgtacgtccatgctcccaagactaaaagtccatagcaaaaaaggaacaaggtgctttttcaggttaacaccgtttggccacttcccactcacatattatggattggttaatagattttccccaaatctataaaaaaaaccaattacgttgggtttaagcatcactgaattcacagtagctcttattgttgggtcaccctacagcacagcttccaaatttaattacaaaatgacagtgaagtatctaaatcaaaatgtttaatcaaaaaaaccttttagggtttaattagtgaagttttacccagattcatgagaaaaacagacacctaaaaataatattacaactctctcctccatttattgactttttgttgttttccttgggcagggacattggagtggagagtttagatacttgtcaaactacttgagaaaataaggttgtaactgctttagaaaacacctgctaaaccatggcatttccttactattaatgttccacatgacataaatatgttaaggaaatgggtcacaggagttttcatggacaaatggctaagggaaatgggatattagtcagaatttgtgttcttatgacgacttaattggaacccaaagcactccagatatttggtccctctttgctcatgaaaaataacctacgcagatgctggattctcatgctgaaagcaattccttcattaaagaaatgtctactttttgtcactacatagaaggctgcagtgggataccttcctagacctaagaaatattatcctttgagacagaaacaagtttaaaacctaaaggatgggattaactatatgtataaactgcctcaaaatagcagattttgacttcagtggcatgaccactagtgaagtatattacaaatgattcattactaaaaacagttaagcactgaagttataaagggttaatttttaaggtaagtagaagagattcaaagttattgctatggcaacactatcttgggtgtgagagaaaaggatggggtaacagcttgtcttcccaattcacattccttggcctattttacacatcacatgatctgggcacaccttcagaggggtgtagagctagtgaaaatctggtagtctaaagtggacaaaaaataatgaggaaaaaaaatcgagaacatctaccttaaaaacaacgcagtatcgtcaagattaaggcccagaaaagcaatcaaggatgactgaaagtgaacaagaataataatctactccaagatattaacacatctcatggctgaattaatgtgtggctaaaaaacaggcaagaaaaggggtgccatagaggggtgcctcttgcactgtcaggatatagcacatgcaagatgacccatatccactcttcttggcagctccgtcccaatgatagaaacagatttcaagatattctaccttaagatcacaattcatcaactaagtccccttacatgttcagttcaccaagcaaccttctgatacaatttgactttccaagtaagttttccttcaagaagaaaccaccaactggccagttgacatgaggatcccagcatatgtggagtatatatttcacattgtacatcagtaaactgtcagtcaaaactacgcactggtcacaagtattcatttcagtgtcaacaaatcctctccagcataatcaactcttcctttactgtcaatatggaattccttgttctgccattgtgtagagctcttctagctaatcagcagcctctctttctaatcatcacatatcccgagctcccagatgaaggaattttgtgtttcccaaatgagaccattcttatataaagaacaaaatgatgaatggcaaagtaaatttcactaaaaagtcctatgtcaagaattctcaaaatgccaaacattttctatgacttatgtgtagtgacgcaacataaactagagtagaagtctgaacaaaaatggtcactaagaccaccatcctctaagaatggtaaatccattagaatttggtcaaaaatcatatcaacagttccttagaaacaaatagatctttcagaaattgagaaaaatattaaaggaattacaaaattctccataacatcttctatatcaagggggtataagattcattcaaatatgagtgtgctgaagacaagtaagtgtgttcaagtgttgctatggctctgcatggaccaatgcatagccagtgtcaactacaagtgataacacgaagccctgtgggaagaaatagcagagattggaaaactaaggtgataaaatgaaacatcaaccaaaagaaaggttttgaggtgtctaaaatagggcagttctttattctggcatataaagacaatccaaaactatcgtcctaagtagtatggggacattttttttttggaagaaagaataacgtgagtatgattccttgagatgagaaaactggaatacaggtgtccatgccagtaagaaaactgataatgccctcagggtccgtataaccagtgaatgcacacctgctgaataaaggtcatgtgacaaagcatttattgtttctcaaatctctggaaatgaacctaagacagaaacaatctctagtaaagacatacatgtgtcagttctacccacagcctgctgtttgactcttttctccccagatctgcaaagcagggcatacctccacatctgtacaggcccctcctatctttcactaccagcttcattgaagagcaggtcatgatgcctcaccctataggcaactaacatttttcaaaatatgaacatgatgaaaattaaataccactcaagtgtaaagttgtattcttctgctgttttcattaatggcttggcaaatcaattcaaatagaacaaaagatgccttaaaagctcagagtcatccattccaaattcatttatgtactccatttcaaactaacttgttaggaatcatctattttttaaaaaattaaaaaagaaaaaaacagaaaaaacacatacatttcttcaggtgaccactgtgagccatgtagcaagtcaaggtcatgagacaacagccttgtgaagaattatataatgtagatatgattagaggcaaattcctataatgtacgcaataacccttttgatcacagttatttgttctatgcaaactaacaagaatactggctaccctgcctcctccattttttctgtactaagattctaaataggagaatatgattatcttgagaaatattcagaaagaatggttgtaagaaatacaatttcctcattgagaaaacaaactgacaaagctgtgtcctgacagccacagtgaaatgcagagctaagaaattattatgtggatgtaatatacatatcccctcatacaagctttgttttatcttaatatggttttaaatttggcttttaattttcacatccttaatgatgtcaaggatcttttaatgtgcttatttgctagttgtatatcttctctagtgaaaagtttgttcaattttttgtatgtttttaattgggtcgttttcttattatttaatactgagtatctatatttaatgaatatcagttatttaacaaatatatgttttgcaaatatccccccagaatgtgaactgcctttttattctcctaatagaggcttttgataaagcataatttatcaatttgttttttatggtttgtacttttgtggtcatgcctaataaatctttgcttaacccaagatcaaaaagagtttctcttatattttcttaactagaaactgatagttttacattttacatttagctttatgataaattttgagatgtcgcttgtatgtgatgtatagttagaaattccttattttgcatatgacatttcaagcagtcatcatcatttgttgatgactatcattttcccttggaattgtctttgccctttattaaaaataaatagtccatacacatgtagatctatttttggagtatctaagctattctgttgatctgttggtctgtgttgatgccaataccatgctgccttagttaccatagctttatagtaagtcttgaaatcaaaccttctctgtagtcctccaactttttcctttttcaaagttgctttgtctattctggatgttttgtatttccatatgaattttagaatcagcttgtcaatttctaccaaaaaaaagcatactaggattttaattgagattgtattgaacctatagatcaacatgggaagaatttacatgtcacctgtctctggaaaatccccaaatatttggaaattaaacattacacttctaaataactcttaggtcaatgtagataccaaatggaaattagaaagtattttgagctgaatgtgaatgaaaatgcagcatatcagagtttggatcatgatgctaaagcagtacttaagaaaatctacaccactaaatgcctacattaaaaaagaaaaaaaaatctcaaatcggtaaccatgactttcaccttaagaaactatgagacaaagtaaacccaatagcaagcagaagaaaggaaataataaagatggatattaataaaatagaaaacagaaaaacaatagaaaatattaatggtgatgattaataaaatatattaacctttagccatgcagatcagggaaaaagagagaaaacacaaactacgcatataaaaaatgagagtgataacattattaaaaattctacagatattaaaagaataataacataatacaaacatcctttcaatttaattctatcatggtccatgaacatatttgtttgccttgaatccttttgaatttattgggactaatttattctcccagaatatagtctatctttttaaatattctgtatgcacttgaaaaagatgtgtattcttctatggttgggtattctaggaatgccaattatgtcaagttgattgacagtgttgtagaagtctttgtttccttgctgattttcatatctacttagtctattaattattgagaaagagataataatgtctccaaataaattgtgaattaaaaatgtttttgtagtttgtttcaagtatttggtgcataaatgtaaaaaatgattatattctcttgataaacagacaacattatcattatgaaatgaacttctttattgctgaaacttctttattcctgtctttgttctgatatctactgtcatatattaatatagccaccaggctttcttttgattagtgttaagacagtataccaatttaaaaccttttacttttgtgctgtttgtgtccttttttgattgtttttgtttttatttgtatatgtttatgcgatacaagtgtaattttgttgcattaatatgtttaatagtggtgaagtcaggaattttatatttgtgtctttttgtataaaggcataatatatttgaatattacaatctcacaatctctgccttttaattaaggcacttaagtcatttatatttaacgtgataactgatttgctttgttttaattctgtgatcttcctatttgttttctatttgtctcacctgttctttgttcccttcttactctttttctaccttgttctggattaattattttatgatttcattttatctgttgctggctaatcagctatatatctttgttttgttgttttagtgattgctttagagtttataatatatatgctcttaatttacctcaatcctccaatgattttataacacctcatgcatgatactgaaccttacaatagatatcccatttctcccctactggactttttgctactgtagtcatatatttcatttttgtatatgttataaaataaacagtacatttatattattttgtttacctagtcaattatcattaacataaattagaaaaatcgtatatatttacctatgtagttgccatttttaatgcttttcattcttttgtacagatctatattttcatacggcataattatccttcacctttccttaaaatttcttgcatggtgcgtctactggtgatgaattcattaagtttttgtatgtctgatgaaaacatcttaatcacatcttggtttctgaaaaatatttttgctaggcacagaattctttgttgattttttttcctttcattaattaaaaaatttagctccactgtcttatttgcattgttccccacaagacatctactgtcatccttatgtttgtttgtctgtacatatgtgtaatttttctctggcagtttttaaatttttctcttcatcactggttttgagcaatctgactatagtatgcttttgtgcagttttccttatattccctgtgcttgagatgtattgagcttcttgaatctgtggatttatagttttcatcatctgacaaaattatagcccctgatttttcaaatatttttcctcctctctcctctacctggggattccaagtacacatttattaggctatttgaaggtgtcctacaattctgtttttattctttttttctatttccttttgggtagtttctattgctatcgttttgctactcttttcctctccgaagtctaattccatccagtgtactcaccattaatctcatctaatgttattctgtcaataccatcaatcacatttctcatatcagatattgtagttttcatatttagaagtttgattttagtcttttaaaaagatcttccatgtgtctacttctgaacatatgggctacagttataagaactgcttttatgtatttgtctgctaattctaacatctgtttcagttctgcattggtttcaattggttgggctttttctttttattattattattattattatactttaagttttagggtacatgtgcacaacgtgcaggtttgttacatatgtatacctgtgccatgttggtgtgctgcacccattaactcgtcgtttagcattaggtatatctcctaatgctatccctcccccaaccccacaacagtccccggtgtgtgatgttccccttcctgtgtccatgtgttctcattgttcaattcccacctatgagtgagaacatgcggtgtttcattttttgtccttgcgacagtttgctgagaatgatggtttccagtttcatccatgtccctacaaaggacatgaacgcatcattttttatggctgcatagtattccatggtgtatatgtgccacattttcttaattcagtctatcgttgttggacatttaggttggttccaagtctttgctattgtgaatagtgctgctataaacattcgtgagcgtgtgtctttatagcagcatgatttataatcctttgggtatatacccagtaatgggatggctgggtcaaatggtatttctagttctagctccctaaggaattgccacactgacttccacaatggttgagctagtttacagtctggttgggctttttctttattgtgggtagtgttttcttgctgcattgcatgcctggtaattttttattggatgccaaacattgtgaatttcaccttgttgggtgctggatatttttgtactctatgtatatccttgagctttattctgggatgcagttaaattactttgagacattttgatcccttttatgtcttgcttttaagattgttagatagaaccagagcagcatataggctacagcttattattccccatgactaaagcaagacaaatatgagtcttttacctaattttctttaaataatgagatatataaatctggctagtgggaataggcacttttccctgacttgtgtgagcatcaggactgttccctctaatcctcttggatggttctgttctggcctcaggtagtttcctcattgcatgggttgctcagtgtagtagtttccctttacacacagaggatattttctaagactcccaggggatgtctaaaacctcagatagtgctgaaacctatatgtattacacacacatttcttttttcttcttcacaattgcattgatagaagatttcattcttagcatagatcttagcagcctcagtataattttttttctttctttattaagtcaagaactttcgtctttttacttaaaagaagtactttgtggcttctctttggcatatgtgaattgccaacatctccattcttttgctttggaaccattgttaagtaatataaaggtacttaattgcaagcactgtgatacttcaacagtcaatctgataaacgaggtggctattaagtgacaggtgggtagtaagtagaaccagtacagtgcggataatgctggacaaagagatgattcacatcctaggtggaatagagcagtgatatggttggctgtgtccccacccaaatctcatcttgaatcatagatcccataacccccatgtgtcatgggagggaccctcggggaggtaattgcattatggggatgagtttttctcatgatagtaaataagtctcacgagatgtgatgattttataatgggcagttcccctgcacacactttcttgtctgccaccacgtaagatgtgcctttgctcctcctttgccttccaccatgactatgaggcctcctcaaccatgtggaactgtgagtccattaaacttctctttcctttataaattacccagtttggggtatgtctttattagcggcctgaggacagactaatacaagcaggatggcatgagatttcatcacattctcagaatggtgtgcaatttaaaacttataattgttgatttctggaattttccacttaatattttcagaccacagttggctatgggtaattaaaaccacagaaagtgaaactgacaataagggagtactattgtactcttatattcttcagacctctagagtttatctctctgtaatcctcttctctccagtattttattctgttaactaaagccatcttggtcttcctggatttttattcaacttctcaactcagagagtcactgagatgtgcctatgtcactcctctctatgctgtctggaagtactctcaatggctatgggtaattgaaaccacagaaagtgaaactgctagtaagggagtactactgtactcttatattcttcagaactctagagtttatctctctgtaatcctcttctctccagtatttttcctgttaactaaagccatcttggtcttcttggatttttatccaacttcttaactcagagagtcactgagacgtgcctatgtcactcctctctatgctgcctggaagtcctctcaaggcagtaagctgagacaatcgtagggctcatttcatttatttcctggctcccaaagatcactgttctccatttcctgatgtctggtatcttaaaaagcactcttccacatatgctgtctggggttttgggttgtttcaggtgggagggtaaatccagttcttgttacttatctttggcaaaagaagacattcatagactgtcttgccgaccctttccactcttcataactcacttttcagtttcatgagaccatccataaacattccagttaccaggatattcaataaaggagaaactcctgctgaattccctccctaagacttggtttataaccacgcagggcctaatcataatctgttgtttgagaggcacaaaagatggctatctcttatttctctgttaatgtgatcaagtaaagttaacggcaagtttgtatttctggatagctataataaattatggcaagtccatgaggctatgttattacaaacatgactaaaaatgcactgaaaagagtatatttgtgtggtaacccacaaatcttccgatgccaatggaaaagtttaaagatgattagaatcttggctcagagacctggatctttttatgtcaatacatttctccctaggggtaagtaaggtactttcaaaggacatccattctttgaagtcagttagaaaattactgctgcaaggtatgaaatagtactgcagtagacttacagagataatgtacagctgcaatgtgttcattatgccaggatgtaatttacctttcagcacatactacttccccctgtgcatgccctggctcatgggagtttgggaatagccaactgtgattcagtttccactgggtttctctctcaatgttcacattgggcatgaattgtacccagatactccctctcaaatattaaagagaactagtcaccaatggttcccagggattggtctaggggtagggacattaaaaattgttaaattgactcccactcattacctgacataataggatccaaaaagaaatgttcaaaaatgtatccagttttttctacatagttttaaaaacaatcaatatatctcctgatctacatatttcctttttaaatttttctgaagtagagagctttaatgaccaaaaagaaaaggataggtgggactcatcaaattgctttccacttcctgccaccaagaattagctttagtcctgttaaaggttttggactaaaatagtgcaagtcactgaagctcaatgctctaagttctattgataccaaagcagtaatgatgtcatattagtccatcaatgaatataaaatgcaaagttgttcatgattatgtttgtgtgcaaacttccaagtatacagacacaccaggacctacttgaggaagtggaagaacaggctatggagggaaacagagacagacattaaaaaatgtctcttttatttatagcagtctgcttactgccccatgagatccagaatcctgctcattaaacaatcaaactttacacttatttgcacaatagaacataaaatctattttatcacttcccccctccccccaaaaaaacctgtttaattcttttaaatacttgggtatgattcagttacaaagggcgcagttaaaaaggctttatgaaggtgataaaatataatccacaatgcccacatgacatcattatagcagatgtttgtaccacaatatacaaatgcaacaagattcaaaatggcatacgaaaaatttgggacttgatttattctgggcttttatgctatagaaatttaacaggaagctgtgggccaatagttggatacaggatggagaaagtgtctgggttctgggtttgaagttgacagcgttcctccactgtacattttctggctttggttgccttgatttggtattgatggctggcaaagagcctctggtatttaaacaaaccttacctataatagagtctggctcagagactgtcattctaaattctattttgttctgtgtaatttacttcttagtcacaattattcaagaagggtacactcattaggtaagtgatttccatttgcataagcacattggtaaaaaaaaaaaaattgcaggtatgtgttccccaggtattatgtaataagacacctggagttaattatttgcattgtctttttagaaaaagtttgagaacggttttcatgcatgcaagcaaagacagcatgtcataacagcttagggctgaaagctaaaggggctgcttcctttataatagatgtgcaaagaattacgttccaatttattcttactcttccacctggttacccagcatttgttcttcaaaggtattctaaccaaatgattcaaagaagagtttagcatcaaatatgatgtctccagggaggtatgatttagagagtctgggattctctcaaaaaccactccgtggaaactttaatttttagcttaatatgatgtctgtgtatgaggggataactagtaatgaacctgtgtgatagctgaaacaatgaagtttatgtaaaaggccagggcaggtgtttcaatcttatagttcaaagtgtgaagggtaatataatttgaactttcaggttttagaaacagtaaaatgttgttaatcttgcgttttgcattgtcattgcctttaggacttgttcttgctggcaaaactgtattttacaaccatatatgctgcctcccaacattagcactataaagacccctgtttttgtttttgttttaaacaaaaataagaactagttcaaggaaaaaaaacatgaaaacataaaacatggaacatttcttatttatgctgcatgattccccatcaaaaaacttataaatacattagcagtatatgatactccattctagctgtctgatcagcaagtctaaaataaactttttatgatgtttaagatgaaaaatggcaagtaggaaaagaaagggtatagaaaacatttgtgatggagaaagtggggtgaaggggaagagatacagcaataatttataaattattgataaagggataatagtaccctttaaatatagtgaagggtttttttcaggatataagaatatattcacaaccactatttcaattttgggtatgattctaacaagcttacattaaactgcacattttatggaaaaatgtaatgagaataatactcttaccatctgttttctttgaatcatttccgatgttagagtgatccttcttgtctgtcttatttttaccatctttgaagtcacctgaaagtaataaacatgacaaacagtatatgtatgcagctgagggggttgttataaacatctttaagtctgccaagttttgaaaaagtgcagcataattttatagtcataagagtgtatgtgtctgagtgtaaatatcttttgtaatcacgttaggtcctggaaattggattgtgatgcagaaattgaggctgaaagttcttgttaaacagagttgtagttaagttatgtgcttatcttctaagagaagcagttaagatttactgttaagctgtggagtgaggagaaacccgagctaactgtaagttctaccaattaatagctatttaacttctctgtgcttcagttttcctatctgtaaaatgggtatgttaatacctaccttataggcattttggataaattagaaggcatatcactcaatacagttattattattctaaaacagagctagaaatggtattttaataaatgatcttgtcaaaatgtagtttgtaaaagttgtaaaatgctattcttagaacacgtgtcaaaaatgtatttaacccacttatgagggaatagtaagaggattccaagagtactggagctgggtattgacaggtattttagaaacacgtgaaaatatatttgctaagttagagacaaaactgggtatatcctacagggcaataaaaccataacgtttggggttatcttctctctcagtcaaaaatctataaattagcatataacttcacagtacctaggcttgaatcaaatagtaagtaaagttaaacacagtcatgttcttcaagagtagcattcagcaaattaaggcccctgggtcaatggtgcccaccatcgattatggcaaatacattttcttgaaacatggccacacttactcatttacctattgtccttggctgctctcatgctgcaacagctgagctgaatagttgcaaagagacaggcaaagccagaaatattttctctctggttctttacagtataacagtgctgcatccctatctaaaataatttaataatccctgggcatgtgtgttcaacaatatgccagtattacatgaaaaggtcaggggcctcttcacccagccttattttcaagtgttggatattttcttaccagtcttactaatggaagctttctttttagcctgcataaaaccaagaacacattctcactcaaatactggtacttattgaagccaaaagatcccaataataattggagtgagctgggcctccagggaatgtgtatgagggacaggatttactcttgtttactttatttgtgccaggcagtatgctaaatgctttgcatgcatcattttattaaatcttctaatagccccattatgaaggggctactattattgaaagtagacaacttcatcaaagattcattcactaaatgtccaatttgtaaaatttgctgaatatcccactcaccaaatgattgaggatgttttccaaatttaagtttttttcttgaggttcctgcagccagttagacaaacacaggccattccatctatgttaaggggtatggactgcccacacatacatttcataccccaccctgaactcacatctgccacaaccatgcacctggatctccctcttggcataactgccaagccctcaactatagtatttgcaacttctctatgaagttcaagttttagatttcagacttctgtttactatttccatttctaaatgcctttggcctatgaatttataaagaactgattatctaagcatgattcaggactattgggggctgtaatatattctacaaaccacatacttgcaatggaatttgacaaatactaagctaagctagaagtcaataaactcttcaggttccctctcattcttaattctgaaatgggatggaccgtgatatggtttggctgtgtccccaccaaaatctcatctttaattttacctcccataattcccatgtgttgtgggaggaacccagtggaagagaattgaatcatgggggcagtttcccccatactgttcttgtggtaatgaataagtctcacgaggtctggtggcttcataaggaaaaaccgcttttgcttggttctcattctttcttgccaccaccatgtaagatgtgcctttcaccttccaccatgattgtgaagcctccccagccacgtggaactgtgagtccattaagcttcttttcctttataaatgacccagtcttgggtatgtctttatcagcagtgtgaaaacagactaatacacactaggtggaagaattgaggagcaggggagtctactctggccagggtccaaacaggaggattttaagtgcaggacatggtcatcacctcttccaccaccaaaagagaagaaatccttcagaggtcccacaaaacagtccaaatactggcttttccctattttaatgaagccagagatggactcaaggatcttgagcactgtagtcaaactagttccttctagttcattcttccctcaatgagcccccacactcttaatgcatgctttttaagccctctaggttgctctgaactggagctttacccacagctacagcaacaccaggatgtcttctggaagtcgtggagatggttccctttgctggttgctaaccagcagcccatgatggttcctgttctcagccagggatggggaggctgtgggaggaagtcatctcaacagagggcaaagattagaagatcctgtcactgccagtgggtgcccaaaccttgaaaacccctccttcaccaacaaccttcagctctaacttggaagatatcctgggcactccacaaagaagggggctgggacagtgacacatgcttgtttgatgatgttgcctgagcaaaatccattaagtaatttcccatgggttgtatctggagtaatggctgacgtgagctgttactcaataaacaaggggaagtgaaagagactttctgtgcagttataaatcattttaattaggctgctgtaatatagtcccgaaccaccattaggctttcttattattgctctaaactgctttcttttcccacctctcatttactgcttactttttaagggaaatggtagactgttgcttatttcaggaaataagcacagttgtgaaatcaagccagccttgttgaagactcaggttcctgttttgtttctttcaggctttccccttaaccaacttcaaaatgaattattatttccacatctgccctctctgggtctttgtttccctatggtagaattcatatccttctttgtgactagcttatttgcatttattggtttctcccactgactagacctggggttggcaaactatggcccatgggtcaaacctggccctactgcctggtttttcatgacccacaaactaagaatggcttttacatttttaaatggttaaaagaagacaaatattttatgacatatgatattatgtagaattcaaattttaatttctataaataaagttttattggaaaacaggataactcatttgtttgtatattatctgtggctgctttaaaatggcaatgttgagtagttgcaatagagaccttatgttctgcaaagcctaaaatatttactatcttgtcccttatagaaaaagcatgccaatccctggaataagtatattgtaagcctcttataaacagcagttaagtttccatatttctctgatggcccctctccctgaaggcaccaaaccacagggacaagctgtttacctaacagagcattgagactcacacagatcagagtttaacctgagatctctacttaatggttgcttgactttacacaagtgatttcacttctctgagactcagtattcccacccacaacatgggaatgagtttttctacctcatagaattgttagaacttttacatgatttaatgtagatagaatctcaagtacaatgtctgatacatgttaagcattcaataaaatggtggtattattgttattgcttttactaagggcaagacatttctaacccactctgttaaaagaaaaagcagagggaagaaacacaccttgcctttctcaccaccccttacatgttcctcttttgagaggagtgattatttatctgggaggtagggttgagcatgcacagcccggcccagccacccacatcccagactgctttgagatatgttttctgtaagacacacaccttttctgtcactctagaagcagcctgccagggtgctggggtgggggaaaagtcctgtgcctggctatacagtgtctggttgtgtaaattcatttcagagcaaaatgtaaagaagcccatgtattcagcagaccaactctgtgtttcccaagttccagttttagtggagctgatgtcttgatcattgactttctgattttgttacctatctctcagttggttcagtcctcagaaggggtagcaaggaggggcctgtactgccctctaaaacagtaacaggtacataataaatttttgttttaaaaaatttttgtatgaacatatgtttttattttttttaatttttatttccataggtttttggggaaaagatggtgtttggttatataagtaagttatttagtggtgatttgtgagattttggtatagccatcacctgagcggtatacgctgaacccaatttgtagtcttttatccctcacacccctcccaccctttcccctgagtccccaaagtccactgtatcattcttatatttttgcatcctcatagcttagttcccacttatgtgtgagaatatacaatgtttggttttccattcctgagttaattcacttagaataatggtctccaattccatccaggttgctgcaaatgccattatttcattcctttttatggctgaatagtattccatcgtgtgtgtgtgtgtgtgtgtatacatatatatgtacacacacgcacgcgtgcatatatatgtacacacacacacacacacacatatatcacaatttctttatccattcatggattgatgggcatttgggctggttgcatatttttgcaatagtgaattgtgctgctataaacatgtatgtgcaagtatctttttcatatgacttcttttcctctgggtagatacccaggagtgggattgctggatcaaatggtagtttgggtacatgaaaaattcttattaaattctttataacttttttttccagactataatgcacttgaatacaaagcaaatgaattaagagcaatctccagaagggggcaggacgagtcgggacaatggccttctgtgcctcctagggtggtcaccaggattaactgaagtaatttttgcaaggttcctggaatatgatataagctatcattattattacatgtgttaaaatattgttctctgattacatgttataaatggttaattataaaaataattggagaacatcgtgctaagcactttctacatgtagaaatcattgaccacggccctgtggcataatagctagaacacggttctgagtagattacctggtcgcaccaggcaggcaagagaatgaatatgtacaaagagaacttaaaacagcatctagtgtgcagtcaatacatgctatttgttgttattctcttcactgtttttactatcatgagtattactgaaggttccatgaggcctgtgctgtgaataggtattactatatacattgtgtagaaacagtagaaggttaagtagcctggccaaggacactgaaaagggagaagcacagcttgacttgaatctaggtctgttgactgctaaattaccttgctattcagccacaacctgtcaattgcaagctctggagactcagaacttcctgcctgcccctaaacaaggaaaccaaatcaaagccctgtgtacttgctcatcttgttctctccactcagaagtatctttagcccatctgaccagccagcttcagcattcaaaaccccctcttgaagcctactctgacatttaccccattttataatccccagtccccaaaaagctaatgtgtttttctctgcacatgttcctcgggcattttatctgccatgtcactactttcacttgcacatttcactagaaatatttggaggatgtctctatcacctttgatattttgggcttcttgtggcctttccatttctaaatccctagtgctaagcatggtgcttggcacgtagttgttaatcgatatttgttgcattaaatataagaaatcaataactatatgcacactatggtgaccagcttaccccagtttgcctggagctcttctgtttttaaaacagaaagctctgtgtctcccagtcccaggtaaactgaaacagctggtccccctaaagtacacacttgtacacacacagatatacagatatctattacaggaaaaggctcaggcaaacctgaggtctggccctcatagagcgatggtatatatgggaaaatgactttccatttacccactttacactcaggaatgtgctggggttgatcatggtaattttcccccagctggcaggcaggcaggcactggctagagtctccagggcagctggaaatggccagaaaggtatcaatctccctgaagaggatggcacaggtgagctggtagctgcttctgctggaatcctgcagcccaatgaggtgggatcagaaggaactggatgagcagggaagccttgccctgtgagctgaccccatcagtagggttgttcaccagtttccattcattatgtcattaatgccgcgaaaagagcccttcaccagtgtaagtctactcaccattctgttgctgttctcctgatgacttctcggctttggagtttttcccacgagggttgtcacttttgtttgcccgtgttccattgacttgattcttagtttctccagacgtctttttctcagctttgccagatgcgccttcttcagcctggcttttggcttccatttccttttgctgctcctctgcggccaggcgagccttttcctctgcttccttcttggccttctcctctgcatccatggcaagttgggaaagccacagaaaagagaaaaagaggtcatgccgttaggagaatggcctgttttagtacacaaagagtatctaaggtgtttactgagtgtttgggtacatttttgcttaattcatcagattggcatgtatacttaggaaacgaataaaataggttcataatgatgtcattctgaaaacagttagaggagaggtcagggagaaaataataaggataataattaataaaccaatattataattgtattattaatatcaccgttattaatagcttctattgaacgtgttcgctctgccaagtattatgctgagtgttttttggggattatttattttcatcctcaaaacaaccttacagcagctactattactgtgactcaatttgacaaatgtggaaatcaaggctgagagacatcataaaactttcccatagccacagtaaaaactgcagcttcatgtgggcttgcttaagacctagagtttaaacacaaacaattgattacaaaacaaaaagggaaaatatccaacactagagcaattgaagacaaacacactgaggacactgtttgttaatttaaaacaaggaaggggataattgagccttatgaaaaaaacatggtcttcaaactgtccacaagatgagaggtagcctttagtttggccaggtacctggtctgtgtctttccttttaatgaaaagatgctagcattatttctaatccagttgattataaaagggcttggctctgtgcttagtcaaaaccaccgcagaaatgcgtaggttaagtatttatgaaaagattggttcactcatccaactcatatttattgagcagttgtagcgttaagcactgttttaggtacgaggaatacagcagcaagcaagtggatttataaagaggagatcataattaagtaaacaaatgactaagatacttgcagtttataaaaagcgctttgcagaaaaccaagcagagtaatatgctggaatataatcagcataggggagggaaattgcagtagacaaggaggtggagaaggaaggcctccttgacaaggtgacatttaaccaagtcctaaatgatgaagagctggccatgcaataatctggacaaatagtatctcagtcagaggaactagaaaatgcaaaggccatgaggtagaaatgagcttggtatgctcaaagaacattgagtatggttaaagtaaatttgacaagggcttagtgatagatgacgtggtcaaatgaccaaggacaagcagggttcagatcatgcagggctttggaggcaatgaggtggcattgcattatggagaataacctacacagaagacacataacagagcccaatcctccaaggttctagagactcatcccatgcagcgcttaattcactgccaaggtcttctagcctgtgccatcaacttccactgggaaaagtattattacatttttctctacatgtgttttaaaatgctccacacatcattatcaggtgtttactttatttcttttgtgttagccttggtcctagaaaaaagctaatgctcataaataatccatttgtttttaatctaatggacaccagagtgactatgcatctatcatgtttccctttgttttagttgctaaagagctcaaagcccaaatttggtccagattcacacgttcacgaggctttatgacatgtattttgtgaaagtctatgatatcttgtttagtctacttctcctgactttatatttgcttacctaagatgtcttccttaatatattatgttttcattcattgatccatccatccatccaaaccaatgccctagcctcatccccaaacaaattaaataagattctggagaaggaggggcaagaataggatagtttgaatgttttccaggtgatttaaacatacagagttgagaagcactgatttaaatgttaaatgtttgccattcagtatttcatgacattctactccccaaaaggatgtatttgtaatttacattgaaaaggtgaggaaagatttctttacaaataacataattatgtgcatgtaaagtataatgtcttctggcctttatagaaaggtacaactacagagtgaaagaatgctcttgcagaagaagatggtgagatggcattctcagtaggatgcaggaccacaaaaggttccctggaatgttcactcaggctttatctcttccttcttcagtgactgaggatggggtttaaatgtcatctttgctactgaattcccagtgcttagcatggtgcctggtgcgtagcacacactcgaagtatttgttgactaaatgaaatgtaccctacgggtgtgatttatcctatatgcaagtgtaaccttatctgtatgtatcttcatcagtcctcagcaaattaaacaggcataaaatacagaaagtatataaactctaagtcttattctgaaagagtagtcatttgacaaatgttagtttccttaaccaataacgtaggtgagtaaaaagatgactatttttactacagagtgggaaactgaggcaaggaagaggagaattcattcatacccagaacctggtatcaattttagaaaataatttataagcccctcacagaatccccactgaatccatggcaaattttcaatattcaaaataaccccaagttggaaataattttgataaaaactgaaggtattaaatgctggtttgctataagagagtataaaatattatctgagcaagagaaattcatttgacaactgagtcagaccaatttcccatgggaaatctagctaaaagcatacaaaaaactggtggcggggggtatatttcagaaacaaacctggtttttcctcaactgtagctatcgggcaattcaagtttacatgaatgaatggtagcccttctgacatcatgatctaatcagatacgagcctatcctactgtatgatttctctacagcaatcatgttccagcaggtggtcctgcagcttttctactcaatttccatctcttagtcacatctctgagatagctgacattagtgtgatcgactgcatgacacccaaagtggtacaactcaaaatttgtagactgaaacaagcaagcacataaataagaaaaaagaaaatatattgacaggaggtaggtctttttaactgcaatcagattcctttatattttctgggtgaaattatcggtatagatgaaattttcgtataacaagaaaaaggacttgagaacagttattttgtacatgctcacagcttccaacgacagcaagtatacagagaattcacttttcaggtcttagatttagcatctactaggcttcttgactagtagaaagcaagagatgtgcggttcatttctgtttcctttggcttcccatgtcagactgtctgtggtgttgggacttgggatgaaaacagccaagagcaagcagctaagagttaaggtagagcagagccctcgagatccataaatttgcttcctcccagtggagagccagttctaccccacaatgcatgtccgtacagttttggggaaatacattgatttctttgtcttcctgaataatgatactatagggtctcagttaaaaactgtattgggctaattatcccttgatataattttctgaaatgcctacttaaactacctacaaccagagagagaaagagagagaaaaaacagagaaaagagagagaaactgaccagaaaacccaaaatactatatgaattttgactatttcaaatctcagttctatacaagaacaaagaaaggtgcttctagacatttaagaacatagaaggtgttcccgcttcctgaaaattttagtcaaagaaagaagtgctccagctgacagaaaacttcaatcaacattaaaaactcaaaaatgagaaaaatatgtaaacgaatcatatactgtaaatctaaatattcagtatcagaataaaatattcaaaagaaaggccaaatacaagacaatattatattatgatcccaatttgtcggcaaaatttttacttatacatatgtacagaaaagcaaattacaaagaataacatcagaattttaataatagttatatatgtctagagaggtaattagtaattttcattttcttttatatatattttttatacttcagcatttgtaacctaaacatgttagtcttacaccagaaaataaatgttaaaaaaaagtactaaatactgaatggaaattaatcaatattgatcagacttgaaaattgttatgtccatacatctttagttggcaatagtgatttttaactctaagggctataaaaatatttatttaatctttcctaataattatcagttcttgcctacctagttttgtaaatcaggttggttaacaaaaccaagacccatttccagtgcatttactaacaatacatgttcaagtgccccacggaggacagcctttcttgaaatcagggtcatctggaaaaaaagagcaacaaacaaaacagccaccaccaacagaaaacagatgcgaactagatttctaattagcaccagtcaaccagtcaacagcattactgagctgctaagaatgttataaaatattagttacaggttgctattttcaccaccaccttaacttcgtattcaaacctttaaccttcttttccaatttgcatacataacagctactacttaggtaccaaccttgtgcaggctgctttctcagtgctttataggtattacttctattcacctcaattctgcgatgtacattatcatccccaaagtgagtctcaaagaacctatctgaatttgccaaaaaaaaaaaaaaaaaaccttgcaagtcaagactcaattctctctccccttccctgctaattgaaatgtgccctgataaccaaactattctcccacaagatatccgtaacaccaggctctgtgcctttgcccaacccctttcttcttgttcccatttctaaatataacacctccttcaggtcttaatcccagaagtctgctacatgatgccttcccaaactcccaagcaaggctacagacaacttctttgtgcttccaaaatagttcaaacacacagttatctctatccccataccaaatgcatttaaaaattattagctgtttatttatctgttctttttaaagggccagttttctcctgaaactgtcaaatgcttccccaggtgattagtttctgaaggtaattttagtaagccagataattgcaaacaaattattttgaagtacctctttaaattgcatgttgtcagaaattgaattttcaagtgtaatgagtgtaattgattataagagagtgtttctttgcagatgatgcagtagctgccatcgctgcttgcaatgcctgccaacagggaagattgaaatgtttaaagcatttgaatggactaggagagggtgcacttaaaatatggaaggtgttggctccctccatagctcagggtgcaacatctgtcctgaaatgataagggttcaattatgccctaaaagtgccataaatataaaccctttgcctcacctgaaatgagcagccacttgaacagaattttatggacaagtcacaaaattggacagaattttgtgaacaagcctttgaataactccaacagtgaggctgctgctttcctacactagaagcagaacccccagccccaacccaatatatgggaaccaacactgctagaacatgctcttacccaccgtccccacccttctcacctggtatactgacaccaggagggtaaaaatgtgagatgttgtgtttggggaggggataatgtgtttttgtctgatgtgagggcctagggcttagactggtggtgctggtggcaacttcagggctttgactgaacttccattcttcctttgaatgaaattctgtagtaatgtctcttcccttcccctgccacaagattgtgagttttgagggcaaggatgtctgttactcatctctgtaccctgggcaccgggcacaacctggcacacagtaggcatgcaatagatgttagcaaaaaccgactcttgttgaaggctcacctctaggaagcccagtcccctcactgggctcccagagccaccatgtctttgtccctacctggaatcagacatcacagtgtcagaccccttatctcaggtttgcgctacctgtgcacaagggcatctctccctagtatgataatgtagaatgtaccgatcatggaggacatgctcagtagtcacaaatgcacatatgaacaaaggaatgtaagctttccaaatcatacaaatttccatatttttctgttgatagtaccaagggccacaacttttagttttgatgatgtctgcttcagggaatttctgtttaccgacaatttaccatcatctcagaagatcagttatatggtttgagcaatgagtgaagggaaactgagaatatgaaaggaatataaaaatgcctgtaagaaaattaaagctccttatatcccaacataatggccaaggcaaggtggctattagcgggtctttacttaggtaaaagaagaaataaaagcctcacagttgtgccacatgatatcaagtgaaaacgacaagatgtttagcagaaatcaagaaataataacacccatgtcctgtagagtcttcatactagaaaaaggagtttagtctcacagcataaagggaatcatgtcaggaggcttgcaggtctgctgcattttatcatgcattgattcgtagatattatgaagatcaaaagatggtagattctaatattcggcaatttgaatctgcatcctgagcaactgtgctttatttgtaacacacataactcagagaggacaaccttgttttatgctgaattggtttggacaggtctgtggcatgttacctttgggtaccttggccctccatctctcccgattgatgtgcaccacttccgtccaagtagctttaaagctcttatagtcaacggagatgacagaattgttgatcggggcacttccctctgaaccagaggtcttgacacctgatcgcttggcatctgacgagctgatgctattcaaactggaaaacaaaaaaatcataccaaagaagagagttagtgtttggaaaatgtctgccaatgagcaagcccagaggaggaatggttagcactcctaaagttattgctgtgaaatatctggatcctgaggtttataattattctattttccacatatgaccggtgggaaattctgaattttcagcaggaaaaacatcaacattgcagtctcaagagtctctatattcttcatatttcttctttgctatttggcctcttcttttttccccataaccagaatcccctcatgtgaattttctctgctctgttctctgaaactgactaatttgaactgggacatctacttaattccacagttcacctacctgcttccacactgaccacttttccaagttacctagcaacttgctcctctttctttccagctctaccattcccctgcaagggtctttctgatcccagcatacccaagtccaggggaagtgataatttccttaagttgctggaagaagatggaaatgcggacagcatggagattgtgagggactaggtcatgcaaaagaccttatgggtaactttgtaaatattagaaagcaccatctttctggaaaatctcaaagaagtaactactgctaccaagtggttaaagaagtgactggtaggaatacaaattcatgatggactagacaagcagaatatatttcagtcactgcctgaagagctgtggggccatggggactctggcagggggctctgtcctccttgttagcaaacttaagagggtctatccatctggagcatccctggggtcccctgtcctaacgcctgtctttctttactccttttcctgctctttgcttcttcttttcctattcattccacttctcttcttcctcctttatgacaaagcccactgttctacatgaacaaggagattagtagtagtcgtaatagtagtagtatatctaataaagactttatggtagctagcacttcctctgttctagatcctgttgtaaggtttaacatatttttaataacttatttcgtcttcccagtcacctctgagtattataatccacgttttctcagatgggggaagtgagacaattggcctgcgattgcacagctagtaagtgatgaggtcaggagtaagtgatgaggagctgcccttgatataatgatgtggtggtagaaggtgatttcaagctttcgattctttttctctacttcattctttgtgcaaaccttgaaatgaaagtcagtttcatttctttgtaagtattcttgatgagtggtactgtctttgtggagtattacatgagcaaggattgtctgggcacagcaggtaaacatgcagcaaatagggtggcaggggggcagcaccaggtgcctgctggtcacgatttagaccttggtcaccctttacagtttagcctggagagtacggataatacaatttcaactcctctgagaaaaggaaagaggcagacaaatttttctgagaaggagctaaggcaaatgccattatgaaataccatccccatccccagcaaaagaagaattctatcctcaaggacaggccaacctcaccctcagccctcaagcttccccactgacctcgaacgcctctgtcctgtcccaccagtttgagaggtttcatcgattaatggactcacaatcttctcggtcatgtccgtaagcacagtgaaggtgggttccacgatgaaatcaatgaaacctgaagagaaacagcaatgcttcagaggaaccacatattaccttgggcctttccatactttccagaagaaactgatctagaagttccagatcagattaaaagagaatggcttgatcttatgtactgtatgtattccttgatttgaatattacatgtcagtttcatttctcctacataacttcctatgacttttcaggatacagttcaataaagtgcctaagaaatatacactcaacacccactatagaacaagcactgtgataagagctgtgtaaaagaccaagactgaataacacaacctgcctgaagttgtgacatttgagctgaacccttaagaatgggtggagaggaagatgtggctattcactctgggcggtgggaatggaaaaagccaagtgacagagatgggagggtgtaagatgtgtctggggactgactagggagtagggattcttttggatttggggaaggaaagcttgggaaggcaggttatcgacagctctaggaagggaggcttctaagtgttcagatagagggttgggacttaggtggacactggaggctcctggagatgtttgagccgcattgtcataagagtttttaaatgttctttggaaagttaatctggcaagatagataagaaggaagaaagcaggaagggagaaggatgagaaaatcatttagaagctattgcaattgtttaaacaaaagataaagaaggctggaaccagtgccactataaagtggaaatgcaaagcaggcacagatacctgcacagcaggaggtggtactgcctctgtatgggatctgccaaagacactccaacaacaaagcagggaaaacaggaaatagaaggagaataaggccaagaaaagacaatgggctcagtttcagatttgctgactttgaggtacaggggggcacatctagatgggagagggcaaacagagttggaagaaacaggattggaaagtggaagagggctcaggcctagaactatacctttgtatagtgatagagagatggctgaagtcgggctacagagattgtcccaacagctcagacacccaaatgttctgcgacaatcaggagagaaaataggagctgaagctagtggggatgctggtaattcattacacagtcacatgaaaaccggaaggaaactaaatatcaaccagaggaaatgttgtccattctccttcgaagggcatgtttggaaatgtatgaatgcatatttagttttcacaatggcccaggtagaggtaaagctggcattaatgcccagcagtaaaggatgttaaaagtcctacaatgtaattgacaaaacaagaattgtctcaaccaaataccaatagtatcgtgattgataaggaaacagtgatagccaaaagtgtattatggttaatacagtgttgtaattgtgtatgtgtagtatgtattgtgtattatggttaattatagtgtagttttaagctgaaactaaagtatttgatgacaccatttttgccttttttttcctgacaaattaagctcaacatgtccaaaccagaactaactcataagcttccccacaacctttgtaaatgggatcatggtccaaccacttaatgtagagttctgcctttatctcagctttgcgttcagccaaatccttgataccttatgtgccacctctcttctggagaggccccgttactaccttagttctgatattcatcatctcttctttgtaatcctgtaggaggcagtcaactactttccttgcctctaatcttactgaaaatcctccaattaatcctctatgctactggcaaagaaatcttctaaaaacagggtaggcaaactttatctgtaaaggaccagatagttattttagactttgcaggccatatcatcgctatcaaaaccacttaactctgccactaaagtgctaaagcagccatagacaatatgtaaatgaatgcacttagctatgttgtaataaaactttatttacaagaacaggtggtgggccagattaagcccacaggctaaaacataaatttatatatttttaacctcacttaaaattctttagatatgccctcatttcctacaagaaagtataaacacatgctattattaacactatataaaatctgggcttgatacgtccctcactacatcctactccgtacccaatgttcttgccatatggaaatgtttagaatttgctgaccataccaggcagttttaagtttccctgctttgtatatgctacattctctgcctggaatacccttctacccacccctagctcacctccaacacagatcaccatttgcccagacaatgcctactcacttcttgggactcaattcaaatattatcccttaataaacctaatggttcacacactctgttgtgtaccttatcgtactaggtacaaaagtctaccttggcattataacattctaatagatttttgtttttgtaacattttgcccatcacccaatactggtttaatgtctttgagagcaggtaccatatataatttgtctttgttcctataacatctattatcatgtctagcagtgcccaatatatgaagactcaatatacattataaaaaaagcataagcactcaaaacacaagtagaaaaatgcctaattcttattgaattttcttaaatgacttcagactcttcaaaggtggagatcactgacaacatttaacttagatagggcactggtgtcctctcccacagatgaagatttttaaaatgcatatattatggttattagcaattcaaaagttattcttaccttaaaaaagtgctttaaagaaaagaaaggatggaaggaagacaggaaacaaggaagaaaacattttaaaagatccattcatggaagtagattcaacaaggaaatggggctgtcctgaaaacagggctaggagaagcatcagtgagtagaaatgccttgttagcttacagtcctgcatgcagaatggcgggatggagtagaatgggcttcctgccaatgacacttgttatctccttggaaagttggggccccctctttctcttgacagggaatgacagagacaccaagagtatcattgtccaattctcccatgaacaagccacattccagggaaaagaatggacagagtggttccataaattgaatcaggcagagccatgagcacaacatggcagaatggagccagtttcccagccaaagaaccactgggatcatctgtgcttacttctacaggcttcctgctttggtgcttctatccaaagagctgcaaacacgtacctacttgtgactgagcaaccatagtggactttcggtcacacagaggagaaaaaggcagccccagctctgcttctctgtcaccctggaaaaataaaaggtcatagtaaattaaggaacagtaggctgggtcacccagatttcatttagcaacttctgccgccacggaggccactggtctttattttaattattacaattacattataaaataagtctttatggagcctgcttctctacataaaagacaccaaaaggctgaagccctctgggatccaatagttccacccaactgcaaagttcatgttgctgtaaagaaagcctcattgggcagtactaggacctccatggaaaataaggcaacaggcaatatgtcttgtggcctgcagccagcactgcaggcagaatttctgtgttttctcaagtcatcctgggtcaacctgtggccattgtttagctaatgaactcctcccagatgtgggcagtgtctgaaactaaaattcaaactggactgattcagactgattcttctagtgctacctaaagccacacacacttggagcaagtgcttctgggtttttaacctcagagaccagtccataatgaaaagtggaccaaaaagagaataaataattgcttgtgtctatgaagttagacaacaataaaacacaattgtctaaccaatatattctcaatctcaccaaaaagcatcaccataataagcattatgaagagtctaaataataatggagatgttttctaaaaacttgggccagaggcttaatacttgtcatacccccagaggaaaggaaaaataatatgtcacccttcttatagtagtgaagctgtgctaattcattttactggctcaggataatagctactgacttgtgcttgaatccctttctcctactagatgtgagatagatcacaggtaagttattttccttccatacattttagtttttatcacttgctaaatgtgagatagtaatctctacctcatagggttataaggatgaaagaggaaaatgcatgtaaataaataaaaagaactactgttgtttcccaacaggtggctctaatatttaaggccaagactcgagaaacctttagtgaatttgttcacctaatacactccgattgtaataagtactgtcaataaattaatgtaatagcaaataaagggtagtaacaacctgcaaccaggcctggttcaaaactggatgattcttccttctaaggcatgctaccaaagagaatggatattggctcacatgtagcattaactgaaaggacggaaaaggggtgtgtgtctgaggcagctcaacagtggggtcacaatgggagctggggacatccaagggtctcaggaatagtccctaagtggctcagttccttctgcaccctcttcctatatagacaccccagcggacacaatggcttctttatttcaagtacgcactactgaaaactgctctctcaagtggcatgataaaaatgatttcctcctgagtgatttctacctaggtgatatgtagaaaaggaagtgcatttataacataaattctagtggtgtagatggtttggtgggatagttcagctaaaacaaacaaaaccctttttattcccatgtagcagggatacaaattgttctgtcagtacattttaatggggagggtgtgaacactctccatgactattaaaatataaacactaatttggatttcattactgaacaatcacctgatactaaataactcctaattccacgaacttgtctatacccaaatatacacataatttacatgctttgtatttaattgagctgtgtagactcgactaataaaagcttatttttaaaacagaggtacttgaattccctttggaaagcagatatacttacgaattgaaaaaaaaaaacagtgctgataatgtagaggaataaacttctactcatgagtccaacttgagtgataacacaatactgtatgactctacagctatagcttaaaattattcatacacttcctctttattgaagaggtcaacattttcaaaagagggcaaaagtctctatttacacaaaggatttttaaaaactcactcatttttttttcttccaggacagcgcagaaaaataagtatcattcctgcagtaggggttaagataactccaactgataaagccacatagttggcacacagaaggaagataatgaatatttgttgaataaatgaaaagactaatttggttagaaacactcaagttcctttggccactcagacattcatgacagacaaactaaagacagcagttaggcaggtagctgttcaccacatccctattcttctcctcctccatttcctgtctacacagctagaccccattgcctagaatcactgccagttagtgctcaataacagaacgagagaagggatgcatttctaccacagttcaggcctacaatatctcttatgcctacttctccatgttttccccagtttgctggtttgatgtagacaagcactttggaagcaaggtagatggcagaatacggtctaaaatcattgcttatcatagaaccatctgctaatcaagaaacatgagtcctatactgtacatgagtgagttcaaaacttctgtttatgtgtgttgttatacatttgggggtagctatatgtaagcagcaaaccagtcaaaagagacaagggctccatctgtattggaagttcacagagaagatggcacctgtcaatgcaagagcttccaaagacatttaggtaatatctcaagtgagtcttttcaggtgaaatgaagaaaaagcaaatgtttgggaatgcaacagaaggatcaagttgaacaaagcacagcaatgtatattcttctttcccaggggaggaaggcacaaatataacatatgagaaaggcattgtgatgttggatttaagatagcatagtaaagttttagctctttcagaaattatcacctcaaaaataaggagagtaagaaacagaaatgcaatcacacatcctaggaaaaatctgtaatctaaaatcaaaactatatgagaaagggctgccaaatgctgtaaatatcagagaggaataaggcaagatgccaagaggctaggcagagaatagacattgaattgcaagaggccctacaaaagtaaggaagtaaaggcacacacacacacacatgcacgcacacacacacacacacacacgcacatacacaccgcttcataggaccctaataataaaccaaggacaattctagatagcttagaatactactgctctgattgccctgtggtacaaatctgcaaatagttggtctgaaaagaacacatttcactcaaagattgtaaataacaataataaaataaagtgaagaagaaaagagaggaggaggagaaggggcagacggaagagtagaaggaggaggacaaagagatgatggagaagatggaggggaagaagaaaaaggtgaagaagaagaagaggaaggaagagataaaagaaaaagagcaaagggaggagaaggaagtattataccatcagcagcagaagcaggaataaagaacttcaaacaaacaacagatggggaatactcatcagataaatggtgccactactaacagaaagaagcccctgaaattgttaagaacaagggctcaggggaatgagacctagcagagcacaggaaagacattgaaaagggaagaaaactagaactatcacattaatgcagattgtgctggaagcagctcaaaggagaactgaattgataaaaataaaaaggccagtgaaggcactataaacaaaaagagaaacaataaaacaatctgataatttcatagagaacaaaggaaaaaactcaccaacacgtgtaataaataaaaatgggaaaaatactatagacacggattaaattaaaagaattgtaagagatgtttgcaaaatataaaattgtacaacaatacaaagaaaatgaacctcacagtttttccaacatgacatatttaccaacgaggtgaacttatacttctttaaagtcaatatttcatcaaaaagtaccctgaggcagtggctcggattttgtaaattatggttataaaactgaagatgtaacttactctcttagtaaccatggaatgtgtggtccatcagcactgagactatgcccttattttaaaatgtaacccaactttccaaatgtaatttttaaaaacactctatagtgccattgagatttcccatttgaattgtccaatttaaaaatctatagttaagaactgaggcagcatttctcttacatgtgttacttactatagcttatggcatctaggttaaaatattaagtcaataaaaataatttactgaattttaattactaaaaaatagttccagtccaatgagttaacagtcccttcccaacaggcaagaaattcaatatggttattttcatattgcctctagcacatttttattcgagtatatgtatgtgcaaacaagttttcctttacgaggaaaaaatgttcatatgtttaagtaattcatttttactttctcataattagaaaaagaatcactttaatacctcaaactatatgagttagctattatctatcctttcgccatggaccaaatactcctagctgtagagggtttgttatggtttggctgtgttctcccaccccaaatctcatcttaaattgtagctcctataattcccatgtgttgtggaagggagcccgtgggagataattgaataatgggggcagtttcctccatactgttttcatgatagtgaataagtctcatgagatctgatggttttacaaggggaaacccctttcacttggttctcatgctgtctctttgctggctgccatgtaagacatccctttgtttttcctttgtcttccaccacagttgtgaggcttcctcagccctgtggaactgtgagtcaattaaacttctttcctttataaattacccagtcttgggtattctttatcagcagcgtgaaaatgaactaatacagtaaattggtactggtagagtgtggctctgctataaagatacctgatatgtggaagcgactttagaagtgggtaacaggcagaggttggaacagtttggagagctcagaagaagataagaaaatgtgggaaattttggaacttcctagagacttgttgaatgtctttgaacaaaatgttgataatatggacaatgacatccaggctgaggtggtctcagtggagacgaggaactagttgggaactggagtaaaaatgattcttgctgtgttttagcaaagagactggcagcattttacccctgccctagagatctgtggaactttgaacttgagggaaatgacttagggtatctggcggaaacaatttctaaacaggaaaacattcaagaggtaacttgggtgctgttaaaagcattcggttttaaaagggaaacgacacataaaagttcagaaaatttgcagcctgatgatgcaatagaaaagaaaaacccattttctgaggagaaattccagcctgctgcacaaatttgcagaagtaacaaggagccaagacaatggggaaaatgtcacacatcacagaccaagaggcctaggaggaaaagatggttttgtgggctgggcccagggtccccctgctgtgtgcagcctagggacttggtgccctgcatcccagatgctctagtcatggctaaaaggggctaggtacagctcaggccatggcttcagaaggtgcaagcctcaagccttggagatttctgcatggtgttgagcctgcaggtgcacagaagtcaagaattgaggtttgggaacctccgcctagatttcagaggatgtatgaaaccacctggatgtccaggcagaaatttgctgcaggggcagggccttcatggataacctctgctatggtagtgtggaagcaaaatgtggagttgaaacccccacacagagtccctactagggcactgcctagtggagctgtgagaagagggccactgttctccagatcccagaatggtaggtccactgacaacttgcaccatgtgcctggaaaagcagcagatgctcactgtcagcccaggaaagcagtcaggagggaggctgcacctggaaaagccacagggacagagctgcccaagaccatgagaacccatctcttgcatcagcatgacctggatgtgagacatagagtcaaaaggagatcattttggagctttaagatttgactgccatgctggattttggacttgcataggccctgtaacccctttgtttgcccaatttctcccatttgaaatggctgtatttacccaatgcctgtacccccattgtatctaggatgtaactaacttgcttttgattttacagactcataggtggaaggaacttgccttgtctcagatgagacttcgaactgtggacttttgagttaatgcagaaatgagttaagactttgggggactgttgggaaggtatgattggttttgaaatgttagaatacgagatttgggaggggtcagggtggaatgacatggtttggctgtgtccctacccaaatctcatcttaaattgtagctcccataattcccacatgttgtgggatgaacctggtgagagataactgaatcctgggtgcggtttcccccatactgttctcgtggtagcaaataagtctcatgagatctgatggttttataatggaaaaatccctttcacttggtcctcattctctctctttgctggccaccgtgcaagacatctctttactcttctgccatgactgtgaggcctccccagctatgtggagctgtgagtcaattaaacctcttccctttataaattacccagtcttgagtatgtctttatttgcagcatgagaacagactagtacagggtgatattgcaaaagtattatcaaagaaagcatatgacagggggagtggagatttggagaacatcctcctactactattagaaaaacagcctttggaaaaatagctcaaaagaagctcttggtgaaggatgattttgcggagtcacctgtatagttctagttccccccacaccatggagtcccctttgagaattactctgagagggtgagcaatgactctgcaaagagaattaaccataaactaaatagggtacctgttgacatacacatataatagctggggggtgctgcggtgtgtgtgtgtgtgtgtgtgtgtgtgtgtgcgtgcatgtgcaccatagacagagtgaaggaaatgccttgcatttcctaacaaaagggtcttaagaaaacatctcgtccaaccttatcctaaatccttccctccccccgctcccccaacataaatcacagataagaccatagggaattagagaagcaatttgattagactcaggccataaatcagtggaaataaactccaataaagggtcttctggcatttgtttaatgtgctgttaactctagccctacttcattactagatagtttcagaaggaaaacacacacacacaggcacacacacacacaggtgccttctacaatttctgcattcagacttgaaatctaagagtaagaattatcacaatctaaatttattcagaaaactaaataaatagcaaaagagcccatctcttgtcagtttgcgggacgaagttgtgacttgtgttattaagcagtgttttatggaatcagaagtctctgaatccatgctgttgaatctcttttcttgaattagcaagaattaactgaattagctgtattaacttgaatttattataatttaggtcaccaaatctatgtatcatgtcttcaatctcaggcccgcatgtctggatgcagatgtttgaatggcagcacctctagagataaggttagcacatgtgcctgagttggaaagacttcggtcttggtgctatgcatttatttccctatttctctagttccatgcaattttaaaatttgtttttaaacaatttataataattaaagatcctgcctgttctttttttctttttctgagacagagtctcgcgctgtcgccaggctggagtacggcagtgcgatctcggctaactgcaacctccatctcctgggttcaagcgattctcctgcctcagcctctcaagtagctgggattacaggcacccaccaccacgcccggctaatttttgtatttttagtagagatggggtttcaccatcttggccaggatggtctcaatctcctgacctcatgatccacccgccttggcctcccaaagtgctgcaattacaggcatgagccactgcaccagaccgatcctgcctattcttatagacaacacaactctggaacttaggatggagtgaagtttaaatacaactggaatggcagtttctagtgatttcctgaccccaaattgccacatctggtttggaattttgcgtcttggacttgtccattagaaagaaacaacccaaccaattataatagagacatgagttcaagattaacatcttaatcccatagggtgatgccaaagtaactgtcattttgtcgagccactagaaaaaaaaagtaaaagaacccctcaaatgacattttgacaaaagactgctacaaggaaatactttttttcccccaaacagaaatgcataggataaaaataccataatgtcctaaaaagcagtatttaggtaagattcaaatatcacatgaccaagaggcaaaataatctgtggagcccccctcccctctccaaaattactgtaatctcaatagtccttatcctagcattgctgagatataaaattcataaaatatccaatgatgacagtcctgatggagagagagcaacaaggtacctgtctgaagaactcctccaggagtgacattgtccagcgatgatggaggtcccatgcttttgctggatggctaatatctgctgtatgcagcataagggataaggcttttggcttttcaatgctgtaaaccaaaagcacccaaacacatgataaccacactcttcagaacctcagtaagagttttttaaaaatcattaagtttttaatctcttttgttcttccatctcaaaccccacttcagctaaattgaggaaaagacatcatttcatcctacaactgggatactcattaacttggtctccatatttacggaattggactctctggactcaaatccatttctggaatgactgcatccttcaaaaagagagcaagaatccaagagtcactgacttttattggttgcttctgcattggggatctctgataatttagtttcccacagggaattatttttaattctcactggggacaactgatgctgcctctattatttctttcaaccctgatgagaacataccttattgtggtaggtacaacttttatgctttctccttcaaacataatcattgcataagaacactctataaagttgtgttaaaggagatgctctttaaagggatagccacatagacgaggacccattcaaacacctatacaaacaaaaacacaagccacaagcacacttacgcttctggctgctgcagagcagtcttcattgctttgatttgttggaagtgacaagacatatctgtggccatcaccatttcaattaccaaggttcgaaactcccttttagagacaaccatggagaaaaaaggatggaagtcaaaaatggaaagtaaaaatcagtgttttttttttgccactgctaatgaaaatcagtcaacgatttctgacatttctaatctaatttgggtctttaaggtgagcttttcaaataaggaataaatgaaagctaagtattaagaaaatcatttattaggaatatgatacatggaatacacatatcatttggaaaattaactcacaggaaaaaattcaatgaaactgaaaattgtattaaaatgctcttttctccaaatgaattcagagttttaagaaagaattaacttgaaaataatccttggaggtaaattaatcatccgtatttcacattggatacaggtattccatctttttaaaaatagcttgatttttaatagagttttaggttgacagaaaaattgagcttatagtatagctagttctcatgttacctcacttccagcacagttttcttatttttaaagtcttgtgttaatgtggtgcatttgttacaactagtgaatcaatattgatacattatgttaactacagtccatagtttacattaaggttcactgggcatgctgtacagttctaccagttttgacaaatgcataatgccatgtatccaccatcacaatatccatacagaatagattcagcaccctaaaatcccctgtgctccttcgattcacccctctcttttttccctcaacccctgccaatcactgatctttttactgcctctaacgactttattgaggtataatttacatagaataaactgcttacaatttacataaattgcagaatgtaatgagtttaacagttgagtaagtttttgaaaataccactgtaatcatgataccaaatacttccatcatcctcaaacctagccccaggcaaagtttgatctggcttatgtctatctaaaatagtttgaattttctagttttatacatgtgtacataaagtatacacatatatatttagtatatatttcaaatatttaatatatattatagatttcaatatttatatattatatacacatatatttcatacatatatacatatttattatatacatacatgtagacatacatagatacacatatatgtattatatattaaatatgtgtgtatatatgtatatatagattatgtatatatgtatgtatacacacatacatatacgtatgtatacatacatacatacgtatatgtgtgtatacatacgtatatgtatgtatgtgtgtatatatacatacatatatacacacattattttaaaatagtcacacattgaaaatatacacacatattattttaaaatataatagataatacatattatacacacatacatacgcattatatattaacacagatactagatatatacacacgtgtttccatgtatatacatagacacacacacacacacatatataatacaaaatgtactctttctttactcagcataatgatttacaattcatctatatagtggttcatcaatagttcattttctcttattgctgagtggtattctatcatatgagcataccacagtttgttatccatttactagctaacggacattcaagttattagattctagtttggaactattgtgaataaagctactatgggtattcatacataaatctttgtgtagacacatatgttttcatttatctggggtgaatacctagaagcagaatggctggtttataagacagctgagtgtttataagaaactgccagccgggcatagtggctcatgcctgtaatcccaacactttgggaggctgaggcaggtggatcacctgaggtcaggagttcgagactagcctgaccaatatggtgaaaccccgtctctactaaaaatacaaaaattagctgggtgttgtggcatgcgcctgtagtcccagctacttaggaggctgagacaggagaattgcttgaacctaggaggtggaagttgcaatgaggtgatatcatgccactgcactctagcctgggtgacagagagagactgcatctcaattaaaaaagaaaaaagaaactgccaaatatttgtgaaagtggttgtatcactttacatttgaccactagcatataacattttcagtttttctttgcctcctctaatgagtctttaatttcagccattcttctgatggatatgtagtgttatctcatcttggttttaatttacatttctttgttgactatgtcaggcacattttcatgtacttatattccatttgtatacattttttagggaaatgtctgtttcaaacctttctcattttaaaattgaattgtttacttattattgagttataaaagtaccttacacattttggattcaaaacctatgtaaaacataagtgttgtgaataatttctccaatgtcttggcctgcttttttttaacggtgtcttccaaagagcaaaaggtttaatttttataaagttcaatttatcattaaaaaaatgcttcatgctttttctctcctatctgagaaaccgccacctacttccaaggacttcagtattttcctctggaagtcttgccattttagcttttacgtttaggtttataaccaattttgagctattttttgagtatggtatgtgataagggtcaaagttatcttttcccattgttccaaaaccatttgttgaaaatattttcttttccccattgaattaatttggcatcataaatcaattgatgagtcaatttcaaaactctcaattctgtcccatagttacgtatgtccatctttcaccagtgaaatgctgccttgaatactgtaacttaagcatgcttggaatcaagaaatatgagtcctctaaccttgttcttcatttaaaaagtattatttggcatttctatataaagtttataataatcatggcaatttccaacataattctgctggaattttgattggaattgtattgaaacaataaataaattttggaagatttgacatctttataataccgagtgttccactacatgatgacagtatatctctctatgtatttagttcctctataatcagcaatactacataatctttagtgaacatgagctgcatttgtttttgaaagctactactaagtattttatatgttatgtgctattgtaaaaaattattttattttccaatggtttgctgctagtgtctctctccctctctctgtctctctctctctctctctatatatatatatatatgtatatgtgcatatatgcatatgtgtatatataatgttttttacattaaccttgtattctgtgaccttgcaaaattcattatcggttccagtagctcctttacagatccttaggattttctacttaggcaatcatgtcatttgctattaacatcttaacaatgttgatgaatgtaagatcaagcatctttgtcttactcccagtcttaaggaaaaaacattcaatatttcaccattaagcttgatgttagttataggtttttcacacatgcactttatccagttgaggaagctcccttctgtttctggcttgctgagagtttttatgatgaatgtgttgaattttgtcaaatgcttgttatatatctattaagatgactgtatgattttctgtttgtttttaaatatggggaattcttttaattaatttttgaatgctgaattaatcttgcattccttggataagcccaatatatgagtcaggattctccagagaaaccaataggatagaaagagatttattatgaggaagtggctcacataattatgaaggctgacaagtcccaagatctgcagggtaaatcagcaagtggagatccaggacacccaatattgtacttccaacttgaaggctgacagctcaagacccaggaggagccattgttttagttcaaagacaggcaaaaagaattctctcttacttgggaggtggtcagcctttttgttctagttaggccttcaactggttgaatgaggtcaactcatgttaggaagggcaatctgctttactcagtctaccctcttatatgttaatctcatccaaaaacaccctcacagaaacaacagaataatgcttgaccaaatatcagcacacactgaggcccaggcgagttgatacataaaattaactatcacacatgatatattacctttttagtatattgttacatttaattagttaatattttactgagaattgttatagctatgttcataaaatacattagtctttaacattcctttttatgaatttttttccagagtgtggtatcaaaattatgtcttataaaacaaattgcacagtatttcttccttctctaaatacatttgcataagattggtattatctgttctttacatattgatagaattcaccagttaaactatccaaggctggatatttctttgtgggaatatttttgatgacaaagtcaattttttaacagacataggattgttcagactttctgtttcatcttgtgtgaattttggtaagttgtattttgcaaggaatttatccacttcatcaaagttgtcaaatttattgagataaagttgtttgtaacattttcttatgtatttcatatgtataggatatactgttggtactttgtgttctctcctttttattgaccagtctaggtagaaggttgtcaatcatgttgctcttttcaaataacagcttgagctttcttaattttttctttttattttttctattttattgatttttcctcttatcattactaatttcttctatctactttgaatttacattactgttttggtctagcttcctgaagtcattgtgtttggaacttttttctttcctactatgaacatttatagctgtaaatttcctctaggcactgttttaatagtattgcacacatttttaatatattgcattttcattcttgataaatttgaaatgtttcctactttcctctgattactttttgatccacaaatgatttagaagaatgttgtttaattttcaaatatacaggattttcctagatatcttattgatctctaatttaaatccattaaggtcaaagaacatactctttaagcttatgatattttaaaattattaaaacttattttaaaatgtctcagcatgtgtacttgaaaagaatatgtatattgcagttgttgcatggtgttctataaatattaattaaggcaaagtggctgatgttgttcaaatcctcttaggtccttagtgatatttttgtccagtttgtctatcaactgctgacgcaagaatcttaaaacctcctatgattgtgaaaatatatatttctcctttttctcctatcaatttttacattttatgttttggaagtctacagttacctaatagttatttatgactgatgtatctttctgatgacactcttattatcagaaaatctcctttctctttcacaatatcctttttcttgcagttcattttagctaatattaataacaccactgcattctacttattcttactgtttggtacatcttacatacttttactttgaacctttttgtgtatttatatttaaagtgtatctcttgtacaattgcagttggagcttgcctttttatcaattctaataaccttttccttttaagtagaatgtttagtcctttaacatttaatgtaattattaatatagttgcatttgggtctagcatgttattatttgttttctaattatcacctttgcttttttccctttgcattaacttttctgcttgagatattttttgtattatttattttttaaatcaattttaatttatctactgctaaatggtcaatttaaatttatcttttgataaataggtaaactttaacaatctttagctattatggttaatctttttagtggttgcttggggattacaacatacatctttaattttctgtctactgtataactttatgtaacatttaaaaatcctgcaacagtataggtccatttactaacattaactggtctttatgttatcattgtcacatgtattacacctctctacatacaaacctcatgagatggtgttgtaatttttgcttcaaatggtcaaatgcacaatttaaataagtgaagaaaaatggtattttacatttacccagatatttatcagtttattcttttctaaaagtctgatttcactatcatatcattttccttccaataaatatttagatttattaatctaaaaattaataaaatataaaataacaaaataatatttttgaaactaccttaaagaaagctctaaagaaatttctttagcatcccttgtaacgcagctccattagtgacacattcctgttgttttctattatctgaaaataattttatttcatcttcattcttgaagttcatgttcacaggatgtagcatcctgtgttggctttttgttttctttttagcactttaaataaattattctattgttttctggcctctatagtttctgatgaatagtctactgtgattcaacttgttctcctaagtgtaatttgtcatttttctttattttatctttgcctctcagcagtttgactataatatgtgcctcagtgttcttttcatcgaatttaacctgttttaggtttgctgagtttcttgaatctgtatatttatatgtttggcaatatttggaaactgttcagtcattatttcttcaaattctttttctttcccattctctctcttttctctccttctgagactcaaattgcccttatgttggctcatataaaattatcccacatgtccctaacttctactcatttaaaacagctttttcctcttactttttcaaatcaaataatttccaactttgaaacctgaaaaatgaatttttaaaagtcactgtttccttcttctgtcttctctatcatgcactaagcctatgtagcaaattctaaatgtagacattttatttttcagttctaaactttgtttttaatttatgttttcattttactcataaaccttataacaaaataatatttttgaaactaccttaaagaaagttctaaagaaatttctttagcatcccttataacacagctccattagtgacacactcctgttgttttctattacctgaaaataattttatacacaagcacatttttcattacctcactgagcatagaaataatagttgttttaaaagtccaaagtcctcatctgataattctaacaatggcttatcctagagtgtgtatctattgattgtcttttcccttactaagaaatcacattttcctgatctttatatgtcacttagattgtatcctgaacattatggatataagttgtagggaatctgggttctgttatattgctctgaagattgttgatgttttgttttagcaggcaattaacttgtttatactcaaaatacaaactctgtataggttcagtaagcaatacatcagatatcactggacacaaggagggaaacatcacacactggggcttgtcagggggtcaggggctagggaaggcatagcattaggagaaatacctaatgtagacgatgggttgatgggtgcagcaaaccaccatggcacatgtataaacctgcactttctgcacacgtatcccagaacttaaaatataataaaaaaaatttttaaaaaggtttgaaaaaaataataaaaggtggccaggcacagtggctcatgcctgtaatcccagcactttgggaggccaaggctagtgggtcatttgaggtaaggagttcgagaccagcctgaccaaaatggtgaaacactgtctctattaaaaatacaaaaaaattagctgggcctggtagtgcatgcctgtagtcccagctacttgtgagactgaggcaggagaatcgcttgaatttgggaagcgaaggttgcagtgagccaagatcatgccactgcactccagtctaggtgacagagtgagactctgtctcaaaataataataataataaaaggtttgaatatggcagagaacagcttcacacatattcagatacatcatggttttgaaggatttgtgtgagggcttatttagatatttagatcgtgtataatcctggcttcctgacaatctagtaaagtgttctaaagcttgcataattgcctcttaacatattttccaaacatacgtatgctacttctgttatacatacttttacttttctttttttttcttttttttttttttttgagacggagtctcgctctgtcacccaggctctgttctgtccaatggaatagaacagaggcctcagaaataatagcacacatatacaaccatctgatctttgaaaagcctgacaaaaacaagctatggggaaaggattccctatataataaatggtgttgggaaaactggctagccatatgcaaaaaactgaaactggaccccttccttataccttatacaaaaattaactcaagatggattaaagacttaaagtaagacctaaaaccataaaaaccctagaagaaaacctaggcaatagcattcaggatataggtatgggcaaagacttcttgactaaaacaccaaaagcaatggcaacaacagccagaattgacaaatgggatgtaattaaactaaagagctcctgcacagcaaaagaaactatcatcagagtgaatgggcaacctacataatgggggaaaatttttgtaatcaaaccttttattataacttttaccaatagtaaaattggatagagggttccttttttcctgaagtggtgcaatgattaattgaattgctctgcatttttcagatgctggctgagtctagcatattccaataaaatttaagtcaaatattcccatatgttttaataaactaaagctacatggaaactcttagccactcttaataaaaatcagcctctcagattgttcagtaaagttcatttctctaaatccttgaaagatggtgagcacacaaatacccaataaacagctgattatttaattaaaatatgaggactatttgagtcacaacggattcagagttttgtaaggatttagatgatctctgcctgcagggtttgaagtaccttaacctatatttatagctacgatgatttattggcttgctatatatgagacaaagtgtgctaagcattttaaaatgattatgtcatttatcataatctatcccaactgcagaataaatgttactatctattttcaagaaattaaaattttaaagatgtaaagatattgagtcacttcccgaatgtcatacagctagtaagtgactgagtccatattcaaaacacaggtatgtgcctaaatccaaacacacaatttctgtcattcatgcaacagaattaagtgtacataatttttttaagtgtccaataatttccttagaaaatgtcaaaagattgataagaagtccaaatcaaatatagggtgaaaaacacatgttattaaataaaagataaaattcagatttaaggaattcagataaaagcaacacaagtttcctaaggttaaaaaaaaaagcaaatatatccaaagtgtcctcagttgaacactgttagaagtgatttttcaaactttcttctttgagaatttttaggacaatattgaattatttgactcaaactggtttcacttcccaattcatcaataaaaagcaatgtaaagatggcaaaataaagtagttggaacttaatcataacattccatagcctttatttataaatatttgaatatctgtataaagaaaaaagagaaataagacatacatacatacacaaagagagggtgagagtgagagaaagaaagagagagaaagcaacacgaatcaacattttaagcaaggtgttcttttctcaaaaacagcatacttcatccaacttcaaagttccttccctggcctacaaatctctctcttttctcatccttacctccagtcatcctttgagaggttaatcaaaatattcatttcctcgtcatcttgcagaaggcgataagctgcacttaaatggtgattctccagtacagatctgtcattatacagaatagctggatcagacctgaacagaaagccaagcaaaattcagaatgttaaacagttgtgatttacttgggtaattctaacaggctagaacgcaccaccacttttttccatgtttagaaattatctttgtccccatgccagttatatgaaccaaaagctcaactaacactacaaatcatcaatagatgaatgtagggtatgttatatcagtacatgtgtgggcaggaaatatgtgacatccagcctgagaactctctcaaaactgttttacaaccagatctcaattacctatattagttgcaaaggtgtttttttaaaaatatgggtcatgtcaaacttctttatattttctggaatgacatttatttttatttttattttattcaatgaatgcactggtttatttattttagttgtaattttcagaacacatatcacctggtgggtactatctgtaagctgcctctgatagtggcttgatctcaacatttttccatgcaaaagccacatgtggaaaattgagaataaagaatataaagattataatgtcagtttttagttcctatctcaaagaccatactatagctgaatgtcactaaacacacgactgtataatattttaagatcttaaatttaatgaaagcttagattatttgtttctcaccaaggaagctgagtttcagagacttaaaaaaacttgttagagccctttggtggccaagtggcagggctgggatgaaggcaagatcttctgacagttgggccagtgcttccccaagataacttccacctgccattggccaaactttgggctgtatctatcataccttgaaactgttaggcttaaaattttattcatcaaaggattaagggcctggtcacagactttgttttctgaacagggatcacacaggctgagaggctttggataaagttctgttgaacagggccaatgtttaaatttcattccaaaccaagcttaactgaacacattggaattttcccactcctatggagataacgcagaacattcaaatcccgaggtgaaagatctgctgttacatctgttgagtaagttagataccaactgatgtatatttcgtgacacttttccacctcctgtaataaagccattctcctctgtgttgggactggttttgatcctcgtctccaggcaagacccacatatgttcaacccacctctcttccttgggcaggtgatattcaccatggtctctgtcctcagagcaaaggttccacccacagacatacattaaacagtgctactctatggaattccctgtattaaagggaattctgttcccttggaacacaaccacaaaaagctgcttttctgtggctgagactaagtgaggaggcaagaaggtggaactgaagcaagtagctgaagttcttttgtctgcttccattcaattaaaattctccttctgaacagagatcagacaatattgtcttcttttgtgtatactgtaatcaagtgttgagttcattaaatacatgtagattgatttaatgaacacaaacctatctagagtgtgcacctgctttttcaagtgaaatcagcaagtatttatttggtgttaaactctcatccctccctgctacattctttctctttgacttaccacctttccccataccctagctccttttgattactatgtcaaggataatgaactaactctactgtcagactctctccagttccacatcattgtcttaagagagggcaagttcttaggctaggagagggcaaggaaagttttatcctaagtagaaatgacaattgactggtgctattgcctggaattctgtgctgagaggaatactcagaataaacccacagtttagtaagaaaaagtaccaaaatcaactaacagtatctgttacaggtcaggaggttccgagtggggcacttggacccatatttaatgtctccgacgggaggtttgtgattacctgtgcagtccattaggaaggatgcacaggttgctcacggtgaaagtagcctacaggagacaaacttactcccggggccctgtgccagggagtggtgcaagcactaaacagagcagatacgaaatcagagaggatgagaagagatctcatcagaatctcagagatcagagggtaagattggtcaatgttgttaatgtcaacaaaaacactctaatcctcactgtccttattcttttcctttatgtgtcatctgggcctttacgtaaactgccccatttcctgttagaagtaggtcaagtatgtacagaacatacataaacaaatagcgaacattagaatagagaagaaaaagatatctatatgagatctgaacaaaataggagaattaggagcagatggcttcttaaactctaagtcttgattgaagctgatcagactgatctctcatttagaggttcattgtttcagaaattcaaaataggaaacctatgcaaaagaaaggtgactaacacctttctgatttctaaaactgtctctctgacccctcttgcctctcttccaaacatttaaacaccctcaccgagtctgaatgtggaaattgttggtggttccggtatgctcgtagtcatggatggcagctgagaagattatagcaaagatctccagctccgtcagccagttctgaaaggagattacagagcaatcagataatctgtttctttctcaaagtcttcagcttgctgacaacacacccacagtgctgcctttctaccctgcagctggtaagctattgccaaacacaagttttctgagagacagaaataagttattttcctgtgaagagacttggagacttgtgatttgttaacaatgtgttcagcaaggttgaataagctaagtagtagttttatctttttcaagaaatcaaagagaatgaacatgaagacttgaaaagccctcattgcatcctcccccaacttccaaataaagttcctaggtagacacacacacacacacacacacacacacacacacacacataaaaaaattagaaatttgaatgcaataccaagaatgaagagtaatagaaaacctaacgtctgattataggaggatatccactaggaagtgggtagagacagatggaaaaatactggctttctgctctatgcatgctgatgatgtttgaaaggacttctccccatccacaccatcaacattggctgtgggtcagtggttcacaaaatgtgttccttggacatgcagatggtgtcagctgggagcttgttagaaatgctggcaaattcttcagccccaccccaatctcactggatcagaaacgctaggttgtggcccagcaatctgtgctttaccaagccatctagatagttctgatgcacactagagtttgaaaactactgctgtgtttcaagcttccttaactgacttccatttaacggactctgtggatttacttcctatcgcttctgtaaaccatcctgccccatgctcacacgacagaatatgcctgactcaggccaccttctcatatcctttgctcacttttgctactagttaaattcatgcctacatgattcagtatgatttattctaaaccacattttaataaattgtatttgttattataattatgtaattaaatatgacacaaaccaataaaatatggacacaaaattggagttgttatttctgtagaacctaagtttaatgctttggacagtcactaaaagaactgctatcaaaatatgtgtgacaactgtgaaagagcagaacacatttatagaaaagttagagagcttctgcactcagtttgcttcatgcacatctttaagttcccacttaactttaaagagatgagactagaaatcttagataggggcagggttgatgtaagacaaatgtgagtatccaaactggtgaactcataaaagccctgtggtctgaattaaagatcagtgcataaaatagattcatatgatttaagttaacgcaaaatgagttaaaatgaacatttaagtgtttctaatttcccacttaagccatatctttcaattaactactaattttggagaattattgccttctttaaaaattggtaaggggaaaataaacaaatgacatagaacttatgaaaaatacttcagagtgagcataaacataactcatgaaaaaataaaccactatacttttgaaaatgattcctaacagaatccagcatgaaatgtcaggaagctttctggcatcttcaataatatacctcaaaaacacaaattgaggtacacggaacagaaagtcaaagagaaaacagactaagatgaaaatcaacaaaatgagatgaaaaaaagatgggcaagataaggaaagattgcaagaaaaatcaaagctgcaaaaccccttgtaaaggcagcaaagagcctcctcatcagcctcttcattgtctcggggggccccccatgtggcaggcactatgctaggtgcttttatatagaaacttatataactctcacagctctgtaatcataggtactgttgctatccccacttgacagataaggaaacaagccaggggtaggtgcaggactcactcaaggtcacacagccagtcatctgacaagccacacaccacgcctgcagaattctcactcataatcttacattgtattttctttggatcattgttcatgtgtttattcaattttgcataaaattatataggcataaatttatattgcacatttttcttgatattatccatacatatattacatatgcagttttttttccattttggcattgtctttcttttcttccccaatattttgtccccacccatctgtccctggttccctctacctcctctcccacatatatctcttattctaaggtcacgtaaagttaatttcactttttaaaataagattatgaatgggagacagtgtaacatctcaacgaatcctagtcacagaacatcagcccaggcagcagaaagcatctaaataacagtataattacagttctcacattacaaccatagtgatgcttccctccttacccaaataattgaacaaaatcctatcttagatataacctacttctattaaaccaaaaacaatgaatggttaaacaggcattcaacaacaacaacaataaaaaacaaaaccattgtctttaaaactcattttaccaccttagtttttcaacaaacgccatgcatgcttagaatcagttatgctgctttggggataagaagaaagaaaagtagtatctgggagaaacagcttcacagaggagagatgtttaagatgggccttgaaaatttgacagagaaagaaatgaaggtgggcattttcagaagaatgaactaaatgagcaagtcccagcagcaaaagcatgtccacctcaggtaagaaaatgatgcccttgactggagcgggagagaaggctgattgaggccctatgaggtcaggcattagaaaacacagtgagcgaggaatgtaaaccagattcagcaggcagtgaagttcacacgcaagagagtcatgccatcagctccccacttcaggaaggatatttggacaggaggagagaagggagataaaaagcagggtttttttgttttcgttttgtttttgtttttgtttttttttaaacagggtctcactctgttgtccgggctggagtatagtggtgcaatcttggctcactgcaacctctgcccccagggctcaagcaaacctcccacctcagcctcccaagtaagggctgggaccataggcacccactgccatgcccagctatttttttttttttttttttgtatttttagtagagatgggagtctcaccatgtcgcccaggctggtctctaacttctgagctcaagcaatccaccaatctgggcctcccaaaattctgggattataggcgtgagcaactgtgcctggctaaaagctgtatttttagattgaaaagttcatataggatgtacagacagtgtggaggtagaagccatatgacttagcaattatctgaattttggaagtggtaggaggaccagatgaggttgcagttaaggagaacaatatgttagatgacctcaacactcctagcctcactgagtggctaataaacccctcaggtgatattagatagcatcattaacagaaacagagaaagtgggagaagctattttggaggaaattgaacttcctattttaatatacctcagatttccttgcctcttccaaattaactactgtgaacccagaaggttttatgtcaacccataagaagtcagaaattaaagtcccactggtattttattccagaattaccaattggtggcaaggtacaagtcacagatgctatcagtattttcctatctacaaaatatgagtgtcacaactagttcatttgaaaggatgctttgacaagtggtaattggggaccttgagttttgctgtgtatgactcaagaaagcaagccacttgttcccgcatataggggcagatgaggagacatggggtacaacagagcagaggaaacctgaagggaaaggacatggccaatttctcattgttagaggagatactacaagcaagttgtgacttttctatgtgaatgatagagtttctttagtaatctgttagttttccatgctaccttaacaaatgctcagtcttggaggcttaaagaacacttccgggcctggcgaggtgcctcatgcttataatcccagcactttgggaggccaaggtgggtggatcacctgaggtcaggagttcaagaccagactggcaaacattgtgaaaccccatctctactgaaaatacaaaaatcagccgggtgtgctggcgggtgcctgtaatctcagctactcaggaggctgaggcaggagaatcacttgaacccaggaggcggaggttgcagtgagctgagatcacaccactgcactccagcctgggtgacagagcgagactccctctgtctaaaaaaaaaaaaaaaaaaaaaacttccgtttattggcacgcagttctgccagtcagaagcccaggccagtgtggatgggttctctggtcagggtatcccaaggctgacatcaaggttgggaaaggtttcctttctggtggctctgggggaaaatctgctcccaagagtattcagggcattggcagaattcatttccttctaaccttttccacagtttccctcttcaccttcaagctggcaatgactgttgggtccttctcacacttcaaacctctgactttggccatatctccttgactttgatgaacttgtgtgattacattgggcccacctggaaaatccaggctaatctccctatttaaattcttctgattgttagccttaattgcatctgcaaaatctcttttataatccaatgtaacatattaataaacacatgtgacaccagagaacaaaggttgcaggagccaaatgtctaccaataacaaccccaataaaattatttggcactcttcaaacaaaatgtaattttgatatccttagtctttcctgttaatacattgatattatgtattaatatgttaataatatgacattatggtaatgtcataaacgaccaaaaaaataaaaaataaaataaataaaaaataaaaataaaaaaataaaaaataaataataaataaaaaataaataaaaataagatatgcagcttctcctttctggaaaaaaaaaaaaaaaaagacaaagggaaaattactggcaccttgcttgacaaaagcaaggaaaatggccaagggatagctttggagtttgaaatcttttcacctaaatcaaaagtacactagagcttagaatctaatgaacatctattcaatcaatagatagctcttcaatttatttctgtctaaggattttctcttggaaatgagcaaaataattctgaaaggatccaagtatcttctaggcacttaagttaaacaataatgagtaatacaaacagattacaatgttttacatttacaaagtatcactgttgatgttgaagcccagacaccactttatcaatgggttgttttgattctctacgtgtcttacaatttataacactgaaatgatttaaagcgttttctccctcttggtttgtaatgaaaggttagagtaacagtatgttctccattcatcagaatgctccccactgtttttgtaagctcacaatgaaagaagtttgttttgagctgcatttcaaagagagagtaggtaggaaatagtttctatatttaagaatcattctaaatatggtctgaatcgatcacggaaattcaacggcaaatgagaaatgagctcatttaagaaagcatgcagtaaatcatgatcactgctatgatacaacatttatgttaatgataacttgtattggcataaatgctgggtgtttttggtgagagttgaagaagctgtgcatgattcacttttatgtccccagagtacactctgcacaataggtgtgttgaatagatgagttcaaagtgcatttttgcatccattttcatcctcatcacaatacgtggaagtaagtgcacatgaggatactgaggtgtaagaatataagaggctttttttttttttttttgccaaaggcatattgtagaagcatgcctaatatttaaatgcatggcctctgaagtcagagctgggaccgaattctggctcccgtactgtactcagttgctcgggctgccataacaaaataacacgggctgcgtggcttaaacaacggaaatttattttctcacgtttctggaggagaaaagtccaaaatcaaggtgtcagcaggactgttttctcctgagacctctctccttgccttgcagacagctatattctctctgtatcctcacaatggacccttctacctgcaagtgcatgtctgtgttctaatctcctctttctctaagaacaccagtcataatggattagagcccatccatacaactttattttaccttaatacctcttcaaaggccatctctccaaatacagtcccattctgaggtcctggggactaggatgtcaatatatgaatcaatgagaaatacaatttagcccatatagctactttgtaatagaataattttaatttctatgaattagagatttatcttccttaaaataagaataatattacttgtaatgggaatcacttttgattgcccaactgccctttttttccttactaacaatgtctctgattttgtttgagatggcagtgtgtcagacttccctatatatcgcagtggccatgagacacagttctggccaataaaacagaagtgaaagttgctggttcggatttctggatagctctttaaaagtgggcagatttatttggtttccaacttttgtgctttgtattctgccttatcttcttacctggatttgcaaaggtacatcagccattttacaagcataaggacaagagctacagtcaaagaggtgggaaggacactgagaagactgttgctgatgaagagctgccatgccctccctagaagtctctctggacagaccacacaaacacagaggacacccacacccctgacccatctaacccacctggacattcacttacaaatatgttccaacaaccaaacttcactagacattttgagggaaaaaagccaatagtgtaagaagattctcataaacaaatagcatattccccatcagttaaaagagataattctgtttttaaaaagacttttaaaggaagttttcaaaacgtgtaggtacattcataaatatgtaagtttgctaagacaatagcacattcaaagggcaaaaaaagaggagttcctgaaattaaaaatattgctaactaaaaatgttaaataaacaggttgaataactagaaggacatatcggaaggccaaactgataatgtggaagaaagagttgaggacatctctcaggaggtatcattaaaataccgaaagactggaaaacatgggagaagctaagaggtatgaagatgcattcagaaggtctaagagaagtgccagaagcagacagaagagaaaacagacagggagaaataaataaataacagagagtgtttggctttcttctttccaagcatatagtaggattagactttctggcccctttatggttgggagggactgtgtgagtcattttggccagtgagttgtgagcagaagtgatgagcagagtttctgagccatagaatttaaatacagatataggaaaaccagagcccctttctctctaccataatgcctgacaacactcaggagggtggctgtttagaaaacctaggcccttggagtgagaatgacacaggcagattctttaacttactgttacgggaagtgaaaaaaagcagatattatttctaaaccattgagatttggggattgtttgatcctgtagcaaaatacagcctaccctaaggaaaacactccaaatgaatgaaacccttaggagtgaagaagatgcattctcccactaatatgttaccttatgttatttttaagaaagtctatatataaggtcatacaattaaaaggcaatcacaagttttgaaatatttcacatatatgacaagtgttgctagtcatgattacttatgtttagtaataataataactatcatttactaatattctactgtatgctaggcattaggtaatcatttttattaagaatactgagaaattcaaacattttctcagcaaaatattaagttctcaggaatggagatgttataaccaaagaaaataaaagtggttaatacataaggaaaatgtttaatttactagtattaacaataaaaagtaaaaacacacacatatgaaactttagtgggaaaatattgctatgcaaggaggctaaccagaatatcatttacagtagtgaaaaaaaattttaactgtttaagtgatagaataacccaataatgaactattaagattttcttataataaatatataatgacatagggaaactatcataatatatgatgtattgactatatatatatactatatatatagactatatgtatattgactattgactatgtacatttatgatttattgactatatatagactatatatatatgtaaacagcctatatacatatagagagagtgagagagagtcaggatcacagtattagagacttatttatcctgtttgtttcaataaatcccagtattatagacttatttatcctatttgtttcaataaataggacattggccatatatatagccaatggtacaataatgtacaatgtacagtaatggcacaatatcctatataatatagaatatattatatatcctataactttaataatataaataatataaagttatatcataggatatatgatataatataatgttacaatagcctgtaatgttatatccaatatcctaaaatgttcacagctcactttacctaagtaatggtctcatagagaagtaattttacaaataacatttaaacaatgtttaactgtttaagtgataggatgacccaataagggtccataagatgatcccactactgggatgacccactagtgttaacaaacaaaaacttcaaacaatacagatataaagttccctttggccattacttcaggatgagaatctccccagaggtaaccactatcttcaatttactgtttatctttttagatgtttttcaatatactttcatatatatctatgtgtatatacatgtgctatgtttaataatatacatcatgtagaacatatttttctacaactttttaaactgaataatacatcttgaattttagtcatagaaatctatggtattccagagttctaactccctattgataggtatatactccgtaattgttcactatggcaaacattgctacaatgaacctgattgtataggcctccctgagtacacttggaagtgctggaggattggtatgtatatttttccttatagtaatcactgcaaaattgttttcttatatgactataccaatttaccctcagatgagcagtatatgagaacataatttcttctcaatcagtggttctcaacctgggacaattgcccctccaaccagtggtttatttggcaaggtctggagacattattggttgtcataactggagtggggagtagtgctactggcatctcgtgactacaggtcaggcatactgctacactacaatgcatagaaaagcaacaaagaattatctggccccaaacgtcaatagtgctgaggttgagaaaccctgctctacatcctaaccaacagttaatattatcacactttcaacatttttacccatatgtatataatggattaaaactgtataagtttatatatccttagatactaatgaatggtgcatcttttcatatttcttttattgattaaatgtattaccttttctgttaattgcctgctcatactgtttgactgaatttgtgtcattttcctgattcatttatacaatctggatcttaatctatgttctctatgtattttctccaaatgcttacttcattaatttgtttatgatgctttttatcctacaaaagcttttaactttaatgtattcaaattaatcaatattttgttgtataacttttgtgtttaaaagcttaattttaaaaagaatgtcttttttcaaggccataaacatattctcattttttcttctaatatgatcaaatttttacttttgtacttacatctttaattcatttgtcagattttttgggggtgaatgactcgaagtagagtgaaagcattctcttttttctaaataaataactgtagccaaaacattttttaaactgggtgattttccctattaagttgtctatagtcatgtcttcatgttctcacctgcaattttttttcttcattatactctagtcagtgttccattctcaccaaaccactgagatgactcatgtcaaggtcaacaatgacttccatgttgccagagtgaatggtcatttctctgtccttatcttacttgaccatcggcatgtcccatgcaatgcaccactctcttcttgaagcattctctttccatggcttccatggccccaaactcccttggtttataccccatgtcactggccactcttttttagtttctattgttggctctaattctttgccttcattttgatctttggagtgttccaggactcacttcagagccccttctaactatctattcactctgtctttagataatctcatctagttccatgtcttcttatactattgatatgtccaagactacctaatctacatgtttatccctgatctcccctggaactctagcaccctttttctttctgcttggcctctgtaaatggatgtctactacggatcttaaactctacatgtctaaatcagaattcttgatcccctttcctccaaaacttggtttgccaccaggcattcttgtcaactgtttatcaaaccaagaatctaagatgtattctcgattcccctctttaatgttccaaatcctattcaccacagcagtcctttgaactctgtctcagaaacagcactttcttctctccatcccagcagcatccttcctagtccaaactatcagcatctcttcactagacttctgcagaattttcctagcaggctgccttaaaatccattcaccacagtaatcctttttgaatctttatcaggtcacatcacttccctgtctaaaaccctgtagtggcttcctactgactgcacttaggataaaattggaactcattagcgtggcctgtaaagccagacctgatctagctcctgcttcttcctcagcctcataatgcaccactgtccccatcatgtgctgttcccactaggcttgccttacttctgctccttgaatgtagcaaagttattctcttacaggactcttgtactaaaaccctgcactaactctgtggtcacactcttctttcactcttagcatggctgaagccaaaaaacacaattatctcagcttaaatactatctccagagagagtcctttcctgactatgtaataaaacacccagctttccctgggtaggtcctctattttaattctctacagagtattaataacattttcttgattgcttcccattggtctcttctatctgtaacttcacaccagaatgttaagttctacaagagtactgataccctcttaacttgtccattatcttagtccatttgggtagctgtaactgaatgctataggctgggtgacttataaacaacagaaatttatttctcacagttctggaggctaggaagcttaagatactgaatgccataggccgggtgacttataaacaacagaaatttatttctcacagttctggaggctaggaagcttaagatcaaggcgctggtagatttggcatctggtgagggcctgcttctggatttatagatgactgtgtcctcacatggcagaagagggaagggaactcatttttataaaggcactaatcccattcacgacagctccatgctcatgacctggtcacctcccctaggccccactacctaataccatcacattggaagttaggatttcagcagaggaatttgggagaacacaaacattcagtctatagtatcccataataaaggacccagcatataagttctcaatacacatttgggtttattttttgaaactctaatcaattctattgatatatttgcctattttttcacaagcagcacatgctcagcttcagtatgtattgtaatatctaagagagtaagaactattccctattagattgttcttttacaaaattgtcttttctaaggttgtgaaatacctattttacatgaatttcagattcagattatcatgtttcatattaaaatccttgaaactttgaatagtattgctttgaatttatagattactttgagggaaactgacatctatatagtactgaggtttcactcacattaaaaacatgatgccttttccatttatttaaagatcatttttgtgccctttgatttaattttagtttcctttttattgtttttgaggctctttataggtgatttatatactttttaaaaactgctgggaatgtacatttttctattacactcgttaatttccagtgcataggagagctcttttgtctagacctatcgaggtattttatttgatctaaaagggctttattttctaaaggagatgatcacattatttcacagaatatatcttcaacttttgaagatatcatattgcatactgcattcttgaggctgagacttccagaaaaatgccaagtaggaatattaatgtgggtatccctgtcttgctccatgtattcacggaaccatcattcaatatgatgcttgctctaaatgtttggtaaaaatcttttattgagttaaaaatgttccctttataatcttgttataactttaaagatagtgttttaaatactatttttaagaaatcagctttataataaggaagaactgaaaaaatgatcataggttttacaaaaattctgcaacgttttaacaataatgcctaattgttgagcttcctttatgaggcagagtacttaatatttttgatactttattctaaccatcagagcacttctacaaagtggaatatttttcaccattttaaaaaaatgaggaagttttcgctcagagactcaagtaatttatcataggtcacaatatctagtaagcaattaggcagggatttatagccactgtatctagctccaaagcccacaatcctcccacatattccatttttaattcagtgagatattaggccaagtctttcaacagtcactggaggaaaagataacaaatgtgccctggatttatgggataattgataactatacccaaagtatgtctatcttaatgccaattctaaaggagatttcgaagtaaaaattcatacagacctgtttttgcctttaatggctatatctttttaaatgaatggcttacatcaaggaaaaaaagaaaaaagcaaagacaaccaagttgagcaggtcagtaaacacagaacacagattcaaaaacaactgaagatggtgcacgcccatagtcccagctactcagcagcctgtgatagcaggaccacttgagcccaggagttcgaggctgcagtgagctatgatctcaccattgcactccagcctgggtgatagactgagatttccatgtcttaaaaaaaaatttttaaagcaaaaccaaaaacatctaaagcgctaaaatgttgggccaaaagaagcaaggaacatttcaaatggttagaagtaaagatttaccattaggttaaaataatgaaaggcatacaaataggatgtgaataactatagtccctgtgaaaaagacttagtggcttaaaccaaaagctaactttgcgtaacacggttgccaagtacattgaatacaatttcagtatacatgaatatcattgttattgaccatagcaaaaggttaacagtaccactctccatatctagaaatacatatttagttgtagtctttatatttaaattggttataacccagtgaagacgcaaatcactactaggtatttatctcatcaggctcaggatggagaaaatttcagaggcaacggagaactccaagactttccatattggttagattactcctgggaaacaggaagtccataaaacaatgcatgactcgtggcctccacctcatcagaattggaacagtcaccattaaaaactcatccttacatcttttggggaacctaagagttcctatccctacttaccgccactcctgtcttatagaggaggtaatgcactgtctgtgtaacatcggcagcgtgcattaagttatggtaaggatttttgtgcttgctgtatcccacttccagggcctccacaaatgagacaagtgcagaaatggggatctgaaagagagcagtaaggttaattaactagtgacttcactgctttcaatggagacacagaagtctaaggcaccaggactgctttttctctgaaggcataacacatgaggaaattggaacttacacagttaataaaaattactgacaaaattatcagataatttgaaaatctaacaggaagtccttggttgagaaatagcctgccttgtaaatttttctttgttgctcattttagaatccctgagaaatgacatctgatcattttaagatacttagttttagtaacatgtaaagcagtaatttttaatacacacatagaaaactgagttgttggtgactatgttaattttctgtatttccttgtcctcctctactcttaaatacccttcccctctaaccctaagggaaaaaaagatgctacataggacaccaaacaatgttgtaaataacactgaggaattcaaaaataatactaataattagtaaccatttgtggaatcattcactatttgtaatgtagtatcagtagaatgaaatcttccaaattccaagtcactaacaataaattgccaagtaacaaacataagaacatagcctgtttctgttcccatatataacagactatcgcattttggttttgagttttgtttttgcttggttttgggttttgattttgttttgtttttcttatgtgtccaatgtatataaccactcctttcaaagggcattgttttcaggcagtttatatttgttttgcaataattttataacttaagatttttgtgcactttgttttcctacaaatgagatatgctgcatagtatgtattcatttatttctcaacgaataaaatacttcagtctttatttgcaactaccagtcactcagaatatttccaattagattaattgttttgtcgtctgaaatatgtataatatacatgccttccttttctatgtaacagcgaagaacattgcaaaatgcatatacaaaataagggcatccagaaaactttcattgtattagttttctggatccattccatggttcagggtaaattatacaatataaggctaggggaaaaggagaggatatgtcttcctgaggattaacaattacatttgtgaaaaaaaaataaggaaaatgctaagttaatactcctgagattccataatctgttctcccttggtcatattcttccattttaccatttgcagaattttaaaaattaaaatacaacctttaagaggtcagagatgaattcattaccatttttaaaaataaagatccaatgaacctgggctccttgggttgtttcacagagatctaagagtcgctgaaagggctgtgtgtgtgcacaggaactttgttccaaggaaagtctccagcatcctctccagcatccacaagattttcatacagatttccgatgcaaagaaaaattaaggacctaaggaccatggccatgaagtatttgtggtcatgtaaagacatatttcctcagtgggaggggcttcaagatggctaactataggcatctggcactcacctcctccacaaaaaagaaccaaaatagcaagtagataatcacatttcaaatagattatccaacactagaattcaacagagaagtaagaggaaacacctaaagcaaggaaggagagagaatcaaggcatggattggctggaatcctggagaggctatctctccagcgaaaagaaaggtaagtgagtgatggctagcagtccacattcccaccttggactcctgtatcctagccaccagaaagcccctaaaccctggcagaccctgagactaagacagggagctgtctggagatcacatgaagacattgctccatacagggagctcatgctgggtcccacacatcccctaaccccctacccagctacagcaaggcaccatattgagagcccagcccccaccagactgcatactacctgggggctcaatagtccttgtatccccataactctggagccccattgacattctctgcctgcagccacaactgtggctggctgttgcctccagggatgaagtatgaaccatcagcaaagactgcactgcccccaggaacaaacccaccatgcaagttcatgcaccctaaggacaaaaccccccacctgcagcagcttccatggagggctgctgcagccatgaccaaagcacaagtgaagtgcatgctccccagccacccgtatacagctgctgccactgaaagcaacaataccctccacagtagcagggctgcagatccaacaggcccagttccacaccttccagtgcctcaacacaccatctgggggcctgaggatagcccagtccagtccactactattgggaactgagtactcatctcaagcacctgaggtcaggcccactcaaactgatgctgcatcacagctggcacccacctatacatgccacctgtgagcctggagactggcccacctagcctgttgtagccacctctatgatgcttggaactgaggggttagtctcaccactgctacttccaatgctcatgccatgcctactgttcaggggactgagaagcccccaatccacttggcccactgctgccaccactggctcctgagcaagccacctggaagcccaagaatcaggcctcttggatctgctaacaccagtgcaagtgtagaactccctggggcccaaggcatgggacaggcatgcttggcccaccactgccactactggggcccaaggtcaggcccaactggcatcccatctccagtgaaacttcaccacagcctccactaacaattacactctaagctactgaagaaatcacgtacactgctgacacggtttacagccaaaggaatcatacaaagactgcactactacacacagccagaattaaagccaaagttctctactcaaccaacatcatagatacttcttcaggaaaaagtcttcccatgtgaaagcaaattttaaaaatggaaataagtgactgtttaacaagatgcaaagatattgacacaaggacacaataaacatttataaagcaaggaaatatgacacttccaaatgattgactaattacccagcaagagaccccaatcaaaatgaaatttacgaagtcttggataaataattcaaattattgattctaaagaagctcagtgatatacaagagaatacataaaaataatacaaagaaatcaagaaaacaattcaggatattaatgataaatttaccaaagagatagctatcatacaaattagcaaagagaaattatggaatggaagaattcatttaatgaaatacaaaatacatttgaaaccttcaacagtagactagaccaagcaagaagaaaaaagttcagaactagaagacaggtcttcacaaaaaatgcagtctggcaaaaataaagaaaaaagaataaacaaagcctatgtggcgaatggaccaccattaaacaaccaaatatttgcattttcagggtccccaaaagcaaagaggaaacaaaagagtcagaaaacctatttaacaaaatactagtggaaaaattcccaaacgtagcaatagacttagacacccagacacaggaagctcaaagattcccaaacagatacaattcaaaaagatctccacagcacattagagccaaactgtcaaaatcaaagacaaaaaattctaaaaacagcaagagaaaaacatgtagtcacttataaggaaaccttcatcagatgaacagaaaatatctcattagaaaccctacaggcaaaaagataatgggataatacagtcaaagtcctaaaagaaaaaaaaaaaagccaaccaaggatgctatattgagcaaaggtatgcttcattaatgaaggagaaataaagcctttcccacacaagcaaatgcagagggaattccttattacttgaccagacctacagtgaatgcttaagggagtcttacgcctggaaacagagaaacaacatctaccatcatgaaaatgcaaaaggaaaaaactcactggtaaagcaaatacacaaatgaggaagagaaaagacccaaatgttaccactacagaaaaccaccaaaccacaattataaataataagaatgtaagaaaggacatacaacacaatctgaaattaattaataaaatgactggaataagtcctcacatatcaatagcaaccttgaatgtacatcaattaaacttcccactcaaaaaatagactagctaaatggattaaaaataaatccatgacccaactatatgtcgcctataagaaactcttttcacctgtaaagacacatgtagactgaaaagaaaaagacataaaaaatattccatgcaaatggaaatcaaaagcaagcaggagtagctatacttatatcagataaaacagactttaagtcaaaaatggtaaaaagagacaaagaaagtcatggtataatgaaaaaggaatcaattcagccagaggatataacatttctaaacatacacacacccaaaagtgaagcacccagatgtataaagcaaatattactagacctaaagaagagagagactctaatacaataatagtttgagacttcagcactctatcatagcatcaaacagaacatctatacagaaaatcaacaaagttggatttaaacttcacattagaccaaatggacctaatagacacttacagaacattttatccaacagctacagaacacaaatttttctcaccaacacaaagaacattttccagcctagaccatatgttaggacacaaaataagtctcaaaaaattaaaaatcaaaataatatcaagtgtcttctcagatcacagtaaaataaaactagaaatcaataacaagaggaaatttggaaactgaacaaatacacggaaattaaacatgttcctgatttaccattggattaagaaagaaattaaggagaaaataaaaatatttttaaggcaaatgaaaatctaaacatatcaaatgctatggaatactgcaaaagcagtgctaaaagggaaattttagcaataaatgtgtacatccaaaaagtagaaaaattccaaataaacaatctaacactgtacctcaatgaaaaagaaagcaatatcaaaccaaactgaaattagtaaaaaaacaaaataatgaagatcagagcagaattaaatgaaatagagactaacaaaacaatgcaatggagcaatgaaatgagaaaagttgtttttttgaaaagacaaacaaaataaataaattgctagctagactaacaaagaaaaaaaagagaagatccaaataaacaacatcagaagtgaaaagggagatattacaactgataccacagaaacacaaaaggtcatcagagactattatgaacaactatgtactaacaaactggaaaacttagaggaaatggataagttcctggacacatacaacttaccaaaattgaatcatgaggaaattgaaaacctggacagaccaataatgagtaatgagtttgaatcagtaatacaaattctcctgaaaaagagaagtctaggaccagatggcttcactatcaaattcctccaaactttcaaagaaggactaacatcagttctcctcaaactattccaaaaaattgaggggcaatttctccttctccctaactaattttacattgccagcatttccctgataccaaaactggacaaggatgcaacaacaataaatcaaaattacaggccactatccttgatcacactacataaattcaaaatatgttacaaggctatagtaaccaaaacactatatattattttatggtattagtataaaatagtattttatggtattagtataaaatagtatttttagtatacttttatgctaatagtatatttttatactattagtataaaaaatagtattttctggtattagtataaaaacagacacacagtccaatggaatagaataagaaacccataaataaatccacgtatttgcagctaactgatttttgacaaaggcaccaaaaacttacagaaaggaccccttcttcaagaaataactctgggaaaattgaatatccatatatagaagaataaaactagacatccatctctcatcatatacaaaaatcaactcaaaatctattacggacttaaacataatactcaaaactataaaactacaagagaataaaacacttcaggaaattggtctaggcaaagattttatggctaacacctcaaaaacacaggcaataaaaacaaaaatagacaaatgggactatattaaactaaaaatcttctgcacaggaaacaatcaacagagtaaagagacaacctgttaaacaggagaaatatctgcaaaatattcatctgacaagggactaatacccaaaatgtacaggaaactcaaacaacttggtaaaaataacaaataatcccattaaaaagtgggcaaagatatagacatttctcaaatgaagacatataatggacaatgggtacatgaaaaaaatgctcattatcactaatcatcagggaaatgaaaatcaaaagcaaaatgagatatcatcttaccccagtaagaatggctgttatggttaaaaaaaaaaaaaagatgcactggtgaggatgtagagaaaagggaacacttctacaacgttggtgggaatgtaaattggtacagtcactatggaaaacagtgtgcggatttctcaaaaaaaaaattctaaaagtagaactaccatgcaatccagcaatctcactactgggtatttattaaaaaagaaagaaagaaagaaagaaatcagtgtatcaaagagatatctgcaccctcatttttattgcagtactattcacaatagctaagatatagaatcaagctaagtgtccaccagtggatgaatggataaggaaaacttggtatacaaccataatggaatactattcggccataaaaaagatgaaatcatgtcatttgcagcaacatggatagaattggaagttattacattaagtgaaataatccaagcatggaaagacaaacagcacatgttctcactcacatgtgagagctaaaatttgatcttatgcagtcagagagtagaatgatagatactggaggctgggatgtgtgtgggggtatagggggttggtgataaagagggattggttaatgggtacgaacatacagttagatagaaggattaaagtctaatgttcagtagcagaatagggtgactacagttaacaagaatgtattgtgcatttcaaaatagctagaagagaggacttgaaatgttcccaacacatagaaatgataaataatgcgggtaatggacaccccaaaaaccctgacttgatcattacatagtctatgcgtgtaacaaaatatcacatgtaccctataaatatatacaatatttgtaccaattaaaaaacagatacctctccaaatacacagtccctaggagaaaataaagaaccacatctccggagaaatcaatatgtggtacagaaaaagacttgtgttttccagaggctcatccctttgatgagggaagtcagaggagcttgataccatagatgttggcagatgactacatcaactccctgaggatctgaccccacctcgagagtctacagtattagaaggctgtagggagttgaacactggaaatgattcaagttctttatgtaaagttgaagaatcaatttgaagcatgaatggctggaaaataccaatgacctgtcacagatgataagtgatagtatttgtctgaatgagccaagtggtgggaaaaaaaaaagtttacagagacagcagatgttcactctgtctccactactgcccctctgacagcgttggtcaataggacacaaagtcatgtggaaatgagacctttgggcagagcctgaaagggagcttggttattacaggctttgggttgtacttccaggaagaccagaatctaaatgggtctctcctgtctctcccatgccgctgagacccaccagcaagggcgcaatcaaaatcaccctccacagaggaattcacagcagtggctatccgaaggatgcttcctcagtcgcctggagcagttttcattccgcatattaaaatagtctgaacccaaaagtcatatgaggataaacatatgcatgtagtttatttattttttctttttaaagaggtactgaccttgaaacggctgatcagatcataacgtgtgagtagttcatagaaaataaatttcagtgcatgatccccactggcctcattgagggaaaagacgtcaaaggaccacttgtccacatcctgcaggacagggtggggagaaagaacacattagcccacagacacttacacacctaccagtctcctcactttcaagtccgcctgcagccctcactggagatttcacagtgtgacactcaaacagactttccactctcaaactttttccaatctggctagtctacatagtatctactgttaaaaaaattaaatagtcttattactaatacaaatagccataatttattgagtacctactgtatgacaggcattatggttggtgataaatatgtaaattatcctgaaaacaactctaagtgatagatattagtcgcattttatggataagaaaactgataaattacctaatttccctaacacccaaggtgcgtaagtgctagagatacaggcagggccagaacacaaacataggttggatgcctaagatcagttgctttccattaagccctgcagctgctactgtttaattcactacagcctacgatgcttctcttctctgaacttctctgcaatcccttgacactatccaatgacttcctctaagtttacagttaagaatgttaactcatttagaagtgttcagaaacatgcatgatgtagaacacaaaacaatatgccacatcaatcgaaactgctgagctgaaaccaaaaagaaagcattcatttcatatgacagaaaaatgctaccatttctggagtcactagtctgggatcttgtcctcaaatctgttagtcactttactgaaaaaaagtaaaaggaaaaactaaactgaacacacaccttatataccatccctgaagttcaaagtctttgcctgtaaatagctactccaaaatatatgtaaatacagtctgttgagctttggcttatcataaccaacttcttgtggatgtagtaaacaaagatttatttaagcaatggttaaagcaacagtcatttggcttttcacagcaccaaaatctcacttcccgtggttaggtgaagcatattcacttgagcttgacagcaaggattcacatgagaccacactgcctacaggcaaggtgtcagatggtacactggcagagaccttggttctcatgagtgactctcaccccagccctcactgaattccaacataatccatccatcctaattttgttcctgaccaaacattccaactgtcaaattcatcccaaggccatcaagggtctccctcctggatgctaataaactgttttcagggaaaatagaattgcatataggaaaatcagacttttccagaggggtttaaattgaattgttccaattcacacttagtggtaacctcacttaagtcttcaataactgcccctccattaaaataaccaaagaaatagtgacaggcacatttctgtgagcacattttctgtgctaggcacagtgtgagtgtttacacgcatttgcaaaacctcgcaagtctagagataggtgttactttctccagttttatagatggcaacctcagagagattaattgaaatgtctagtgccataaggtagcagagccaggtaataacctcaccaatgacccttaatgatctcactgccaacagatgaaattgtaaatgccatgaatatgtgctgtgacccaggcctcatccctttaatatcccactagggcgcaggctatagacagcaaggacacttaagattaacctaagacctaaagctttaccttggttactatcattggcactgccatgagtcacatacattgtcttatctttagtcctaaggaaaaagtcactgacaactgagtaggctggaaaatgctgtgtcacttctgacaatttttaatcctagtgtccagaaaggaaagggctctctatcactagaaataaagagattatcatgataaaaagccaagatttattctgaatatcaggacttagagaacaaagaggatgagcaaatagagacagtgagacggatgtcctctttggtccctcatgttagggaaggcttagctgtaattctcagtctaatgttcttcagaaccagttgaggggcttggccaaaatatggaccctccagtggggactccagagaatcctgctgtggggcctggaatccgcatttttaacaagtacccagtttaactgccttcaaccattcttcctcattcaccaaattttgcccaaggacacttcctgtagagaaattgcaggaacttcctgttagtctaacacaaaggaagcgtgaacctcctcatctcctcccactttaagcctggagtctttccaaggtgtcacttcctgagtcacaaaacagatgcccttctaaagaagagcacacagctacatttccattaggctaatctcagaagacaagaggtagaacacctcaagttagaagcttacatctatatatatatatatatatatatatatatatatatatatataatggaaaaagtaaaataacataatgcaacatgtttcaaatttagagactgattcattactatcttacttaaatatcattttatgtcatgttcttacgttaaccacaaaggttaacatgacagtagcataagggttattttagggaattgtattctctcagtctttagggaaaatttctgtaataaaagaaagcagtaatgattccatatgaacttctggcaatgaagtggaaataatcttttttctaacatgtagtacataaagaaagaaacaaaagagtctatatctgtgatcgctccaactcattgcaaacaaaatcagcctctggagaagtggaaaaaacattacattgtaaaaagctttgaacttccccagtaaacaggggacatagccaagagaaatagcagcttcagctttaatgcacatatcaacaatatatgtgaggagaagtagcaatttatttagagagctagtaggtcttccttatctgaataatctaagtacctgtcccctcagacaacatgtgtgcatctgagattttcttttctctaagtataaaataacaattcatgcacatcacagtttgttccaattctttctcagttattctgcatagaaaagaggcttcaatttggatagaaaagaggcttcaatttggaagaaacattttcgtaaatgtcttggtaccagtataccctcttgtatttatgttcccgataaaggaaaaaattaaagacaataatgatgcttttaatgtttctaagagtttgattgaacattcaggttcaattatgaaaattaatacaacttcatagtggatgttaagaaatatcagatttcctgaagtgatttcactgattaaaatgggaaatatcactgtacattacactgaagtattgggcatcagattaggggttaaagaggaatgggagaaaagatacatcttcttgctgggtccttcctgagtatccttcctgcttttaagattaggtaagaagagacggaaagggtagagacaaacaaaggagaaatgagaatctgtgtatatatggtctctcaaattcagctagtaaatgtctctgagacaagagaaaggcctatgaatacataatcaagattgtcccaaggggctctttcttgacattaaattaatcaagaagcactccccaccccctaactccatgaataggtaatttagcttctgaaaatatcacctttttcaggttttggagaaagaaaacaatggctttagcaaaggtcaaaatgctacaatgtccctaagcacatggcccaagtccatacatagacaacatgtgatgtcaacaaactcagtgatcttgggctacaggatcagcaacacattggaatccagaagccaaatcaagtttagcaaatctcaaataccctcagaccaatgccttcaggaatgcatctgctttggggctgctggagatattctatacaattccaagaacttgcctgactagaggtaattctgcaggatttagcccatttaaactcaagcatttgtatgacttccatgggaacatttggctcagtgagagtctttggaaaacaatgggctatatagatgggacaaaggctctcaggccatacgttcatgcagtaaaacattactaagagcttaccatgtgctgaaaactctgatatcaaacattagctctgtctctaattaactctttttttttaaatcttgctgagtctcggtttcttcatctataaaatggacttggagtaggtaatcagataatgggacaattgcaaatactgaagatcctcctaatgctgaatacttacagccataacatatttgatctcgtatggcaaaatcagataactctcataatgacagatcactgtataaaatctaaactactctagagtactagaaagaaatgaaacccacacagagtttgattgtttttaaattgggaagatgaagggtgaaaagacagtgatactgttagaacaaataataaaaagataatgaaagaataaagtcaggaataactggaaaagtaactgtaaatgaaagcctcttattttctaacaaatttaactctactttttattaggtaccatgtacattgtaaaatcttttcactcgtattacctttaatgcctcaataacagctggtggatagctcagtccaaccatgtttgatgtccgtctatacattctgaaaagccaaaagggaaaaatgcaacatgatatcttataaagtaggatttgtaatccacagactcataccaagtattgacaaataataagaagtcaagtggggtgatccaaagaacctaaaattcattttttgacatttttaatattcactcaggtggtctaagtgttaaattcaaaagaaattaaagcaatcccaaacatatgaaccatgggggaaaaaaaacctaactctataggccccagactggaaattgaattattaaatgggtcacttcttccgccagagtgaattatagtacagaatagacagtaagcagagtagtaatttagcctgaatgaagaactcctatgggtaacccatttagaatagcttgttctttagaactgtcaaaaacaagaaggaaaaatgtcccaggtaatctttaaacttaccgtggtgtttctaaaatgtataattacactataaggattataggaagaatatatctatttctggaatctattgctgggtaaggaggtcaatttgatttcaaagagtaaaatagctaataaaactgaagtgtcttggggacttcaaaccactgaaatgaactgtcttccctgggccagcaacctcaaagcatcccagatctgtttcaaatggagacatcatccacctatttcaaaagatgatagatgagatgatttcctgctttaaaaattagagactgaactcaaactaaatcttctctggtaaacaaaaaaattctgagcaaaagcaaaagcttttcctaatgatgctacagagattaaaatagatatgtttttgccatttctcattcaagactatctgtttctacccacaattttcagtatttataaagataggaaaactacattaaagcaaagcttccagttattggaaacgtgttgctttggctgctttagtcactaaatgacaatgaatgacatctttacctctccacaaatatcccagcctgcactgcgtgaacgatgctcttgaaccggggcttctcgtcgctcctcctgagcatcatccccatctgccgcgtgaaggtggaggccagccagtctcggacctcagaaggcacagcatctgactgaatgtcactgagctcatcctctgtatccaggagtctcctgaacacaagaaacagaatcagcacactgagattaaatctgaagttggagctctctgttcaaagcagctgctcctctctgcctcacctgcatgttaggtgcaaagaaaccaaattaaattggccacaaaaaatacagtgcctttttggtaaggcttatgtaagctcgccatgtgtgtttcgcgatggtcttggcttccactgatatttcaggatggttctctctaccagactggacaaaggaactggtccattgtacccagaagcactctgtggcatttgagtgaaatttaaaccttctatttaaaaatgccttcacagggagccttgtattatttcatagatggaccatgtgacgttattttgtttaaaaatataaatggatacttaagagactttgcaaagtatttaccaaatcacagcaacccagtcctctgaagtagtgatcctaagtgatgacaattaagattctttccaggttgctaccaaaatttaaatgtctaaattcaaggaaaattttcaaaataatgcagttctttatttgcgcacaatgatttaatcatctaatagctgtgttttgctgatttttcaaacttgttcataggtcagaccactagaatcgaacacaaagagcaatgttaaaataaaacctaaaatagcatgtcatatttacagtaaacccaactaaaaatcatcagtaaaagtagctgccaatgtaaaggtgtttggattttttttttcctttagacttaccaattggggtggaggtaagcggaggaaacataacatttggaaaaaagctatgatatcgaatttccttaaattagaaaccaagtgtgtcagcaaaataataataatagtaaaccatacaaatcttagattactgtgaaatactttcagattggaatttggcaaataaaagacatcacaaatactgacagagaagcctgtctaaattagggggaaaaaaaaccacacctttcgtattcaacatttcaacatttttcaaaagaaatgcaattttataactttcaaacgtatgtagtaactgaaaccgctttaatacgtttagataattcaagtggaataaacctgctaagtaaatcagcgacatacgtaagactgaagagggaatgctgggtgcttaagagaacacatgcttctcgatcacttcaggagcctccatttactaatggacattatgaattaaaacataaactcaatttttagactaacactaaaaacatacaataattacaatggagctctatatctgatttttaaaatcttagtggatttttaaaaattcgtttttctcctctttcatgatctcacttccttgtcatggcggccatatgagatttgttctattagctccttttatagatgaggcggtacagagagtaagtgacttgtccaaatctatcctctttgtttgtggaaactaaaactcaaagatgagtaatttgaatgtcaccccattcctggcatgggggacaatttcagaaaagccatttaagagaaaatttactatcactatactaatctcttttgttatttttagcttaccttgtttcatcaatatacacagattcaagcactgtggctgcatattccaaattcttcttaagatctaccactgaagcttcccctctctctaattgtttgaccaaagaccgtaatctagaaaaataaaaagacataatttcattagaatagaggaaacaaagaataatcctacaactatggtgatacattttacagtcatcgaatattctcacttattctgatacatctgaaaggaaaataattatgggaccaaaggagcaggtaataaaataaatgtatacatttttgccattgtgaagtaagaagaaaaaatttctctccaaccaggcactgaccatactttctagctagcttttatctttatgaatcctaaattatcaatgattttgctttttctcaaattttcatcttttttgttctatgtggatgtagtaaagcctgaccagcagcaaaatcaccaaatacctcttgagattctgctctgttgaaggcacttggtccagcagtggccccagataatggcagccccatgacccaggcatgtcccaagacagatgaaaacatataaaccactgagaaccacaagagggctacagaaggaatagatgaaagtaaattgttttactggacagaaaaaatcactctgagaggagataaataccctagttaaaaaagaaaagaaaatatgaggattgattttaaaccgaggaattccagactatacaagagaagcaataaaacatgttttttctgttatttatatgaacattatctgcacagaggacttagtattcatgagaacaataaaatgactacagatgatcaacatgcggtaactgagaatactgtaaataccacagagatttggagattgggcaactcttcaggctgtttgataaccagcaatgaaaagagtagagactttgaagacgaactggggtttgaagctcacttcataacttattagctgtgcaaccctaggtaagttatgtaacatctttgagtgttatcttaatgaagagcaaagtatgaaatttctaaagttgacctaaagattaaatgaaattgatatagagtatgtgactcggttgttctttgaaaaggcaatcgttatagctattgtcattattcaatgactttgatcaccacagataaccaaatgagaaaaattctagcaagatatttaaaatgattgtcaaatctccacttcccgttggtatacgcaatctgttctcaccttcctgacatcaaaatatcctcaaataggttgccttcatggcaaggtatagactactcccttcctgatttgcatgaaaatgacccacaataaagaatgagaaaaaatcttggatcaaccttaaaaagtaagcaagagggtcaaccataaaataatttccaggagtttcaatgatataaaatacaaataacattagattcaggtagtatctacctgaattacgaatctgcaatatatcaaacggaaatatgcaaaggaaatcagcagaggcccctgcaggcttggaggtgaaggtcagccttggcaatgccattagcagcactgggaagagttctgaatttcagaggcagcacgagacagggagttggcagggaagggcatgccagtcactcacacagaaggatagccagcctgccaaagaatggggagacagcagcagggagctctgactgctgctccaaataaggattggaagctctttagcaaaacacattcctggctaagtctgcctccagttctgattctcacctcaaggtgcccagctatcccctaggctgtttggactcccaaacgaaaaaatgagagtaaaattaaacttttcaaagtttagtctcaaaaatgaaagtaaaattagactttttaaagtttactctcaaacataagagtaaaattaaacttcttaaaaatgcctctctccatttggggcttacaggttctatcaggaactgacatgtaactctagtagaatccatctcaattctagaacctaagaggaaatgacaaaaaccaagaaaatgatgagaaaaattataagagtaatagaagtaaaagccagaagatcctatctacctataatagaacttccctaggaaataaacaacagaagcagctttaattgaataagttttcctaggctaaagtaaaacctgtataagcagatgaaaagggatcaaatacaattttttaaaagtaaatgaaaacatcaaatgtatgctactgtaatttttgatttcaaagaataaagaaacaaacttgaaaatctttgagaaaatgaaatataatacttacaaagtaacaaaaaattgtcctggccatctacttctatcatgtcaaacatcaaaaagcaatttaataacagtaccaatttttgagaataatatgggaaacttcaagacatttatatctacatctacagagttaccaagtacataagaagccaataaatacattctcaggtgtcaacaacttcaaaatttatcattcatatcctttccagaaaacaaaacaaaaacaaaaactttaagcacagtggtcttccaagggagtgaattcgtgagtctccagttaaatggattgttgattcatgacctagatttaactaactcaaactgtaccaaatggacaagtaatttaaaaagattctggaaagaagagacagataaaataaaatgctgataatacaaggacaactaaacatgaaaatgagctgacacgtctccttttactaggacaatctcctatttctcatacaaacacttcctctcccacttttacaaactaaaagctaattctcatcagttgaaaaataattggaattattaaggacattatatggactatggatgtatagccactaatttttaacaattcccactcctgggaaagcacagtattgagagaatcaagtcatgaaggggcctcatatcaccttgtgatcagggggctgggaccccagggccagaagaggagtggggccttcagggaaagcttcacttagaatctcactcagctgttccaatgagtagcactgaaatcggctccatcagggagacccaggctttgtgccacaattagcagaaaatcagccattcagaggcttctccctgatgtagtcaccagtggtgccaggcagacattaggcagtcacatttatgcattcagtgtgaagttctgacccaacaggaagctgtaaatagaaagcaaaaccctagccaagtggtttcaacagatccagagaggaaatgacacagaaataatgcaccttttggatgcgtgggaggcactagaaatttatatgtaaccctgtctttccagcttatgagatgagcagaagattcaatcaacttcctggcagacagtgagggaacctagaacaacccgtcactctgtttatggaagaacacccagctgacattcacctttctttactcaaggatgatgaaacagaaaaaaaattcatgaagagatgcagcaataaagacagaagaaaatacagcattcaaaatgtgaaaggattcacttttgaaaaaaaaaatcactaatggaaacagaagtgaattttagggagcatctgctgtgtgttcaatacaattcaaaaaaaacccatagatctctgaaacaaaggtaaaagcccaaatcaacacaataagaagtttctttaaaaagaaaaaaacatgacaatagaaagactacaagaacttattgttaaaaagagttaagtggtgaccagctttgtatatacccatctcctgtttgggtgtcacccatgtcagatacaagctgcagctgccaactttctgctttatgtagctgccacacaaagcctagtgattccagatgcccctttcaaattctgttgagctttagcatagtgttcaggtgcttatgctccataggcccctcagcccacctttctctagctctttatccattccatttggaatatccagccctgccctgccatatcctacctacctcttggtgaaatggctattctttgggcaaaagagtttcaaattagctcttttatcattggccaatttaagttcatgagaataaggacccctctctatttgtcattatagtgaaggtattccttagatcttaatctatcttaagaagggttgtctgaaaattagccaggatctttcatacccatgtcataaagtatttttgttcaactggaaaagactagctgaggccagagggctcaactgctcttctttgttttcctagtaaagttgtctagatgcttttcatgtgaatccattccatctaaaaggcaaatgtcctcagaggccaggtcccatggtatgctgcagcctatattttgggaaagatggagatctggtgttttaatactacccaggggaatttttggtctggacacctaaggggaatttatttcatgagcatttgaaataaatttacaaggaaggaagataaagaagtaggaaaatatacaaataataataatattaataagatttctcttctgagagaatgaatgttcatagtttccagcactccatccatttctgtcactgcagctgccagataatagttccagtatagaagtgcaacaccattttaggaagtgcttatgccttccaactttggcaagatgcctttcagttaagacagtgtgcaatttcattgtggatgagccattgcatcttttcatgactcttgcatttcttggcgtaaactgtttgctttctgtatgcttcttacctgcaaggcatatgatgagatactgaatctcttcagttccctgtgccctcagatccagagcgagccctggatgctgacttcccctgaccccacaccaatcaacatgtgggatgcacaaaggtgttggaagaggggaactatgtgaggaaaggccagagcactgtattttgtaatttaaaaggatgttagggaggagagatatttcttttttttccacaaagataattcctaggaccaatggagtgagcttcattaaaaagcaacttattggttcaactttataatttagaaaactgccttatactggactaggcattattccccaccccagtgaggtcgcagaaagccctataaccctatgccttgaaaacatatacatttgttgagcattagaccctactagaatttcattcttttgcacaaataaaaatgaactataaaaagaagctatggaaacatactttctcatgtttgtctattctgcccaaggttattccctctgaggatgggggggcagctcctaaaatgccagtgtaaccaacaagtactgctgtctcagaaaggctttgttttgtttgaaaggatatgagagagaactggatcttttacagtactttctctacatgtcccaatggatcatgagccctaaaaactcatttgaattaaaaaaacttcatttcagttcatcacacccatgtattcgaacagcatactcatctctgtgtccttttcatacacctgcctcctccatgtcactcctgtcctctgccacttacctaaatgccataggaaataacttaaaacaactcttccaaatgggatgccccaacatgacttttagtcttatgctttaatgccatccaatgatgtcacccaagcatttttctggccattgtttgtttctataattaatgacagctgattaagatggccacacttgaaaaacattcaacattgggtgtcttttgtgtgcaggcactgggagagataggctctaggaatacaaagtggggaaatgcagtgccttctctcaggtagggaagacagaaagctaaccagcacccacaatgcagtactgtaagcgaaatggcagaggtgtgatgggggctaagaaagcacagaggagaggaatcttctaataacaaagccctccccagtggagttgaccagagccattttgaaggccacgtaggggtcagccaggcacagaggatgggatagggaaacggcagactctgcatggagagagcagactgaaggcagtgatctattcagatctattcagaatagatcttttcggatcttttcagaatagatcttttcggatcttttcagaatagatcttttcggatcttttcagaatagatctattcggatctattcaggggcgtgtcaaaagataaaacagaagaaggtaggaactacaccacagtagacttagaatctcaagctaaagaaatgtaattttctcctggagataatggggaacccctggagaatgttaaaatggaggaacagaatgatgagattggcattttagaaagatcaatctagcagctgagtagaggagcacacatagtgagtgagatggaaaattctatgtttccattgtaatcaggctggtctgatactctgaacagcacagtgtgaatactctctctcacatgatggaaatttgatagagtgatgcgtgagtttagtggtagtatggatggttgcttttaagaatttctgggaaagacattgttttggggcatgcggtttcctcattgagtgaacatcaaaccaaaaacaagaacagtgccaacaaaaattatgactggcaagaatagcctacttatgtagcttttaccttttgttaatgctataaataaaagagaattttacttctacagtttctaattacatctgcttaaagcagatgcacacatggattgaaataaattactggactccagttactttttcacttaagaaaaataattagtacctaggtgcatacttatgtttctatacttttatatgcctcactacataacttgttaactaaaaaaaaattagtaatgttatagaagattttgaataacgtcatgaacaaaattgacctagttggcatggaccggacactgcactaaattgctgcagaatgcaccattcttttcaagtgtacatgtaatagtaatcaaaactgaccatgtgcagggtcacagagactctcaataaatttcaagtaattgaactcagacagataatgttctgtgacaacaatgaaacacaattttgttattgattagaacccaaaacaaaaaatggctagaaatatttcaagtgtatggaaatttagaaatagatttctaaataacccataggtcaaaggttaaatcacaaaataattctaactgaacaataacatacagccttgtagtatgcagctaaagcagtgtttagaggaaaatgtgcagccttaaataaatatattagaaaaggagaagtctagcctgtaatcccagcactttgggaggccaaggcaggtggatcacgaggtcaggagatcatactggctaacatggtgaaaccctgtctctactaaaaatacaaaaaaaattagccgagtgtggtggcaggtgcctgtagtcccagctacttgggaggctgaggtaggagaatggtgtgaacctgggaggcagagcttgcagtgagccgagattgtgccactgcactccagcctgggtgacagagcgagactcagtctcaaaaaaaaaaaaaaaaaaaaaaaagaaaaggagaagtctaaaaataagtgatctcgttatgcacctcaagaagttagaagaacaagttactccaaagacagtaggcaatagcaaaaaataagcacaaaaccaaaacttaagtagcaacaaactcacagcagaaataattagcaaagccaaaacctgggtctttgaaatgcttaataaaatggataggtcaagcaagactgatcaagaaaaaagagaaatgatataaataaccaatatcaaggataaaaagagactattactacagattctgtggacatttagaaaggtaaaaggatatcataaattcctttctgaagatacatttaaaaatttagatgaaattttaaaattccataaaatattaatttatcaaaattgacataagaaaaaggtaaactattaataattctgtatcagaataatgatacagaattgtatcagagtaattgatctactgaatattgtatgggaagtcttcaccagttcaacaaagaaagaagaaataatagacataggactggaaaaaaataatatctttaaaaagcagcaaataagttattctaattaagaggtgaatttagcaatgccacttgataaacagcaataaacaattagaaaatggtaccattcacagaaacatcaaaacgaaacagtttctaggaataaatcttacaaaatatataaaatcatctacatggaaaatggtaagatattattgagagaagtttaaatgacctaaataatggaagaagaatccatgctcatgaattttaacactcaacatttagaaatatgaattctccctaaattcacctgtagattaaattacaaacaaattcaccacaagtcatttggtggaaaccgattctaaaatttacttagaaatgtgaagaatgaaatatagttgatgtggtaaaacaacaaaactgttgttactatcctacatatcaagacttattataaagcatttaattctggtcccatgtccctctaccacttcactattccaactctcttcctttcaacatccagctggtatgtgtgaggatgtgcatatgtatttttatattcatataagcacaacataagtggacaagaaaacatgctacaagaaaaaagaaaacaggcaatgtaagttgtttttgaactatcctattctacatgtgattgttccattccacatgcagggacccactctttggatacccagtcaagggcatcactgcatactctgtcttggttgccatggattttctgatgaatatttccattcctttggttttcgtgaagctatgccacagaggagccctgcatgctcagtctcctccttgttctgctctacagagtgaatctcctttggggatatatgtttgtgggtgtgagagtatgtgggcaactgtgtgtccaaagtgagtgtgtcagctcactgcatgggaacaccagccaaaatgcactgtcaagtccaaaagaagccttctattcttatggtactctagaaggtgttacgactcagggttaaagttttaatccattttgagcaataatattgactttgttcctttgcacttcttatcaaatgcagtactttagaaaggagctccctaacagtcattcttggccttataaataagtgtttcttaaaaaccagtttatcccctgtttttattgccaatcaactcacacattttgttaaaaggacatagcggatttttttttagagtaagattccaaattatgctaagaaaatctttcgtgaaggtaaacattctctctccaaagtttgtaggcgagcagaccttattgggaaaggatgttattatgaaaacccacttgttcttctgggtgaagaaataaaaaagaatgaaaaatacaacccagagcatcattcagaatccaccccaggccatgctggggactggggagagggaagcagttaagatcctgacagactaccaagaggtaagttccagaagccagtgttcatttgcagctattcatgtggaaagaatcactgtcacttctgcctgctgataaacatgccacttcaacatctgtcttaatagaccaaagaaatgagaagaactaaaaacatctttgaatggcactaatgagaacaggaagctgagcagaaatgagaagcaagtttgcaggaagatttaggaaggttgcaacccatgcctagacacgtcaagacacatctttccatgtcttcatagtcaacccggtcccgtgactcctttgctttccttttctgaatttagttcctcattcaacctcaattgcatcatgttggtatgattatccagaggagctaaagctccctcagccagcaaaatcacaggaattctaccatactacaaatataagttttggtaagataaacctaaggttacatttttctcatttctacttcttttttcttttataataacagaaataaataaattaattcatagattaaaaaccttcaaataatggctaacaagatgctgaattggcacagttccctttcttaagattaactcaagaaaaattataggaaaaaaacctcaaagaaaaccgtgagaaacctctaaggtgacctgaggctgccgctttgaatgtgtgtgtgaagacagtgcatcttcttggtctgggacaggaggcagccccaccacactggggaggaaatgatgggaaaggaactgttggagtctgctattgtttccctccactccacttcctccaggcgcacagtagctgctcccacacctcctgtgactcagaactctaaatgtcaagaaatcctggagagctaaataggggttgtctgtcccaccttgtggctcctctaagttcaccatgggtttccaagattgtcacagaaggaaaagggatgcaaaaggacatgtgcgagaggtttttatgaaccagactggaactggaactgattgctcctggtcacttccaattgtccagaagccatagtcacctaactacgtctttccaagagagaagctggaaaacacagtcctgtggtaggctcaagaggaagaggtggtggttttagtggagatccagccaatctctgccccacctagaaaatgcaatcctatcaccaatacttgttttttcctttaaacctttactttctgctcctttgaaagagtcaaatggaatgttgtatattaaagatactttctaactttaaaatcctttaaaactaagaaacgtaatcatcctaattatcagataatctcccaagcattttgacaaaaatgagacagttctcatgggaattatgttgagtgaagaaagccaatcccaaaaggttatatactatatgattccatttatgtaatattcttaaaatggaggacaagattaggggtttacagggattggagagaagggagaggaagagggagacacgtgtaagaagggcaacaaagggaacctactggtgaactattctataccttgactgtggtggtggttgtacaaacctacacttgcaattatgttgcacagaaccaaatgcattcatacacacacacacacacacacacacacacacacacgtgagtacaataaaactggagggctctgaataagattggtagattatgctaatatcagtatcttgggttgtgaaattgtcctgtagtttttcaaaatgtttccattggaagaaaatgggtaaagggtacatgggaattcctctgtattatttcttacaataatgtgactctacaattatctcaaaattaaacatttagttttaaaaagtgggacacagttatccagctcaatggaatattgatgacaaaaggctggacatagttgtcctttccccagctggttttataagtgtctctctgttcttaaatagtggtctacttagtgtcctccagatccttcggcttggcctcagcagcagtaagagagttaggggtaaatgttcaccagtgagctactaactgtgtctgatgactttggagagcatccagtgagggctataatcagtgatgcttggagcttggtgagaaccagactcatgccttgaggaaaccctgggaaagacaaatggaggttctcaggatcaactgaagaaactcagatgctagcaaatggtcaccacactaaaacggtgagagaaaaagaatcccagtgactttactaaaggctcactaattacacctctactggcagtgatcccctgggactctaagatatgaagcacgatttgcatcttccctctcctttttcagttcattctcagaagtttgtttcaatttgagggtggcttcactatggcaggctggccatgaaggggttgtaaagaatgaaattaatatacacacccacacccaacctctagtaaccaccattctatgttctgcttctaaaagtttgatttttttttagatcctgaatatgagaacatgtggtatttgtctttctgtgtctggcttatttcacttagcataatgtcctctagggagtgaacagggaaaggagagatgttaatcaaagggtacaaagttccagttacacagaaggaataagttctggtaatctgttgcacagcatggtgactatagtgaagaataatatattatgtatttcaaaattgctaaaagggtagattttaaatgttctcaccataaaaaatgagaagtatgtgaggtaattgttatgttaattagattgatttaatcactccacaatctatataggtattgaaacatcacattgtaccccataaatatatacaattattgtcagcttataataaaagtaaattttaaaaataaataagagtcgattccataaaaaaatgaaaggaatgaaatctagagctagctatggactaagggagtgagggagtgagggtagacaagttggggtgtgaaaacacaggtcacggagacggtgttttgttgtatagtcatttccaataagtaggaaaacaatttgcatattattaacatttcaagtttgtattcaatgtaattaccattcaatttccttccaactatacatcattttgtaatagctttggggtgggataaggggagggatctgaaccagtaattcattgtcgtttgtggtcagctccagtatattctaataactgaacgtgtcaaaagcctaaagctttttcattttgtgctatatttaatagaaaaagaaaagaagaattgggaagacttacttatgcagtcccatctcacttgccagcaccacctccctttctttgtagatgaagaatgggactcctttcacttttagttctattaaaatagctctggctttctctgtggttaaaaatatgagcttgatatcgctcaggtagtgacacaaggtaaacgctaatacaggaccaactcccatagctatttagaaaaaaaaatcctcctctgttagctatttctatcacaatttacaaggagagttgatttacagaagaattagcagtaatagccacaaacactgttgaatcaatctggacaaagcactccacttgccccaaacaacccctcattgttcacggtggtaatctgttcattttaaaagtattatctagtgctttggagtttgtccctcaagaacagcatgagcctccactgtaccaggacttcctcgcttagcatttctaaaacctcttaaatctgggaacatactttgtaagatttgttttaaatgatatttgaacctacatggtgtcataatatattctatcattgtgtgtaaaaagaagaattcttttccaatgagctttattgagctttagactctgacttggggactggaaagaggaagaaacaattcctttaaatgattctctcttaaagtaaaaagagacaacaagggaatcatagaatgttcaacatttgctactgactctctcaaagtgtacgtgagaatttttaaagctccagaggtggtgttcacagctacgctatcgatcgagtgtttcttgagagggagtcttcttttctccataccaggtgatgctccgtgctctggggtcacaggagaggggcatctgccctgtccacagcctgacagagccaaaggcaagctcagacagctgtgacacctaattatgggtcttcccatgaagtctgaaaaatggctgaacttggtccagccctagtgtaaatagaacaaaataagcatatttgctggaagtgaggctggtctttaaaattcataatcacacatatggctccatgaaccatctgcaccaagccatgtctgtgtgtgacttttggctctgggctatttgctattacttgctgtggaccaggtgcagattccttctttctctctcagcccccacattcacatatttctcagaaaagaaattccattggaatcagaggtgaaaagctaaaacctgtggcctgggtgatctaccattttgacttctgtcacctaaaaccctagttccgcctagtgcagagatttttaccacttgaatgcactgatgtgtgacagagaagagtatgttgtgtttatatttcccccataccccctgccaacagccattcccaccacgagaacccccagggagcagtggaaagaggaatctcaggaaagtggtgtctatgaagtacatcagagttctggggcaaagtcctgaggcaagagattgttagacagggcaaggagagaatggatagctggggaatttagccccatttccttttcttaaactcagtaaagagatgacctccaaggtgactcccaggacacccttacacaaacccaagatggttacatcagattaaaaacagctgcatctgagatagaggaaggccacagttcagaccacctgcatcttcctcagctcctaggcaggaaggaggaagatttcagaggtcccctgtgccctgcaaagggacaggaagcagctgatagtgctgactggagggattattaggggcactgccatggatgagggacagagggtcagggatcaaataggtgctacagccagacctcagctggatccatagtgccaggaggagctgaacagggacaagctggtggggagaaaggcagtcccagacattagctagagatgtcactaagacttcctgtgaccaagcagacaagagatatcaccatggagtcaagaggaaccagaggacaatacaagaccctgctgtcttggagagtaacagcgagcagaataaagaaatctcaaagtctaagcatttacatttttttaagtgagttacctaaaaagaatgtttaaattgctagattgggtggtttcatgaattggattattattagtttctctcttttctctctctctctctctctctctctctcactctgtctctctgatatggtttggctgtgtccccacccaatctcaccttgaattgtagctcccataatccccacatgtcaagggagggacctcgcaagaggtaattgactcatgggggctggttttcccgtgctgttctcgtgacagtgaataagtctcatgaacaccgatgattttataaagagcagttcccctgcacatgctctcttgcctgctgccatgtaagacatgtctttgctcctcttttgccttctgccatgattgtgaggcctccccagccatgtggaactgtgagtccattaaacctctttttctttataaattacccagtgtcagctatatatttattagcagcatgagaacagactaatacactctcccttacatacatacatacatacatacatacatacacacacaaacacacacacaaactgccccatcacccagcagggtgagctcatgaaggtcaggtcatacataggaagtaaagaaacctcagtttctctgcacatctgaataaatctggccctgctatatgtacagcactcagcaactccttagtggcaggcagggcatagtggaagcagagatgggcacaactgttgtagtttggaggtccctgctggaagggtgaagggtgtctgccccaggaccaaagggaggaatataggggtagaaacaggacctgtacagaaaatgcacagtagttgggaagacatgagacatgaggtcaccaaactacgtgaatttattaccagaaataaagattcctactctcggacttctgtctgttcactcctactagctcttttgatctacttggtaaggatttattcccaccactgttacttaaaactgacagctagccttgttgaatatactccccagaaagctttctttagccttcttgtggtatattcacctccgtagcagccagtcagcaggcactgataaagagataagaataggaaaaaaagacagaagatctcttgaagaagtaagatattggtgatactattggcattgttctaaatccagtgcaatgattcccaaagccaacattgcattctaatttcctgggaatattttttaaagtacagaaaccaaggtctgactttagaccagagtgtgaaatggcataacaattgatggtaattctgaccttgtggggtgggacaacactttcagccaagtaattggaataattaagctaccttgtcatggtgttaattgtcttaataattaaacgaccttgttatggtttgaattatcctgacaagtgctttctaaactgtataccacaggacatctagcccacaggatgttaacatgcattgctggagagaagatttctgttgcacaaatatttgagaaatccaggttaaactaagttaagcaaagtttgtttggtcttcaccagctcagagctttttacactgatgtgcgcttagactctccacgatgaagcaattgtgtacgtcatttccctcctagatctgacaaggtcttgtatttttcttgtaaatcccccaggattagagggttttattgcatgggatttggcgagtgctgctctggagtgctgtcacagggctctacttccctgctgatgcaggtgcagtcagggaaggcatggattcaatgaacttgacatgaagtgatgattgtaaatttaaaacgagacagtttttttgtcacgcaaggaaagtgtcctattacaaattaagatacaaaggtaatgggcagaaaacatgtaagattatacattcgtggacttaaaatagcaaatcatggcatacagctatctttgaaaccagtttttctattttatgaatatttcaatcacttctttggttttctctcatatccaattttgtggcattattacattatgaacctatgatctcataaattaaacaggctcagataatttgacatacttcacttttacctcacaatgacgagagcatatttttaaacatctctcccccttttgtctctgaatactacttttctctaatattgttttctgtctctctctggacactctctgaggaccagttaacgtcatgtcaaggacaaatgggtgcatcattatgactgccaaatctcaagggtcctgttacatatttggattgtttttcctgaataaagcatagaatctccaacgctcattaattcttctatattcacatgcttttggttagaagaacttctgctcaagactacaaaccaatgggtttttttaaatatatatattttttcctttcttatagtcagaaaaccaacaataatttgtttactcaccacagaacattctcaattacaatgctggtatatattttttctcaggttttatttaatacttttcctaacacttcctaagtaacagaagggtttggtttctttgtgtgtgtgtgtgtgtgtgtgtgtgtgtgtgtgtgtgtgtttactatactgaaaaatgtgagatacaaataaagttttaattcatgttcttttaaaagagaataattgaaataagtatttcacaaatacctatcattagaaattcctttcatagtctcccacaaattttcttaaattttaaaaacctttgctttatttgtatttttaaaagaatctatggttattgtgggaaatttataaaatacctattagaaaataaaatcacataaaattgtaccacctagggattacaactattaacataaaatgtttatataattattatattgtatcatgtatccatagagtttaaacttctctacaaaatttatttgatagtatgctttaacacttaatgtattataaacactttcccttgttattaagagtttttctctgatataattttaataacagcatagtttgtctctaaatatacatatcataatttataaaatccactattgcaggacatttaggttgtttctgatttttgctgtcataaactgtattaaaatgaaagttttgtaactacatttttgtacacttttgttattttggcttttatttgattaagacaaaattcagaagtccaatcaggattaaaggagagaaatatttctaaatttgttgatgcttattgctaagcatctaaacacttatagcaacctcctctttttctccagcagaacgtgagcgtggctacctctcccagtaatcacagaaacctggtaagactgtttggaaggcaatggaaatatatgtgcaaaaatgttttttgtctcatttttgtaatccttggattttcaatggaaattttggaaagggcagaaataaagggcttgagataagatgaccatctttcactagcgtggcttcctccattgcaactagatttcaactggaagaagttatttatatttctaatataaaagagtaaagaagttacctgctcccctccctgcctctgtctgaagcgctccataattcatgcagcctggcatcctgtcagtgcccttagtggactgttgcttttagtactgatccttaccaagagcatgggcagtcccacttttttttttttttttttttttttgagacggagtcttgctctgtcgcccaggctgcagtgcagtggcgcactcttggctcactgcaagctccgcctacctggttcacaccattctcctgcgtcagtctcccgagtagctgggactacaggtgcctgccaccacgcctggctaatttttttgtattttagtagagacggggtttcaccgtgttagccaggattgtctcgatctcctgacctcatgatccaccctccttggcctcccaaagtgctgggattacaggcgtaagtaagccactgcgcccggccggacagtcccgtttctacaactcagtcttgcctataggtcacaatgcagtgaaaagcggcagctgatagtgtaagccccgggagatcccaaatgcccggttattaacaagtgttatatatttttaaaaagcaatacagattttacatcatatatgagaagggtgttgaaatcaagggaagaataagagacagggtggaaaaaaggaggcttccacgtgcgggagacagagaaggacaaaggcaggtacagtaatgaaaagaatgtgtaaacccttagtatgagcaggcctatgtaaatagcagattaatctattacccagttcattttgcccaaaggctttctttaaacggatccttgaatatgttccccattatagtctcatggtaagggagtgattctcaaggggggttgcaattctgtcccccaccggaaattagcaatgtctgaagacatttcggttgttaacaacaggaaggtgctactggcatctaataggtatgcagggatgctgctaaacattccacaatacacaggacagccccacagcaaaaaattatctggctcaaaatgtcagttacgccaagaaacctcactccaagaaaagcgaaagtgtagtattttttcatattggaaaagagcaataccattggctaaatgtctctttaattaaaaattaaaacccacaaaaagaaatgttcaaaagtagaaaaagaaaaatccctagcctatcacagatactctctacttatataataattgttttataagtctttccaattttatttcatattctctctcatcatatcaacccatttgtattaaatgtctgttgcataattacaaatacacaataaattattttatcaaatgcttattgttccttatatgaaatacgccattctaaaagttacaccttctagaaaacaagaaaaagaactaagtaacattcattatctttttattcctggctaccttttttttttttactgtaatatacaatcctttattgaaagttgtgaaagtactaccaaaatattaggttagagatggtttatcttttatattaacagtaagttaaaatttactacacaaacataatgactatcaattaataaatatggaaacaaaacagctgtcaaaaatgtactagatatccaatatcccatataatatttatgtgaagaaaaaagctcggtaattttatacatattcatatatagcaatatatattcatatattgcagctatatcacaacaaaataaggttgttgtctatgaagccctattgacttcttgagtatcctagaattttctgtttcagagtgtggttttcagctttaaaaatctaaaaattaaactttttcagtgttgtcattgtttaataagttcttcagattcatgctaccaagaatggttcaatattttaaaatctatttatataatgtaccaaataaataagttcacaaaagtctatatgatctttttgacagatactaaaaaaaaatttgatgcagttcaatatttttcttgatttaaacaattacatagtaaaccaggaatttaatgacttttttaaatgataaagaatacatatttggaaacaatagccaggattatatttactgaacaaacaataaaaggattctattaaggactggaataaggcaaggatgccctctagtagcattatttacaaaaaaaaaaaaaaatggttacgaattatagtcaatgaaataagaccaaaaaagtaggtagaaggaatgaaaaattgaacaaaaatttcattacttttagattataaaaagttcaataaattttaaagccattagaacacataatgaaatattatatagtaagtgattaccaaacagatacacaaaaataagtatcttcccattaaaggttcaataacatttaaaaatataaagaaagctattctattcaatataacagccaaagtatatatctaggaaaaaatgtaaaaagaaattctctaattccatgtgaagaaaactataaagttctactaagggatataaaatgaatattgaagaaagtgagatccacatcatatttttggatggaaaagcttaccattttaaagatataaatttctcctcaaattaaattctaaactatggatttgttgcaaaatttgagaacttattatataatttaacatagaaggctaaacttttaaacatagccaagtaatttctaaacaaaaaggaattcaaaagagaagtaattttatgtcttgtcctaccatctataaaaatataaattttaaaaataaaaacaatacagcactattgtcaatattgagaaaacaatctgatagaataaatagaatttccaggaaaaaatactaagtcacaggataggacttatatatgataaatttatttcataacagtaaaaaagtctgaattattgaacaaatagtatataacgtttgtcaagtatagctgtaaaaataattaatgcatttttaacaacttaccccaaaatattttccaaatggaaaagatttaaagatttaaatgtagaaaagtaaactcatacaaatacttaaaataaatgtaagatatatattgtatttatataatttgtgagtggaaaaggtttctctaagcatggcatcaaagcttgaaagcagaaaagaccaatagagcaaacaaactaataacaacttataattgtaaaagatttaaaattatattaggacatgagaaaaaatctatttactacatattataacaaagtatcatttctaagagacttgtgaaatcaataaaaacacaaatatgctttttacggaaaatataaaaaggaaatgaaaaagcaattcacagaagaactataaatgtccaataagcctagaagaattcatgagcctcagaaatgcaattaaaatttcactgggatttcattttatttattaaattggctaggatcataaacaatagtaaaactctgtgctaagcagcacaggaaaaaatggttgcttttgtaaattgctgatgggtctataaattagtatgatcttcttggtaggcatttggcaatatttgccagaaacttgaaaaatgtaggtatcctttgatttaaaaatttctcttctagttattcatctaataaaataaataagcatatcctgaaatattcatttacagacattcatcactgttctggctatggcagcaaagatggaaaacagcaaagtttccactaacagggaattgattaaaaacattattgtaatatcacacgatgaaaaaatcttcaatttttatagctatcattatcattataacacatgcaatttagaattatgtaatatatagtataattataatattgatatactatttataatatcgattaacattaaaaagttcataatatattgagtgaaatgggtaggtacacttacttatcagttacctgatagagtctacataatagatctgtcctagtcttcctaaaccaaatgctgagattatcaaacaagtatgtcttatttctgaaatcagaatgttttgttttctgttacatatcagaatattttataactgcatatttcatttgaacaaataaacttcacatgctaacttatggtaaggcaaaagctgtactactctttcctaaggaaataatcattaactagacttaaggcattaaataatgaatagtgattttataaaaccattctatttctaatgaaaatattaaaatattttcaggaaaaatgagatttctgaaagaaaattaaaaattttgcaaatgggagtcatgggatactacataatattgttttaaaatgctaaaccaaatcttgtcatataaatcagaaaaatatctgaagttgtatggaatgctcaaaacttttagtaaattataatttattttctgctagaaattaaagtcaagagatcctatttttacaaaaagtcataaaatacaaggaagaactttttataaccttaagaacaatgctaataataaagatattcaactggtgaaaaattctaaagaaccaacttttcatacatcagtaccctggtgaattgtaaatgtcactcaaataccacaaggtcagattcttagatcaattcctgcattaatacttcttgtataacctgccaaccttcaagtactatatactctagtcagcctggaatgttgtattataataacttaaaaattaaatatcaggatagtctattcttttcccaaagcttcaaagtgaggagcccaaaatgggaagactgattccttaagagagatttctccaaagatgagaaagatttgcctgagtcaaataggaagtcacttggtcaaacccatttattattacaatctaattatgttttacagctgctcatgagatgtctaggaaattacatttgcaactttagtcaaaggaccaatattaatgcttatttaataatcagttctttgggtatctctattattgagataaatatgattgagacatgataggaagtggtcatttctctcataaacttattctgaccttcaacgttggtgtataattgcacatttatacaaatgtatgtcatttataattgcacatatgtatgtagaacagtgaactttggctggtgggaaaattcagagtgaagattttgaagattttcttggtttcatgactaatcatccttatccacaagaacagagagtgctatatgcagcctttcggaaaatgcctgtcctttcagctacacaccacattaggacagaagctggaatccagcctgaattgacacaggactgggcaataggaagataaaacattctaactcttcgtttggttctcattagagctaacagtgaatccagatctagagacactgctattataacacaaaatttgcgagcaaatcacccaaaataaaaaaaaaatctatatacaatttttaaaacttctcttagatttagagtcctaaaacaattgttaattttgcagattcttcagattctcctgaatggaggtatcacatctccactcacttaaaaaaaaaaatctaaatccactgtgtccaaatatttaaatatggagcaagttttatgtataagtattactctactgatccctgctacatactacttcgactcactatagaaatggctaagaacaactaagaacttttttccagcatttacaggtggtccatcatttctctaaagaaaaaaaaaacactaaataaagatcttattaaaactcccatctcaattgcaagtaaaattaatattttaattgtaaattatgcatcctatcctctatgtttcatgcctataactgattaactttaaatggcttatggaaaaaggtttggatcctctgtcaatcaaccatatttgttgatgaaataattttatcatcataaattaagagcattttatccagtagttgaatgtgttacctagttattattcaactaataaacatggtaaaaagtatgctagatttttttaatttttacattcttttatatattggctgaacatacttactatgggctggatactatattagatactgtggagaatacaggtgaagctgacatggaccttggcctcatacagctcacagcctaatagtatgaattcactatgaaataccaaatgattagttccatttaatataatgaacacttaaagattatcattgtgccatacagtattctagacccaagaaataaaaagcaaacaagtcacaaattgataatattccacttggtttcaaacataagagagaacatctgtattgttgtggattcttatagaacatctctatttttatagattatttaagtatcatcactctaatatataattagatgtcagtagacctggactttgttatcttggcttcctgaaaaacaaaatactggattaaaaaaaatgttatgccatctatttttacaaaacttttagagatgaaaatgtctatttgaaaagattataccttttcttgcaggattatcttgtataaagaatcagtaaaataaatcccttctacactttagagccaaaaaacaatttcccacgttaactggacaatggaaactatacaatttaatgtgcacaaatttttatcttcttttaaagcccctgtggtcaaaatttcctttatattgctatgagcatagtggacattgaataaataggttagatgaataatgaacaccaaaccaaatatttcactttagacacactttcttgtgctcaagttgatacaaaattggttagtagctgataaggtttggctgtgtccctacccaaatcttatcttgaattgtagttcccataatccccatgtgttaagggaggaacctggtaggaggtaatcgaatcatgtgggtggttacccccatgctattgttctcatgatagtgagttctcacaagatctgatggttttaaacgggacttttccccctcttgctgggcacttcttgctgcaagaaggagaattgggcacgtctccttgcttctgtgaataaggacatgtttgcttccccttcccccatgattgtaagtttcctggggcttccccagccatgctgaactgtgagtcaattatacctctttcctttataaattacccagtctcaggtatgtctttattagcagcatgagaatagactaatacactagcagtttcttcgaaaatcttcacatttgaaaccattatctaacgataaccttcttctctttatgttaaacattctcaagtcatgtcctcacaaacacccatgtttaacaccttaaatcatctcacttattcttacatcatgcttctagtttctccagggccttttaaaagtgttaataacatgagatccaattagttattatctctcaaatgtcaacttctcctaataattctcaagagcatgttaactttttgtattacagtagaagcttacacttagactaaagtcaatctgtgattcctgaattttaactttgctttaaataaatgaagtgtagagtgaggtacatttcctttgggttggtcttgatacaggatgatattcagatcagaaatccccatgcttttggccacgtgtactgttgagtcaacaacatttttgttggtgccaagtcaatggcaggtgttatataggctacaaagagaagggattcaggaaccttcaagttgggtgagagggaaaggcattcactcatgcagcagtgagcgaataaaagaagggctagcccaggagtctagcatgtgacctttagagtataatgccttccattccaaagcctggcttttgcatttactagttgtatgaccttgaacaagctttttaaatacccaatatttccatttcttctttggtaaaataggaataagagtatcttcctcatagatttgatgattacacataaaataatgtatgtagagaggttaacaccacgcttttaagccttcagtagctgctatgtgtgcacgaatgcacgtgtgtatatactttgtgccaggtactctgctgggtacataaataactatgatgcaaggcagaatgaaagagagaaactgaagagcaagaataggacttgagaatgagccaaccatttcttgatatgtggggtgtgtgtgtgtgtgtgtgtgtgtgtgtttcttacctcagggccagaactaatttcagatgatgggaaattctgaccctataggtaaatgcaaaataaatttccttgttcaaggatgccgagagcaagaaaagtgccatccaagacatattacgtaaaaattaagtctcattctctgcattcctgtgcatgatttcctccttcccaaaacatgcaagcctgcctaggtaagatcaactctgagttataactcagtctatacagagattatcaccaagaaaaatcagcaagtataaaagatttttaataaattagaacctgtaaaactttatgagaagcaggtgtctgagtcccattttataaaccatgagcctaacagagttatatgaactactgtgaggttgttctgtctgtgagcaacgatgggaatgtaatcacatgccccacaaactggactatgataagcatccttttgttagggtaataccatttatacatttatttataattttatattcctccctttcatttcattctttgttgaaagcaaatgtattgcaactcattggcaggcaatttatttcagggcgaaaagtaatctaaatacaaaataataaaatatgtgaatgtgaaaaaaatcccaaagatataagcagatttattatacatagctggaaaatatctcgtatatgaagccattcataaagtgagttaacttctctgtgcagaagttctttgggaatatgcttgtacagagtaatttactttcagtgttagaaattacctggaaagaggtgaaaattactcattcaagtcaagaagtatttacatgccaccaaataactaaggtgaaataaaaccttataggagaaatagaagaacagaatgaaaaaaaagggaggggcagggtgagataaataaataaaaagctaaagaaaaagttaaaatccacccagtatttacacaatgattgaataataggacaacttttatcttgacttcatttaaatgttttcagtaggaaagcttgacaaaagtgacattcagtcattagtaatattgctaaaaaagtgaaattcagtcatcagtaatgactgaaagtggcattcagtcattagtaatatgtcattagtaatattgctgtataaactagaaattgttcttttgaatctttaaatggtgaaaacagtcaatagtgttttcttttttaaattgttgcttcttgatagaatcacagtttctcttttattgcatcatttaatctcaatgccaagttttgaaggtggtgccaaagttcactatctgtctgggtagcagatgaccaaaacgcccctccacagtaagggtgcgtgagtactctggttccagcgtatgctccacacatcccaccactgcagggcgcatccaggtgtgctgtcatggtcagtttgaatgcctttatcagtgactgtgccatgccacatatataaagatggaaagtcaagtccatgacctccaggaatacatattctgactttgcactgataacctcatttagtccacaaaacacagatatgacgtagttaatgttattattcctgtttcagaaacgaggaaactggctaaaatactttatgtgactttcagcagggtcacacacctaaaaagtgatggcactcgactcaaacattgcagtgatatatgtccacttggctaggttatatgtccacttggctaggttacagcctgcagttattcaatcaaacactaatctaggtattgacgtgaaggtattttgtaaatgttattaaaatccataatcacttgactttaaataaaggagattgtgctacataatctgggtggaaaggccttaaagcataactgaggcgtctctgaaaaagaataaattctgcctgtggacagcatcttcaaccttgcctgagagtttcaggatgcccttcctaatggtctcccctgcagatttcagatttacctagtcagccctcacaatcaaatcaggcttttgcttgcaagaagtctcttattatgtatctcctactggctctactttctggttgaactccgactgaggcaattactcctgtcctcttacgtggtaaagggttgtggttattctagtcagttcatcgggctctactcaagaaacacacagggtctggaagcaatataaaacttagcaccaactgggacttcctacaagctttctaacgaaaaacaattttaaaaattacaagacataaatatgtggatttttaataaagaccctcttagtcatctttacatacttaataggtgcttgacaaacgcctaacaagtgaatgaatgagggaatgaatgactaacttggtttggctggagtcctcttgtgctttatctctcagattcatcactgcaatgatcgggacgcacagcatagaaatatatacatatatatatttatttaattcctccaaactctatgagatgtcatgccagagattatcaattctgagatgcattcatttcctcattttaatatttctgaaatagagatgcattgtacaaaacatagaatatcataacttatttggcattggtttgcctttcttggtagttcataaaatgaaggtatactttatgattgacagcattttattttaattgaaatatagtattatcaccatgttcatttttcagatgagttcttcaggcacaaaggctaagtacctttcccaaggtcacaaaattagtaaatggcaagtcagggtttgaacccaggctgtctggcactaaagcaggagtttccgcaaattggcaccattaacattttggactagataactctttgttgtgggggctgtcccatgcagtgtagcatgtttaacaatatccctggtctctacccacgagatgccagtagcatccacccccaagttgtgacaactaaaaatgtttccagactctgccaaatgcctcctgggaggtcaaatctctcctaattgagaaccactattctagggtatgtttaatcactatgcaatatatatttttccctaaaaatggaaacacgcccagggtgacttctactgcagccagaagcaagttgggtccaccccagaaagcaggaatacttttccctgaagatggtccttttccccaatttcttccttgactcttactcttctcttactgccctctcctctttttcaactttgcacagttcttcaggcagtattctttccaactgcttgccaggtcccacatctgttcattttgttggcacttaatttgggactgctctggaggtgctgacagcattagtactcctgttcctccaactgctgaacaatcttaattgagctgtccctgtctccttggtgctgtcttgtaccagctccaccccatactccagaagacgggtgacaggcactatctacttgctccagctttgaccaaataaagaaaccaagaagagacttttcaaaagctagtagcacagtgaaactcaggaaactaatgaacatgatttgactgtaataggttcttattcaagaatacatctgttctcacgagcctgtaagttaagaggccatgtatgtggtggatgagtccatggcctctaaagccaaatggcctgggtttcaatcccagctctgcctgcttctcagtaactgtgtgagcttgagctactcaatttttctctgcctcagtttcctcctctgtcaagggggaaaatagcagctttatctaatgtagttggtgtgaggagtaagtttataatgcatttaagagggcctggcccacgtaaacaccagaagagtgtttgcaattattagtggctcaacttcaaaacaattgtggtgcacttttggcttaattcgataggctggatttgaatttttaggttcattttttaaaacggaatactcatgttgaaatactgaacctaaaactagcaaaaatatgtaagtcaattgcttacatatattcagaacaggatatcattttagatttagtttatacacacacatacatgcaaactagtaaattccagtgatggtaaaattattagtgttttaacaacaatcactcctgactatctgatatactatatgatggtacatattggttattataacatatagctatagatataaaacaatgatctcaaatcctgaagttctatctgaatcaacaaaattaaataataactaggatgttttaatattaatattaatatgcttgattagattttaatcctttgaaaattgagagaggcctatatgatatttgtggtgctacttgtggcctttctacctgatgtgtaacttccaggaaaaggacaatctgaaggggctcagtactgaagtaacctctgagcttttcctacacggcccctcctcacatttactacagcattctgtattagccaccaaaactgagcaaacctcattccgttagctagtctccaaagaaggtagcacctgttactaatccccctgctaatctccccagcacaccctggatcttcacttctgcccatcacatgagatgtgcagcctgggaggcttccctttgggtccctctagaattagaagtcattcccatttactataagccaggtgtgcatcatttcactgaaaactgtcaccaccatcctatgagccagatgctttcattatgtccattttacaaatggaaaaactgaggctgagagaaggtaaataaatttcccccaagtcagttagaaaatctgtgcaaataccctattgcctgtatctcaaccagccactgagattccttgtttacttctttgaaagtgtgctgcctgttgtccatacctcctaaggaagcaaaattgagttcactctcccattgcccattggagaatcaccaccccatagctttctatccaaagcattacaggagctttcatattctctgttgtgctgcttcaggcaggtggtattttcagtgtgttaattttttaaatcataagttaaatccattggttcgagggcaaaaagggttactctacagaggcagaagtgatgttaacagaccaaattatatatatgtacaggtcaccatgatcagtaaggaggagaaaagtcaatgaaacctattagttctgaaacaatagataagaagagagaattctacttcaaatcaagttaaccttacaatctcacagttttattgtcatatagttattaccataaatattcagaatattttgacttaacatacagatgtcttttcatttgctcaaaaccatgcttctgaaatgagattgactttgggagaggaagtactatttttatatcatggtgtattaaaacatagataaaaggccgggtgtggtggctcatgcctataatcccagtactttgggaggccgagacaggtggaatccttgagcccaggtgtttgagatcagcctggacaccaaggtgaaatcccacctatagaaaaaatacaaaaaatgagccaggtgtggtggtgcacagctgtagtcctaactacttcagaggctgaggtgggaggatcacctgagccagggaggttgacgctgcagtgagctatgatcatgccactgcactctagcctgggtgacaaagtgagaccttgtctcaaaaaatatatatatataaaataaaaaattattttggcttgtggcatggggaattagttccctgtaattcagcaagatgcatccaagagggctgttttctttaaaaaagacaacagagttagctggctagaaattatttggaaaatagattttttttttggacacagaaatgtatttcaaagacaataaatgaagattattttatttcatatattagtactcaatgtttgcccacatagttgaactaatttttgtcttcttgaccttaaatgtctggctagaccaagcactttttcatattttaacctatagtaatatttcatattttaacctgtagttttggtgatcaagagacactagagctcagaaacagatgtcttccaagctctgttgattcaccatatcagtctgaggactccagcatcctgaacctcagcttgcatccctgaaatggagtggtggtacaggttcattatcatcacaaagaaaggatgctagcctttaaggctacactttcttccatgttatttacaactcaaagggcctgtttcaagttccattttagctccctgtgtagtacactgccaagcacatgaattttcaatgaaaatgttggaatgaaatttcagcatttcttaacagagaagtaatcaccaagatacgagttaatgctttacggaggttatgtctggctccattctattacagaatgaatcaaggtgaaaaaaaaaacataaataatgaattgtgtcctatttgggtcatgtaggaagggaggttattggtagcaatcaacactgggtcagaaagacaaagccagaacctggagccagaagggcaggcagcaggtgtgaaattagagatgtgatgatggaaaaacttagaaacagcagacaaaagacacaaaaatctgaataagacaagtggtggggtgatttcatcatttaaggcaactcaagtgatcaagtctgagagctgtggtctgggactaagacaagagcagtctagagaaatttaaagagatgctgtgtcatcccctttgaaggaccaagtgcaaacttatatttgtccttaaacagagttctccaatcccagcctcacaaaaccggttcagctatagctactgaacggcatctgtgtgctggctttccatctctgctcttgagcacaaagaacaaagtttttcaaaaggaacttgcacagtccacttcataaatctcccttcagcttgctaccttccgcccacatctcagggttgtatgccagctagatctacagcagttatatttttaaaccagcaattatcctcattcctgctcactgacatgccatacagttaatctggtttaggtccaaggtaaaaaaagggaaaatatataaattcacataaacataattcacattggctcaaaattactcaaatggttttcaagcaactccaatctgaattacaggtcagtttcaaagtcaattttatatcaaacatgcatcaattacaaaatttttccaaaacaactgtaaaagaagtcaaagtccaagatcttaattaaaatatagtttactttagagaaggtaaagattatcatgggaaaactctatcacatcaagacaaatataatagcttgaattacatgtataaaattaacagactggaagggaaagctttatgacaagaagttccgagaagaacttagtgattctacatccaactttattcatctatatccaaatgttaacatataccttgatttttctctttgttaattaaatatgaatgcttaccccagctataataagaggaatctagtgaaagcaaatagcagacctaacataatccctttccctttagctatagtcaactcactctaagtgtttccaaggcaaggatatgtagattaggtaaattgattccttttttcctattatcagttgtcttcttcagttatcacaaaggttgaacattaagctaccaaatatataagacattgcctcaagaacaacttgggtaaaagatacccatgccacacagacaattataacatgattatcttgaattttttcttctattttaaatgctgccttgtaccatttataatagcaaaaattgctgtccaattaaaaagtgtttggaagagaagactccagtttaattatgaagggcatcattactataaagcaatgacagggtatgctcaggaatgaatccattatcacagaaggaccacttatgcgacaatgatgttttctcatctgcccccaatatctccatttcgtctagttcctcctacttatcctcaccacaaggtaaggtatctgaaagtgctgaacacaccgcctgatgtaaagcaggtatgcaatgatattcattcatttatttcaaatattcactcatcccatcatccctctggaaccaatccatttgctacccaggatagaatttaaggtactttaagtatctaatcgcaagtaagccttactgctgtccactctggtctgtgggccatgagtctgtatcctttaataaattcctgcttcacacagtaagaactgtgctttcctatcccaatctctgcctaatagcccaacctaaatgcgttccagcagccccagccccatgcctggcctccagtatttccaacactcaaggctcagcttatgcatcacagtccttcaacctgggtcttgtcaagatgtggctgtatcttcctaaaaatccctgcctagccaggagggtggcagcctgccaccaaataacctcactgtgaaaatctgcccaaatgccagtgttaatattgacaaaattggcctagactgatgctacttaagcatttttctgtattaatgatatatgcatgtactttgtatttcactgaatccagagaatttttatctgggtttagttagccttaaacagctacactaacttctctgtgtcttggttttctaacccgtgaaaggcaataatattaggatccaccacagaggttactgtgataatttttatatattagcaacttagagaactgtctggtagataacacatgcttatgtaaatgttattgtttgtatttgtgggggaaaaggaaagattaacaagaggaaagcatacacatttatttaacataagttttatgtgacatgagggcctttgaaaatgaaaacccaaagatacaagtagacttgtatttttttatgattaggtttgacgaagaatgaacagttgtgcagaagtatattgggggacaaaaaggtatgatctaatagtaataaacggggaaaacttagcaaggcctgtctgttcagattttctctgtgctccatgtcttcagagataaggaagttactttctgccaggtatggggggggcacctctcaaatgagggtctcatgacctgcctcagaggagaagtgtgagggaaagccagagagcaaccttcctatgtttgccattttctcaaatgccaaggtaccagatttgggggggtatcatgtactgaaccttgttatattattaatactattactattgacttcctctagtgagtaagctaccagatgcatgaagataaaaactgtctgtttcattcttaaaacccctcaaacctacatggtgatttgcacatctcaggctgtaagtgattgtcaaataaaattgaattactgagtactttaaaaagatatctggaaatatcatgataactatgatatagctgtagaaagtaagaccacagaaaccaaactgtcttcttaagaacagaaaatcactaaaagagccaggaatgcaagtcagtcataagcccatgctgctggttcatggacaatcttcatatgacaccattttcctggtgtgagaacagatgcatttattctgaccttacgtcatgcaaatttacttatccctgggcaaggacaggttacggggtagctttggcattgctcattcattcctgtatttatcaggtaaccctgcaccaggtcctgctttaggtgtcaggagactacagtaaatcaaacaaaccgcattggctcaaaaactgacatttgggagagctagacaaaacaaaatactagtttatattaaattatgataagtgtgaagcataatattgaggggctgctccatcagatcacctatcatgacagtatcagttcctggcacatttattggcacccctttctggaggcaatggactggaggtccccaccacttggtcaatgaagtgaaatgtatggatttgatgctgagaggggtttgacattgctattcttctatcaatcctggtgtaaaaaatatacactgtattccatagcccatctagggaagaatcctactaccaggcatggacagaaacttaagtggctcaagaagacccagcagctcaaaatgaggcagtacccctggatgggaaaggtatacctcctatccagccacaggtagagagacacccgcctataggtaaatggtcccaatcctgactccatcccaaatatcaccacaagataaacagagttaattacggtagggttaaatttcttttcgcagatagaagataggttacattagatgatgtgctctaaattcccagagattattttacaggaaaagaaaatttttacagctatcaacttcactttaaggttttcgagggcccttcaagattttatgtcctctcacaaatgccacaagcacaaataaatattgctctttaaaacaaattaatgtcaacctgagtataaatgagtcagacctatgagtctccaagcattatgtttcattaccctgccaaaaccaagcctttctagactagtcttaaggctctggttctgtgaataggcctgctgaagaaatatttcacctaataacatcaactgtcttaagattcactttggataaattgctttttcttatagcaactgaatgaaaaaaaaaactgaactaacaagagaaacacgaaaaaccacagaatcaatcaataatgcttccctgtccccaattattacattaaactgcattaagagcctggccagctattggtccatgcttcataatccttcatgtttcttccaaataatcacactcttcaaagtaagatattcctatataatcatgatgcttgatcaacttgccttatcaaatgacttgcaaaaaatatctatacctctgctctgggaaagcccctgtgagaaataacatattgaatagtttagattcaaatcactgccctgatttaagccctatggaaaaaataacactagagtaaataatattgagtgctacccacaaccccatatatcaaagactgtcaaggacatttagtattgaaggccattccagtactaagccccaggagatttacaagaggtcggggtgattaggtctccttaattagaatgtaaatttatttattgatttattgtatcagacagatcaattagtagctaccaatttttttaacatgttcattttctatttcaatgatagatatcaattaaatattaatcagaatctcccacctcacctgtagtttcaatgttctgagctcaagttaagcatgacagggacattctatgttccaattttattccatcctggcttcaaagttttggaaacagaatacctcacactacacgaataaaatttgcaacaaactgctaactgaggcaaaatagtattcatttgtgtgtaggtatatgtcacgcatgtaccctcaggccagctctgtaaccccacgaagacccaagtgatttctccttcatcccagagcaaagagggagaaagagctgcttagctgtgcacgttgaggaggtgatctggaaatctgcttgttcctctgaagactatgaaccattcgttcagagcttcctcaggcctccagctcctgagtctttctgctgttctgcagcacaaatgagcttccctcttgctgcattccttctctgtaggctttctgcttttatagtctgctaagtcagttactagtccatatcatttccagctttcaattttttgttgacatctattttcttctgtcatttctgcttcccttttgttcttgtgcatttataccttcgtcattgccttgctgtcacataaaacggtttcatgaaagagtagaggaaaatccatgtatttaatctgccctgcgtagccagaagcctctactatactatgtgataccactccactccaagctaaatctatctgagccaagatggctaagttccctggtgggacagactaatgtaaaacaaactgaatggcattgcttttcttctttcctgtttcttcattgccatggatcaggttacgtgcaaataataataataatcagcaatgctataaataaatcatattaaggcagggcttacagataaatcccaaagttcaaatgtaagtatcttgccaattgtttactaacttgtcaagatattaaaaatagaaaactaacactcaagacaacagaaatagttgagccatggtgccagggcataacccaagaactcggactagacagtacaagcatatcaaataaatatttagcttaggtatcagagcactgtcattaagagcacagggccaggaaccaggctgcctgggttcaaataccacctctgccactgacgagatgcataactttagacaagttacttaacctcgatgtgtctcagttactgtatctgaaaatgggagtgataataataagaaagcctcatatggtggtatgaggagtaaacaaattaaaacttgttaagtacttagaataccctctgacacatagtaactactacacaagtattgagaaaggtagttgaggaaatgaataagtgaaaataatatggattcttctggtcaagagagaaaaaaaagaccctaacctcaagccaccattttaaactagaacttaacctgtattacccttaaaaaaacgagggcaaaccaacacgtaaaaagaaaccaaaaaagcaagatcttcacttttgagcttccaggaaatcaggcctcaagatttataaacactgtgtcttaatgggaatttttcagctgcaccaggctttaccttaaatgcttgcctaggggaaaatccagtccacctgttagaggctggccctgcaagggtaagtgttgaaaccccaggttgcttggtgacatctgggcatccacgcctgtggtgctcccaacctaccctccacttggcaggtgtaggttgcgttttctggctcctctgagcagcctcattgcctgggagccaggctgtgctgcactctccctgcctgtcttaaggaagattcctgtgaagcccctaaatctgcactcatgctcatcctctccactattcctctttccttttctacccctatttcttaggtggaatctgcctgaaaagcccaaagcctgacctggagatcaaccaatcttctgggcatccattcagacaagggctagggttggcagcctgtgggctcaacgtcctacccatacactgagtccctgcttccctttaactccctggtactagtactgtctcctgtttgctaccagtataccataggacaggagtcaatcctaaccatctggacacacagatatctccaggatgctccccaaaagtttccttgacatcttgtctctttttcccctccccctaaatctacactattctggacatccattctgctcctgtctctccagcaaagccaccctcctcagaaccagctgctccctgcaacctccaatccctgggcagaggagacatatgctcttcatggggtgaggttggggtggcctggggagaactctcctgagatagtaaaagacagaaaaagccaaaggagactgatctcagggtatagccaccttgttaagtcttttttttatcaccatttttattaagaaatattttacacatataatatgaagatctatggagttgtaaaaaataataaaattatcacatgttcctacaagccagcttaagaaataggatacacaaataattaattaaaagatcctttcccaattgtatactcccctggctccctcgaagttgatcactgtccttgattagctcttattgagcccaacgtgaggaaaacagcatggcctctccagaaaatgtggtatgactattttctgattccagctattcatcctattttcctttacatcctgtccaccagaaaactcgtagtcaagtctccatcctaacagtttaacccttctaatatgcctgatttcttaccaccattcattctattaacccttatgtgcatgtatatccatgactgagttttcagtagaagagggaatcactcaaggaatcaaagccattcagaaatgctccctcaaagcctaaagcaaactcaggctactgaaaaatcaatgtccaaatgataaggtaggttgactctcatctggcacctactctaacccttgtctggtgcatctttaggatggcacaggctagaaaacataaagtacactttctatccattcttgaaactagagttctagatgtgacttagtttcctccaagcagtcattattgcataatacttgaattcaaaactgagttaagaggagatagaacaggtctcatgcagattgtttgggagtgagagagatgggcatgaacacagcggacactgtgcattcttgtagttagcgattctgaaaggagtttctagtctgtagagagtaagtaaatgatgcgatcctaaggtcagaagttgggacactggctccccaatttctcaccttccaggatgcggcagggggagacattcccttaatggtcagttctatatggtgttatttcaggattcattcctggaaaccaagtcaagaaccttctcctccagttcttccagtgattttgtaaacatttaactcctcatatcaaatcatctcctgctgaaaataaccaaagggtttactgctgttggcaatttaattctggctaatatgtggaatagagagagagaagttgacagagtaaagcttgataataaaaaaacaccagctcatgcttttatcaagaaaataaggcataaccagatatctatttttaaataaaattgcttacttttaattttatataatgcttttactgttattaataactttttttagcatggccatgttatcaattatcaataataataaaacataattatttgcagaacattgatgttgtatcaagcactacataagtattttatacacttagctcatttaagctttacaagtctatgagatacgtatttgtatccattctataggtgagaaaattagagttaagagaggttaattagtaattttccaaggtcaaacagctgataggtggtagagataaaatccgaaacctgtcagcctccaaaactcacctcttaaactctttattatactatctctgtaagcttatgaaattcacggcatgaagaatgaaaaaggagtctgccttgataatatccgactcttctttaagtatcctcttgtgtgatatccttggcccctcttacaaattcttcagattgttttgtgtagactctatttaacaatcttcaggaaatactttggaaacactaatggaattgaactgttaaaatataaaatctcattgcccctagcaagaattctctctaaaattagagccaggttttgcttataatttaacagtcttttccccatcatttgcatagtgatagagcttttatagttttaattctgaatttatattccagaaatgtcaatctggaggctgtaatcctactaacttttctgcatgcctatttttctgaatatgtataaatgtttattttctttaagcagcacatttcagaggtaaaatgtatttggaagactttaatctatgcacaagccatcattaaacttccctggcatatctttctcttacagttaaccaaattacatttgggtatttgaagcaaatgaggatataacaaagtgatttgggtggacaaaatgtatgaactgcatcctgtttatgcaacatttttacaattgtataagctgacagctatgcttagagaaacagtggaagaaacaaaatcgttcactcagtggtttataagaaaaagaaaaaaatgtcaattttcaagataaaagtgtggagtcaagaatgagttttattttttttaaaaattctcattacaaagtccttgaaagaatgtcaagaacaacacagtttatgactattgggaaagtggatctcctcttagaattggaagcctctatcctttctttctgcgtctctctatataaagatgtttctgtcagcttgggtgcattttcatcaaatttggagtatgcatttgggaagctaggactaaacatagagcagtgacatatgttgaatcaacttgggcagggagagctggggggactccgagtggctgatgctgaaacactgcagggaggcctctaaccagagaaaacatacagaggtcttcattgagggctccagaatcaatcattccaatggcagatactctaaactgctcttctgattttggactgagttgcttctcacctggaccacacaacataactcagatgcactgattttcaaccccagctgcatgttagaatcacttggagaacttttaaagactgtgggtgcccaggtcccagccagactagatcaactggaacctgggggtgggaggtgggaggaggacaggacaagtggccccaagacacctgcatttttaaaagctccccaggtgagtctaaggtatagccagagttgaaaaccactggttcagggtgaatagcagctggaatttatataatcatggttaatgattctcttatgagtaacatggaggaggccagctagtattatacaaagttaaaatgacattttgcttaggaataattggaaatattttttgtcaagtgtttatgtctgtgtctgacaacacacttacaagaaagcttagacactgaaaagttagaagcctatgggagctcagaagtgagatttgggttgtgcaccgtggctcatgcctataatcccatgttggagaggcagacatgggaggattgcctgagcccaggagtttgagaccaccctgggcaacaaagtgagacctgatttctaaattaaataataataataaatttttaacataataaaagaagtgggatttgctctcagcagagccaagctcagctatatccaagtcctctgcttatacaaagatatcctctagacataggtgttataatttctacttcctaagatgaactttttttctattcagcttttttctattcaagatctcattcctgtgtagctctggtttgaaaccaatagaaacttgagttttaaaatcctgatgtgaggtttctatcattttggctagcactgttcatttagagtaacttaacttcagtagaggaggataaattaggatctcccaaaaaactttaaagggacctgctctttttttaagagtttttcctaagcatcctgtatggatttccttcattctctttaagactgaatggaattttactgtatatatgatctagtgtcttccctcatacctcacacaggacagacaatcaatatttgttgacttaacaaattaaatatttaactattctcccaaatgatgggtaggggcatctggttgacaataacagacatattcaaggaaataatttgtagcaaagctgagtagaagattcctctgagctgacaagcatttcccatgtctcccatgcaatcagctttgaattccaacttcagggacagaaggcacttgcttgttgccttataggcatcatgactggcacaaataaatctcttccttgcagcattttagacaagtgtgatcaaccaatcaatgaaagctacaggcacctcgaaagagccttttctttccaatgtcatttcctccagcagctgctccttccttttgggaacccccgagtttatatataagcagggttcagaaggaagacaacgttttactcgatgcctctctcattcaagtaaatgggcactggcccatgctctgttctgctgctggaaccaactggagagtccaaagcatcacatttttcccagagggaaaactgatggaaaaaaaagatggaacttcaatgttcaatcaatcccaaccaatcaagaagctttcaatgctgcttcatttacataaaagtagagctaacagccaaaaagcagtctttaattcaggtatcaatgtataattctcaaatatatggctcaatctcaaatatatggctcaacctgccagagttatagaaatgacctggtagaaaatgtattcctatccttgaaggagctaaaagtagacatttctgtgtgtgtgtgtgtgtgtgtgtgtgtgtgtgtgtgtgtgtgtgtgtgtgtgcatgcgcatgagtgtgtgtgagagagagatgagagagacagattcatcactatcaagataagagctgaagaatttctttaaacagagcccccactgttaagtggactccaaaggataaaggtttctctcactgacttgaacctcattattaattatatttattattagttcctttccttgaatatgtctgttatcatcagccagatgcccctacccatcagtggggagaatagttaaatatttaatttgttaagtcaacaaatattgattgtctgtcatatgtgaggcactagggaagacagtggttcacacatacaataaagttccattcagtctttaaagagaatgaaggaaattgatacaggatgcttaggaaaaactcttaaaaaaaagaaaagatgtccaatgtgtatagtatcttgcatttgtgttttaaaaagtatttacatttatatttatatgttcacataattacatcgaaatcttttggtgctatacacaagaaaccactgacaaactctgaagactagggtgtctctagggtggaagggagacaatttgcatcataatgtttgccattttttacatgtacatttgttattttaataaaaaataaaatgtctaagtcatgagcagtattttctagagtagaaagattatttacactgagaatgaagagtgatttcaaagaatcatgaattttcctaattttccccaattttaaatcttaaaactatgaattttccaataaaattagtattcataaaataattaggggtttggcaaatatgcaagttgtgtctgtcagcatagtccactcaccccgatttccatgtatgcatatgtgcacactccatgtcccgtttttaatccctttctcttcctgcccaccccaacccagccccacacaatctcaaacagtctatgctgtaggacacaggtatacctgtgatcatacattacagtttgtaaacagaatattatgctttatattcacaatggatggataggatatattctatttaccctacacacgtctgtacatacacacacacacacacaattatacacacacgcatattgcctggtattcatgtatttttcaactgtgtgtcctgaaacgatttttctttttcagtgagtcattcattggcctgtgaaataaaatgttttcctactcagagatttgtaatgccaatgttcaaacctacatagtgtactgtcatgagaattaaataaactgaagcatgtgacagttcctcacccagatcctagcacaaagcagtcactcaataaatgtttgtggaatataagtgcattaaatatgtgttgaatgtgaacgcaaacctatgaatattttagcaaataacctctaacagatagaaccatgttagaaaactaccagttggatggccaaataggaacagctccggtctgcagctcccagcaagaccaaggcagaaggtgggtgattcctgcatttccagctgaggtacctggcttatctcaccgggactggttagacagcgggtgcagcccatagtgggccagcagaagcagggtggggcatcgcctcacctgggaaagtgcaaggagtcagggaactccctcctctagccaagggaagctgctagggactgtgctgtgagggactgtgctctccagcccagatgctatgcttttcccatggcttttgcaacggcagaccaggagattcctggtctcatgtgcctacaccaccaggaccctggatttcaagcacaaaactatgtggtcatttgggcagacaccaagctagctgcaggagtttttttgttttgttttgttttgttttgtaccccagtggcgcctagaacaccagcaagacagaaccgttcactcccctggaaagggggttgaagctagggagccaagtgttctcactcagtgggttccacttccatgaagcccagcaagctaagaaccagtggcttgaaattctcactgccagcacagcaatctgaagttgacctgggacgattgagcttggtgtggggaggtgcatctgccattactgagacctgagtaggtggttaaacccctcacagtgttaactctgactgtgtggaactcaccgcagtgtggcaaaggtcctggggctggactgcctctctaaatcctactcacttggcaggacatctctgaaagaaaggcggcagcctcagtcaggggcttatagataaaactcccatctccctgggacagagcacttgggggtaggggcagttgtgggtgcggcttttagtggacttaatgttcctgcctgccggctctgaagagagcagtggatttaccagcacagccctagagctctgctaagggacagactgcctcctcaagtgggtccctgacacccatgcctcctgactgggagatacctcccagcaggggtcaacagacacctcatacaggaaagctccagctggtatcagacaggtgtccctctgggacaaagcttccagaggaagaagcaggcagcaatctttgcttttctgcagcctccgctggtgatacccaggcaaacagggtctggagtggacctccagcaaactccagcagacctgcagaagagagtcctgttagaactaacaaacagaaagcaataacatcaacatccacaaaaaggacacccacagaaaaaccccatccaaaggccatcagcatcaaagatcaaaggtatataaatccacgaagatgaggaaaaaccagtgcaaaaatgctgaaaattccaaaaaccagaatacctcatctcctccaaatgattgcaattcctctccaacaagggcacacaactggatggagaatgagtttgacgaattaacagaagtaggcttcagaaggtgggtaataacaagctccactgagctaaaggagcatgttctaacccaatgcaaggaagctaagaaccttgataaaaggttacaggaactgctaactagaataaccagtttagggaagaacataaatgacctgatggagctgaaaaacacagcacgagaacttcatgaagcatacacaatatcaatggctgaattgatcaagcggaagaaaggatatcagagattgaatatcaacttaatgaaatgaagagtgaagacaagattagagaaaaaagaatgaaaaggaacaaataaagcctccaagaaatatgggactatgtgaaaagaccaaagctatgattgtacctgaaagtgacagggagaatggaaccaagttggaaaacacactttaggatgttatccaggagaatttccccaacctagcaagacagccaaacattcaacttcaggaaatacagagaacaccactaagatactccttaagaagagtaaccccaagaaacataaccatcagattctccaaggttgaaacaaaggaaaaaatgttaagggcagccagacagaaaggtcaggttacttacaaagggatgcccatctaactaacagtggatctctcagaagaaaccctacaacccagaagagagtgggggccaatattcaacattcttaaagaaaagaattttcaacccagaattttatatccagccaaaaactaagcttcataagcaaaggagaaataaaatcctttacagacaagcaaatgctaagggattttatcaccaccagcctgcctcacaagagctcctgaaggaagcactaaatatggaaaggaaaaactggtaccagccactgcaaaaacataccaaattataaagaccaatgacactatgaagaaactgcatcaactaatgtgcaaaatgatcagctagcatcatgatgacaggatcaaattcacacacaacaatattaaccttaaatgtaaatgggctaaataccccaattaagagacacagactggcaaattggataaagagtcaagacccattggtgtgctgtattcaggagacccatctcatgtgcaaagacacatataggctcaaaataaagggatggaggaatatttaccaagcaaatggaaagcaaaaaaaaaaagcaggggttgcaatcctagtctctgataaaacagactttaaaccaacaaggatcaaaaaagacaaaaaagggcattacataatggtaaagggatcaatgcaacaagaagagctaactatcctaaatatatatgcacctaatacaggagctcccagattcataaagcaagttcttagagacctacaaagagacttagactcccacacaataatagtgggagactttaacaccccactgtcaatatcagacagatcgatgagacagaaaattaacaaggatattcaggacttgaactcagctctggaccaagcagacctaatagacatctacaaaactctccaccacaaatcaacagaatatacattcttcttagcaccacatagcaattatcctaaaatcgaccatatatttggaagtaaaacactcctcagcaaatgcaaaagaatggaaaacataacagtctctcagacaacagtgcaatcaaattagaactcaggattaagaaactcactcaaaaccacacaactacatggaaatggaacaaacctgctcctgaataactactgagtaaataacgaaattaaggcagaaataaataagttctttgaaaccaatgagaaccaagacacaacgtatcagaatctctggcacacggctaaagcaatgtttagaggaaaatttatagcactaaatgcccacaacagaaagtgggaaagatttaatatcacaattaaaagaactagagaagcaagagcaaacaaattcaaaagctagcagaagacaaaaataactaagatcagagcagaactgaaggagacacagacatgaaaaactcttccaaaaatcaaggaatccaggagctgtttttttgaaaagattaacaaaatagaccactagccagactaataaagaagagagaagaatcaaatagacacaataaaaaatgataaaggggatatcaccactgatcccacagaaatacaaactaccattagagaatactataaacacctctacacaaatcaactagaaaaatctagaagaaatggataaattcctggacacatacaccctcccaggactaaaacaggaggaagtccctgaatagaccaataacaagttctgaaattgaggcagtaattaatagactaccaaccaaaaagaagtccaggaccagatgaattcacagccaaattccaccagaggtacaaagaggagctggtattattccttctgaaactattccaaacaatagaaaaagagggactcctccctaactcattttataaggccagcatcatcctgataccaaaacctggcagagacacaacaaaaaatgaaaatttcaggccaatatttctgatgaacattgatgcaaaaatcctcaataaaatactggcaaactgaaaccagcagcatatcaaaaagcttatccaggccaggcgtggtggctcacgcctgtaatcccagcaccttggaaggccaaggcaggcggatcacgaggtcaggagatcgagaccatcctggctaacacagtgaaacctcatctctactaaaaatacaaaataataataataatagccaggcatggtggtacacacctgtagtcccagctacttgggaggctgaggcaggagaatcacttgaacctgggaggcggaggctgtagtgagccgagatcatgccactgcagtccagcctgggcaacagagcaagactctgtctcaaaaaaaaaaaaaaaaaaaaaaaaaaaagcttatccaccactatcaagttggcttcatccctgggatggaaggcttgttcaacatatgaaaatcaataaacgtaatccatcacataaacagaaccaatgacaataaaccacatgattatctcaatagacgcagaaaaggccttcagtaaaattcaacatcccttcatgctaaaagcactcaacaaactaggtattgatggaatgtatctcaaaataataagagttatttatgacaaagccatagccgatatcatactgactgggtaaaagctggaagcattccctttgaaaactggcacaagacaaggatgccctctctcaccactccttttcaacatagtattggaaggtctggtcagggcaatcaagcaagagaaagaaagaaagtgtattcaaataggaagacagaaggtcaaattgtctctgtttgcagatgacatgattgtatatttagaaaactgcattgtctcagcccaaaaactccttaagctgataagccacttcagcaaagtctcaggaaacaacatcaatgtgcaaaaatcataagcaatcctatacaccaatagcagacaaacagagagccaaatcatgagtgaactcccattcacaattgctacaaagaaaataaaatacctaggaatacaacttacaaacgaagtgaaggacctcttcaaggagaactacaaaccactgttcaaggaaataagagagcacacaaacaaatggaaaaacattccatgctcatggataggaagaatcaatatcgtgaaaatggccatactgcccaaagtaatttatagattcaatgctattcccattaagctaacattgactttctccacagaaccaggaaaaaatactttaaatttcatatggaaccaaaagagagcccatatagccaagacaatccaaaggaaaatgaacaaacctgaaggcatcacactacctgacttcaaactatactacaaggctacagtaaccaaaacagatacatagaccaatggaacagaacggaggtctcacaaataacaccacacacctacaaccatctgatctttgagaaacctgacaaaaacaagctatggggaaaggattccctatttaataaatggtgctgggcaaactggctagtcatatgcagaaaactgaaactggaccccttcattacaccttatacaaaaattaactcaagatggattaaagactaaaatgtaaaacctaaaacaataaaaaccctagaagaaaacctaggcaataccattcaggacataggcatgggcaaagacttcatgactaaaacaacgaaagcaatggcaacagaagccaaaattgacaaataggatctaattaaactaaagagcttctgcacagcaaaagaaactatcatcagagtgaacagacaacctacagaatgggagaaaatttttgcaatctatccatctgacaaagatctaatatccagaatctacaaggaacttaaacaaatttacaagaaaaaagaaaacgaccccatcaaaaagtgggtgaaggatatgagcagacgtttctcaaaagaagacatttatgtggccaaaaaacatgaaaaaagctcaccatcagtggtcattagagaaatgaaaattaaaaccacaatgagataccatctcataccagttagaatggtgatcattaaaaagtcagcaaacaacagatgcgggtgaggatgtggagaaataggaatgcttttatactgttggtgggaatgtaaattagttcaaccagtgtggaagacagtgtggcaattcctcaaggatctagaatcagaaataccatttgatccagcaatcccattactgggtatatgcccaaaggattataagtcattctaccataaagacacatgcgcacatatgtttactgcagtgctattcacaatagcaaagacttggaaccaacctaaatgcccatcagtgatagactagataaagaaaatgtggcacatatacaccatggaatactatgcagccataaagaagaatgagttcatgttctttgcaaggacgtggatgaaactggaaaccatctttctcagcaaactaacacaggaacagaaaaccaaacaccacatgttcccactcataagtgggagttgaataatgagaatgaacgggcacagggaagggaacatcacacactgggatctgtcaggggttaaggggcaagcagagggaaagcattaggacaaatacctaatgcatacagggcttaaaacctagatgatgggttgatgggtgcagcaagccaccatggtacatgtatacctatgtaacaaacctgcatgttctgcacatgtaacccagaacttaaagtttaatttaaaaaaaaagaaaactactagatgtttttctctttaattagagaaaacaataaatatatcaatatgtcaatatagtattttcaattcattgcaacatgaccagggtaaacacctaagtatttatttctggaagtgatgctacagtaaacattgaaattgaagaataatgtctaatacaattttccagaatagaggagccttttgtttttcaacaccaattattgtattggaagaaactttctatttaaataacaggtttttacaccaaccacagctaatagggcccattgcataaacaagtgcattgtgtaacagttttaggatgacacttgatatacagtctggatactcgtccctgcccagctctcatgttgaattgtaatcctcagtattggaggtggggactggtgggaggtgtttgggtcatgggggcagataccttatgaatgacttgggccaaccccattggtgatagtgagctctcactctaagctcatgagagatctgttggtttaaaagtgtgtggcacctccccactgccttgctcatgcttctgccatgggacatgcaagctcccacttcttctgccttgaatgaaagttttctgaggcttcaccagaagctatgtttcccacacaacctgcagaaccatgagccaattaaacctcttttctttataaattacccagtctcaggtttttctttatagcaatgtgagaatggcctaatacacttaagaaaataataccctaaaaatgaatttcactttttcaaggcatttgaacatgcgctattccacttcatgcttttccacaattatatgaattcaagatggtatgaaaagaaacagggaattgtcttgaatagttaagtgcttcatccaagtctctgccaagagacttcatatccttgtaccttctggtggccacgattgctaagacaccatcaaatgaatgtaggactcctctcacttaagaatagcttttcagagtaagaaaagagatgctatatttgatgtacatctctgctctgataagtacactgattcaaaaaatgattcagttttttaaaatgtgcccactagaattcaaactttatgacatagctaaggttcttagccttagtttattaatgacatttttgttcataagtgtaattcagacaataacacgatattaatgtaatccttgtcattcattccagtggcaactttctctgtgtaacatgctttgcactgaaactagtttatgctcctggcacagcatctttaaagtagaaaatttattacataaacatttccagcaaattcaattagcaccaccaatacaaaaaaaaaaaaaatcacactagcttacgtgagttgatactggtctgatttatacggcaaaactgtctgactcttgcctcataatctaaaatttcatagtaggaacactgtaaagttatctgatttgtggtacgtttgaggaagggtaatctcctcttatgccatcattctcctaaatgcccagaaattttactcaaggtcagttggagcactgaatgctctgtgagtcactgatgctcaggcttgcctgccgttcttttataggatctctgtgggccagaaaatcatgaaaatatagttctacaaaaaaataaattcctccaacactgaattctctttccaatattacaatttcatggggagaaaatggaagaaaatgagtgattatgttccaatttcattttaaaactacagtgatagtgctacattgttaaactaatctcatttctagaacatacatgtaaggacaaaaatatcaagttaacaaattgtttttatcttataaccttccattatgacaaaagcaacaaaaactcgaatgccttctctagtaagagaacatggatagtgctagcgttgatacaggggtctatccattctaaaatgtcaagacacagaaatagtgaagagaaggcagcctgagtagatgaaaacgataaaaactttctcatattgacacaacattcctttgttcaactgaaatcagtgcttttgaaaacccacttggctgacagccctgagcctggggcattctccatttcctttacaaattaagtcagttatttcaactctgccccttgccccaggcctgcacttcccttttacagaacctccctcctattgacttcagggcacaagttcatccttctctaactcttgcttttcacactaaagttcatacacctgaaaggaaaacctataaataagctctcaggacaaataaaaatccatcaatgcgaaggtcagggagagctttcaatgatacaagcgcacattcattcaattattcattcattcatttgccagcacccactctgcagcaggcccaatgctaggcctggagacacgcataataataaaataagactcagtcccttgtctcagaggtgtttacaatccggtcagcgtaactaacataaattaaagttaggatgcatgtgctaagagtagtataaataaaatgctatgggggaccgaagaatgacccttgcactaaagtctctttgcctctgggtcctcttatttatcagggtctaacgtcaccaagcagcagctgaaaggaaaggaagacaatgctagcagtagcagcagcctcagcagtgctcctgacactgagtgggaactggggaggggtggagctcacaagacttattacccagcttcttacattttgataaagggaggaaacttccctccacttcccacaggggaacataggagggaatgccgtctgtaagatattcacagcaacctctatcaaagtttcagccatttcccacttttactccaaaagtgaccatattctgcaatccaaaaattgggacatgggatctgacaaataagtttttttccaatcaaaaagtatatttttataaagatctaaagacggaatcacacatggctatatactcaacatttgttgagtcattattaagcagggaatggtccataaaacctatcatgtgggttgggatagacagtaacatgtatccatgtctttgcttctaccacacccaaactgcattgatgctgatgctacaaaaagccaatggaaaggattgttttttcccaattcctgagaaaacaaactcaacaatatgcccttacaacacacacctgtggtattctaagctcattccttccagggagaagaaaaaaaaaaaaaactctaaaaagttataacacctcatttatcccaaacttacaggcatcagacacacatctatgagcaagcatgcgagcaggacgtgccaatagcatcccccactaaggacatgtactaaaccttatgaacatgatgatatcaaacaggacatttagaacttcaaggatcctattaattcttattttgcatacaagtgtagtcactttgcttttctggtttaatgactcatcacagattagaaaccaggaattttaaaggggtagagagaagaagtattgaagttaggcatacaaagagttctggcacactataaatatttgttctataaaccaaaaaggatctgaggcatgtctcaatcagtttagaggtttattttgccaaggttaagagccagcccacgacagagcctcaggaggtcctgagaatatgtgcacaaggtgtggttgagttacagcttgcttttatacattttagggagacagaagttacaggtaaagacatacgtcaacacacgtaagctatcactggtttgcccatctccaaatgggcaggttgggaggggtgcttccaggtcataggtaaattcaaagatttattgactggcaattgtagaaacagttgaagtcagcctgagttaagataggggggattgtggaagccaaggttcttgttatgtagacaaagcctccctgtagaaggcttcagagagaatagatggtgactgtctcttatcagaccttaaaagacatcagactctggaaaaaaactagtaatggaaggagagtctctatagaacgcaaattcccccgacaagaaacagctttgcaggaccatttcaaaatatgtcaaagaaatatattgtggggtaaaatacttttatttctttcaggacctgctgtgttatgtggtactataccagagtcaggttggaatttggtatcttactgctacaaaaagtctgttttgtcagtcataagagttctgttttcatgttaatgctgatcaattgtgtctaaactccaaagagaggagagtataaacaggcatgtcctggtgctcccttcccatcatggctggaactagttcttcaggtttctttgggatccctttggccaagaggaagatccattcttttggctaggggtgcctagaattttattttgggtttacagttccacgaatgaaggaatgagaaaacaagtcacatcaaatagacttgcaataaaaagacaatgttttaaagtctgttcaaaagacatccaggactattcattgcctttaaaattttctatacagatcagttatgcttactactatttgccaattctaatgatactcaccattaagaaactcacattttattcagcatattatgctgaaggagccataaacatgaaaactacacattcaaggtttttcactacaaaatagtttccacaaaaagcttctgaagtggcgagcttcagtttttgtaaaatttgttaacatgggcactccattcccaaacaatgcaagataaatagagtgtttactttgccttgaaaagtacattatttatagaggtatgttatactcatttaaaataaacccacttaagatgaagagaaagcccttgtctttaatcatccagactgagatctatactgattgagctttctgtataattactcacatgtacatttcacactgtgtagatacaatctagggcctactgtaggaattgcaagcaatttggggattttgcaataatgtcattttggaagatggatgcatttctgattcaacaatggttattaatctagtagcctaggaaaaaattaacaggcatctaaaaatttctaaaattggtttgcaaaggtctagaatatgcagtttcccaaaccattcacatatttgggtaattccaaataatttatctgcagcttttatcttgtaaagtatctcaaaagagagcaggcaaaccagataagctggaaggggtggggggctgggagggaggagtcagaccaaattgtttaaagtcatattcaatattattggtagaaagttctttttacctgatatttactcttagaatactttccttttaatcatgtatgcaatactataagtatctacctctattcaaaaacgataaaaacattgatcaaagtttactgtgaaactttacaaaaatttatgttgaatcatctttattcataatagctcctagcacataaaactattcaataattcacaaatttttgttgaatgaataactgaatgacacacagctcctagcacataaaactattcaataattcacaaatttttgttgaatgaataactgaatgacacatagctcctagcacataaaactactcaataattcacaaatttttgttgaatgaataactgacacttgcatgtctcaatgacacaatggcaaattgtatctttttaaccttaattatagctacagtgcactaatgacacagcatcattgtcaagagctcagcaccctcaccacctccagcaccaaagcacttttagctcccagtggcatgttctaggtattgcacaggacaattcagaagcataatccaagtccttcaggaagtccaaatttaaaaagctcaagcgctggcaaaaattttaatttaaaattattactctagcagtgcgaggacaaaactaggtggttggtctaatttgtattttttcaagtcagttgctatggttttaaaaattcatgtagaagaatctctctgttaaacacacagagagagagacagaagaagaagaaggaggaggaggaggagaaggaggagaaagaggaggagcagcaaaatcatttacatggttattcagttcagtgtaactgacttgggtgagcaatgaatagaccacaccgctgagtcttcaaggttgtatccaaatgctctcatttgacaagagttaaaaggaacacacgagtttaagataaaccctgcctttgtttttaatatttagtgatatgattttggttgaagtctgggagggtcactatatcatcagaaaacacagaagggatattgacaagcatcttatgagacaaataagaagttaatctgagagttgagaaaaatataaatgaaaacaaaggatttttaaggagaagaaattgataagagatgaggaatataaataaatattttaaaagcagcttcagaacatccaagaacagttctcactttacttgactcatcaagacctgcttaggaaagaagatagtcactaactcttctttaccaaaaagaccaatgaattatgatagaaactgatcaagataatacaaagaaaggaagggataaaactcaagagagcatgtaacaaaggtcaatacacaatgaagtcatctagaaagataaagaatattggcaactcccaaaaagcagtacagtcagggccaactgagagtcttagaaaaaggaggcatgtttggctgcccacagcctggagaaagagtgagtatccaccatcacagagagatgtgcagtgcagaatctgggaaactaggaaatctccccaaactagagcaaaatgtcagattaatggcatccagctctggctgcacattagaatcaccgggggaagtttttagaaatcgcaaatgctcaagccccacctggagagactgattcattttatttaggttggatctgggtttagaaactattttaaagtagtaattagcagagacagaatttgaactcatatctatctgactccaaatcccaggcttttcctattgtgccacaatgtctccttctagccctacccaaccaagcggtattggaggggtggagttgcctgtgctgtagtttctcctctgacatactctcaggtgctcaggcttagctgtctgagatgaaagcagaggcagtagctgtaaaagcagatggtcaagacttgagtctgttttctccctgaatgattttccagtttttctctgcaaggtagagttcatgattcatcctcttttaggctagaagaaaactacagaagcctgaagtccaaagaatggagccccagaatacaaacaggccagtgttgctggcccagggaagggaggaagatgcacagggcaggagaagtaaaagggacaaaggagtctggggacctcccagaacccatagggatgggtgccctgaggcatttagaagagtgattatgaggcagagcttccctgaagggcaacaagccccctgtgtctgaacagaaacccatctatgtgcagattggttcatcattggtcctcatgcactgataattaattctggtaaggaataatgaatggcaagatgaatgaaacccagccacgctctgtgagcaggtggatccagtttcactctgagcatcctgactgggcctcctccctccacacacacagacccttcaagtcattgccatccttgccccatctccaggtccctttgctctgcccacctcagcccttacaagaacagaccaagtgtacaccttccaactcacacctccacacacaaataggaaatctatcccagttaagcctcatttctgcacatgacagattaaaataaacaaaacaccagtcttctaagtggaaacatggatatttcaaaacaccaagcagctagctacctaagctgttcacccaaagcacaaggtaaatatcccacagtaaagcaaaagtgatctgagctctggctaccctaaagctttggaaacaaggtcctaacaaacacactctttgagcaaaacaccaaagacaataatggtgagcaagcagagatggcagcaagagggaagcccctgactggagggacctgttcaccaacactgtcttcaccctagggtcaagtccatcagccctagaaccagctaatcttcctgcagaagatataagcacaaactccaatggtgcgagaccctcagaagttgtactagatgatgacagaaatctttttgccaaagccacagaagtttctgtggacagtctagaaagggaacctaccctctccttgtaaccttctcctgcaatcaccctatcacccctactacagttattgctgccagaattgaatcaaagagtgtgtctgctcctgtgttctttgacagatccaggaagggggtacagaataatgtttgtactctaaattaatatggcaataacaagtatttagttatcctcccaacatccacttcccgttattcctaattgagtcctttcagacattttaggaactgaacattggactaaaggagtcagggaatctggcttctaattttatctctactgttctttaatccagtggcctgggcacatcccttaccttcttaagacaaagagtttgtcacttgtgatattatgacaagaatgtgagcccctcagggttcctatgctggtcaaacaagataacgtatgaaagtcttttgaaaactgttaatcctaacaaagtggcattttgagtcactttatttgattcaattatacaataaatactgtagggatatttttaagcaaaagatgcacaaaacaaaggataatacttctaacaacaccataaatgagatatcattctgtgaaacaggtacctactcacatgaatatatggaggaagggaggaaatctttctttctgggttttcttttttcattcgcctctaaagacagtcactaaatgtcttcctaagagcagcatggggaaacctcaggaataagggctgtgtgctccataagttccggagtttgtggaggccttgtttcaaagctcagggcagaaatcaaaagctgtatgaagtaccctgttttgtgtccatctgaatcatgaattcttctaaagctctccaggaaaagtatcagtttcagggtcactagctcccatattatgcccctaaactgccttttatcatcactcagctacttcatgctgcccttagttaccccaaagaagggtggattttaaaacttaggaccctcagtaatctatgaacctggcaggatgttgttgaagctatttgaattcccagaagaaatataccctagagatgacatgaatttaaactaatccaaggagtattaaaatggttgtgtgctgccctttgtctcacaggttataactgatgcagtacaagcaagtgggaatgaaaaacatgagaaaaatctaagacagtaactgcagaccattcttcttggaagttattcatttcaagaagcaggtgataattactttctagagacagtaataagaaaatatagtcttgtctggattaaatctatcttgatggttgattgctatccttgggacacgttccaatgagaaaagcaaacaaaatctgtattgtcttcatataaatttcatccagttgagccgattcacatatatgaaaacaagatttcttcattcactgagggaaatatttttctgctgataagtcaaagaatcttgtttctatcactaagatcctttttaaaaatagtaccacatgggctactagagaagcaggtgtcaataacacttaaaaatatagatggctatgactagtggagtgtgaatggctatagctgctgaggtgagcccagcccaggaccccaggagaaaggaaccctggaaattttctatgctggatagcatgcaaattccccatactaggggtacctcctggttaggccatcccccaaaaagaccttgtcctttggcagtttggaaacctttgagcttcagggtacaggttgcatgtgtaagagctataaatgcagaacaagtgccacaggattagttcatgtaaggtgataattaagagccatatgcctatcacataggaccaacttcaaaaggatatgtgaggtatagcccagggaggctcagaacacatgagattggcccttgtcctgcagtcactgctcaccagacacctgggggccactagcctggcatggccactccagagaattggttctactggaagttttgttcaataaaaagatatcctgattgttgatccatattctatttttttatgcaataatcaagcagatttattttgtattgcccatggtagtatacctagaggttttagagtcctcattttcttccaacctaacattgttactcaaagattaaggtggaagcaagttcaccaacagtagtcctataaatatcaatgaccaggagtataaacccatgaacaatgactaattcttcaaaggtatctaattcattctccccaaatttctgtatactaagggatcttcttttcagaggcatgtgagtgaggatctcctgccaaggaatctaaaactctgcattttattggattcagatcagaatttcagatactgggatcaaaaccaattagaggaatttgttgaatccccaccaatgaaaaaacggccagttcagaactatggcagaatctttaaaatataatttcttaaacatattaatagctagatgttaaaaaataaagaatctcatcaggcaaaaccaagtaagacaaaattcatatttgttgacgcccctagtcttcacaagtgacttcaatcccagtctaactgtaggcaagcagagctctccagcagaagctgccaacaccattctcagtacaattatctgccctcctggcccaagaccaacagcctcccctcgactaaaatgaactccttttcaccttgtcattaaaacttcacttagcccaaaccccacttttcaaatccccagcacaagacacaccctcgaccacacatgagttctttcagggtcgtcctcatcctactatgctctgtctggttttcctcccggttacattcgcactagagcactcacctgggccaagcttaataaatatactgcatgtggttgaacacccgcaatcctgagcacagaacagacattgtccaccattctggactcttcctcaaagagcctggatgatacttcaaggtccttctcccccaggctgccattcaaggcagctctcctgagggtgggcaggtgagagggatgatcggttagtaattggcccaccagtggatcttgcacctcacctaaccaacaactgccattctccacccttctctggcacaaaatgcaattcaacataagcctgatgggtgttctgttcccacatgggttaaatacaggccgacagccttataactttttgctcttacaaactgaaagaattttaaaacaccatatatccccttaaatttatgaagttgaaatctatattcttactttgcataagtttgaatagttttaagaacatatatttccagcatcttgtaaacatcgacaactaaaaattacatttttagtttaaccagtgaagtctaaataccacaatgtatccatgatatctaaaaaccgtaatgattaaataatcaccatcatctacttaaaaaatacaggaacaagctccttaacgtttttgaagaaacttttaattttagaataattttagatttacagaaaaattgcaaagaaaatacagagttctttcccctgctcttttcctgttgtttttcttccttgtctggttttaactagggattttatataatctcattttactttatcattttgattatacatctttttaaaaattttcgtggtgtccctagaatgtagtccatctaaattgaaatctatttcaaataacattccactcacatcacatgtgctccaaggaccttataacagagtattcccaataagctgctctcatcccataggacattgctgtcattcatttcacttattcatatgctatgataacccaaaacattgatatcattattgctttaaaaagttcttttgaatcaattaaaaaataagaaaaaaagattttattttatactcatttatttcttctctgatgttctttcttctttaaatagatctgagtctccaacctgtatcattgttctcctggcttttaacatctcttgaagaaaaagtcttctagaggtggattccctcagtttttctttgtctgaagaagcctttatttctccttcatttatgaaggataatttcactaaataaaaattctagatgggtaatttctttttctttcaatacttcaagtatttcattctactcttctcactcacatggcttctgaggagaagtctgatgtaattcttatccatgttcctctaagaggaagattgaatatgataagcctaaatggtggtggattttttggcatttatcctacttggcactctctgagcttcccagatctatagtttcatatatgtcattagttttaaaacgttctcagctattattacttcaaatatttcttctactccattctctttcctctccttcagaattccaatattgcttatgttacatcttttgaaatagtctcacagttctagggtgttttgttccatttttttccattctttttctttttcctttgcatttcagtttgagaagattctattgacccattttaagtttactgattctttccttggatagttgatttcactttgaactccaaagacattcttcatttctcttactgtattctttatttctagcatctccttttgattctttctcatttccatctctctgcttacattgcccatctattattgcatgttgtctactttttccactagagctcttcatatatcaatcatagttatttttttactccctatctgaagatcccaacatctgtgtaatatttgagtttgggtctaatgattgttttgtttctttatgttggggaaaagctgagttttgggaaaaaagctgaggcagggcttgcatctctgacataatgtaaaagagtcttggaacatgtcgggggtccagggtctgaaacccctcatggtctttggaacaacaagctctgtgccaaagggtggaaggctgccctgccacaccataatctaagcccagggcataaaacccctcgtggcttggatggaatccagggctcagggcataaaacccctcatggcctctggaatgtgtctagacttactggctccttgcttctagcattcccaggcttataaaatgattgtatcttaaactagaagaacatgttccccattatctcaagtaccagaatatgttccatatgcttcaaaggaaatgctaaaccatcacagctatagcttatgcacttgatgcaccacttcctttcaaccctcatatcctcaccacctgcttctttgttggattaccaataaatagcatgggctcccagagctcggagccttcacaacctccacactagtgttggccccctggtcccactttatgcactcttaaacttgtcttttctcattcttttgactccaccggactttgtcgcccccatggcctggtgttgggtccagctgccccaacatctctaaagtgtgtgtgtgatttttttccttgctatttggcatgtcctatcattttctgttgaaggcagaacacactgtatcaggcaggaggaactgaagtaaacgagccttcattgtgtgtgaggatttatattaatctggctaggagttgagctatataattgttgcgtagttacagatgccagaggtctgaaaattcctctggtggtctttgtttttgtctcacttcttgactttgggcttccttaagtatctcctcttcagacatggcctgtgtctttcagcaatttcagccataatccactgttataataatggagccgtgttggtgtgataataaggtgtgcaggaggtggagtattctatattctcccaatcaaagaatggattgggtacaaagactgaatatgagacccatctgtagcttggagagtaatccactttactcaaagtctactgacttaaatgttaatctcatctaaaaataccttcatggcaacatctaaataatgtttgaccaaatgtctgggtactctagcctagacaagtttacaaataaaattaaacatcatagcatgtgttcatgttatatttgactgagtcatgatttatctctataaaattaatacttaaaagccagcaggcctttggggccaagttaggctgggtcctttttatttccaaaggctggctatgcccttccaaagtcagccaggccttccctataggagcagcccccatcattcactgctgctaagcaaagaaccccaagtattattttacagagtagcatcgtgaacttcatgtatgtacagtcaccaacagcaaatattttcatagttcctgtaccaaagaagcttttacaaagttaattcagcagtcactcaaaatattgattgaacatctattggactcaagtcattgtaggagacacaaggtcataaatacctcaaggagcttaaaactagttgcagaaacaagatacagtgcatcagttcaacatagatttttaaggagaggagttcaagttctgatactaggcagatttacctagaaaagtccactctagctatattactaaagaaaatgcagtaagatgtgcaggtgatggtggtaaaatctgacagatggcaagagatttacctctatttttaggattacaacaaatttcgaaagactaaacccaattctaaccaggtcagccatgaggtcctgttagatggtgctggttattccccttgtacagcacctacaacactgctagtcctcgatcacagcttctctctggaacttttaagcaactctgctcaccaagcaacaacttgacatcttttcaaacactcacattataaaaatgcattccaatttctctagagatggccattacagtgactcatgtgagagttcttgccttagcaatagagttatgtgtactttggacttgactaacagaaactctcttatgtggtaaacatagatatcttagctggttggcaaccaggaaaaggagctgtaaatgataaattgcacaggtatatagttcagcttccctttaacacaacagtttacacattggctgaagaaagtattatctgaagcttaaaaaacagttattttatagttgaaattcattttattgatctcatttggaaatgattcacatttttatactcacttagcttcatgaaggttacgaatcagtagagtaccaagagaaggtattcaaaatgaccactttttgatatcttctccgggcccttttcttcctcccaactttcttaattgtccctgtcattgatgtttccatcttacttatctttttgcggagatgggagttgttttctagggggaaagatttttggtgttggttttgggtgttttttgttccatcatcctaatacctagtactctttccccattatcaagatgacagatgttttgttaaagtgatagattatagtttaacagtaatcacaaatctggcaaccaagatccacaacaagccccaaactggggcacagcaaaaagaaagctttctaaaggcagtgaactaaaagttgtgcagtttgctggaaagtccctaatcttacagtaatcctaactttatataacagactgatttaccactcctgagcatattagaaatggcaaactttaggggtgggggtgaggctgacacactgtctccagtgagagattatattggccaggggaaaatctacaatgagcaaacaaattttctccacaaatgatgcctggggtcttttagactgatgaaaatatgcaacacttttttagtccaatatgttatctagttggggctaaaaaaacatgactaccagctgggcacagtgtctcatgcctgtaatcccaacactttgggaggccaaggtgggcagatcacctgaggtcaggagttcaagatcagcctggctaacatggtgaaacctcatttctactaaaaatgcaaaaaattagccagacatggtggcacacacctgtaatcccagctgctcgggaggctgaggcaggagaatcacttgaacctgggaggtgaaggttgcagtgagccaagatcctgccattgcactccagtttgggcaacaagagtgaaactccgtctcacaaaaaaataaataaataaaaaaataaatgactgccacttttcctctgttcttagatatatgttttcactttttatttctaaaattgaagtcaatcagaattgatgtgttcctttcatgtaatagtgtgtcttaaggaaatcagtaatggtagattttataatcaaatagaagaaatgaagtaattaatatgcagaaatagattgaattagattcactgtcctctggattgagagcttttgaatgttttacataaaatttcacccaaaataaagcatttttatttatgagtttgacttaatagggtaatctggaaaattagttatgtagagtgctacattccctgaagatgcctgataaatgaactagatacttaggcagatggagctcccgaaaaaagaagccaactgttatcataaacagttgctagtttactttcttcgtagattttctttttttctgattagctggttttcttattttcctgcttcttcaaagacctgctacagtgaagtttagagactttagatacttgcaagtataatttttcagctttcacagaagaagtacatatccttctattcttacttaataaagaaaagttataggcttgagcagacagtgtttttggccatttctcttgctttattttggtaacagttaattagcatagtcctcaagctatccctccacaagttaaaaaattaaaactcccatttgaatatttatcaaaactctttacgtggcaggcactgtgctcagtgggcactgtgtgtaaagataaagaagatgcaagctctactcccaatgggcttatgagggtgttgacatgaaaagcagaagtcttaggaaggactcaccaacaagcaatataatcctgtgaaacacactcttacagcccaccccaatatcaaccaaatgagcacacctccaaagaccatctcgatttcaataaactgaagcatacatactctcatggcaccccaatttccaagacatcctcaaaagtatgcagagtaggacagaactaaaatagttactgccacaacgctaaccacttatcagatacaggatctctgacagaggttttcagtatgtgtgagtgtgagtttaagtgtatgttctttcttgactccacttcctttctcttagtcattatatgtctgaaggagagttacagcaataaacttgaatccactcattaatttaagtaaaccgttcacaatctttatttttttagtagtaaaaaatgacttgtgacatctcacaagaccaatccacagtgaacattacccagagaatttagcataaattctacatataaaatcaaactaagattttagcttgaaattctattagagaaggttaaattttcaatgtcttcattcactaggtacagcatatcctgagtgtacgatatgtttgtctgctggggctgccatgataaaataccatagactgggtggcttaaacaacagaactcaattttctcatagttctggaggcggaaagtccaacatcaaggcatttctgggttgagtttctcctgatgcctctcttcttggcttgtagatggccaccttctcacggtgtcctcaaatggccttttctcttgcgtgtacatatccattcccagtgtctcttcctcttcttaaaaagacaccagtcccattcgatgaggatcctactctcatgacctcatttaaccttaattacttatttaaaggccttatcttcaaacatagtcacattgggtgttagggcttcaacatgtaaattttgtccatatttttcatttcagtctctaatacacggtaacctccaggagtttatctattattcctttaaaatgagaatcatctgacccagaaattatctacaaatagactcaaagaagagtaggttccaaacctatcacggcatgcctggtagttcagccactggctcctggcttcggccctcagtgaagctgtcttcccctcatcaaggggatttcaaactatctacagtttgctgtcagcagttcttggtagctaagtaggtctgagcaatcaggcaaaagagagatggtgaagctagttcttgatttgcaacagtacaattgccaggttaacttcctggctgtgggcatcccttagtggtctgggatttctccctcagagacaaccacacattgtcaggggcttcctttatccggcattctctaatgcatcttctccatggcgaagactttttgttttacttaacataacactgatcccaaagacagctacatctcccctcagtcttgaaagtcacccctgggtaaacccggtgtgtgggagaactgggtttccccacttcctgaacacagaacctcagcctctgtccctctgcctgctggaaaggttggtgtggatttcaactcttacacccccttccctcttccacaaggagataccagcttacagttccacttgccccaccactgttatgaattccataacaaatttagaatattaaaataaaagctacaaatttgtgagtgcttactatgtaccaggaactgtactaagtactttccttacattacttcataaatcctctcaatatatgcctgtaattacagaggggaaaattgagactcagtaatgttaacattactcccccagtatcatacatgtagtaagtggcagggttaatattctaatttccaatgctcaagttttatctaatagtctattcccacttgcctaagtataaattccctacccttcttaaggtagaagaatgtacctatattagagaactaccttttttttttccttttgacagagtcttgctctgttatttgggctggcatgtagtggcgtaatctcgactcactgcaacctctgtctcctgggttcaagcaattctccttcctcagcctcccaagaagctaggattacaggcataagctaccatgcccagctaatttttgtatttttagtagagacaggatttcaccatgttgcccaggctggtctcgaactcctggcctcaagcaattcaccagcctcggcctcccaaagtactggtattacaggcgtgagccactgcacccagtgagagttacccatttttagcaaaacgttactctatgaggaggaagagaggttttggatgctgcttagtcctgaattgtgcacactaggtattcccagtgggctacagccatgcctctctctgcttcaagttccacatctggaaaatggactaatgatacctgcttgtcacattgcaagggccacaaaaatagaaatgagatgccgcatgtgaatggagcttgaggaaaatcaatacaaatataaataaacttatttatatgagtcatacttcaaaaaagaataccatcatactgtccttcatggtatcacccttaacaagacaatgccaaccatctaagttccctcgccccatcagactcctttaatacactacatctagtattgtttaattttctacatgcatccatctagaaacatggatgagcctgtaagtaccttgatttgggagattatgttcattattcttaatatttcctgtagtgccctgcatgcttttccacagtaggtgttcaaaaaatatcatgttgttgggttgataataattatatatggccagagagctggcattaactggtagccatttaaaataagagattaaagttatttcataattaactgaatgtttactaattgtatctttaaccaaactacttgaacgtgtttgggcctacaaggacacaggtttgcgacggtgctgattcaattagtaaccccagcaggttctacccataacttggcttaatggactccaccatttatatcctactcatgctccactctgaaggcagaggggaaatcttgggagagaggagggaggctttggattcttcaatctcaaagtaaatacaaaatatttgcctccctatgtaatttgtcatggacaaatcctcagcaaaattactgaaattacagggagccacaagtagaaattgataactgtcagggtgcttgacagctctatacaggaacaccttcgctaggaagactctgcttgctggatttcctctataaaatcagattttgttttcacttcaaatcattctctccagagaaaatatctattcatcccaccaggcactttgacacaggagccccattctgagagaaatgcatgttgacagcagaattgcagtagaagctgtctcataggatcccatcaaagaggctcttggcaagcctctgttttgagatccacattaactcaaggcctgttccatggtctcttacgtgaaaaagtaaaccagaaaaagaaaggaaaaaagacaataagtcttgtcctgagttagtaaaatattaagaaaaaaaaaccagtatgagtagagctggagaaatagagtatcttggttccttgatccataatattttgataggaataatttaaaccgtgatgattggaaactttgccatttgaaattaagcaccactctgctcctttcaccacatatatcctccaattcaatcttctgctgtaagtaagcaaaactcatgaatatgaggtccataaggctaaaaagatcctatttgtgtagccaagtggctaatgatctaccaaaggttcatgctccctcttccatagtggggacttgttgctgggaattggctgcccaaatgggggctacattcccaacccctttgcattgaggtgagggcatgggactaattcttgagtggaagtgatgtgtgtcacttcgggaccaagaaccttatctctctcttccatcccattccccggcagaaggcaggggcttcggaggctgtagcagaaggcagtgccacaaaacagaaagagcctgagtacccaaatcaccagctggaaggccacccaccaggaacatgagagcaagaagtaaacatcaataatgctaagccactggtgtctggtgtttgctaaggtagcttgcattaccctagctaacccaatttgctttcatggtttcctttccattttacagcttttaattttgatgtgctttttaatggatctattcctctataactaacaattaattatctgatctattcctggattttatgtactgtgaagattgccaaggatctgtccctctggcttactggaatagttatctatctattcttttctccacttatctgtaacagcttggtttatcacacaaaaccaccataggttggtgcaaaagtgattgcggtttttgccattactcttcatgcagaatagcagtagaggctgtctcatatgatgccaccaaaaaggtttttgctattaaaagtaatgacaaaaaccgcaatcatttttcaccaacctaatactatttgatggaagtgattagaatagagttgtagtgtagtacacagatgtaagtttgaatgttgattctgggtaactggacaagttacttgctttcgtcaaggctcggttttctcatttgtaaaaggacaataacattttacctctgctttgatgtttcactctctagtctcaaaatgtgaataaataacttttcgctcagtcccaaacaattttatatatgtctctctctttgtactttgaatcaccgccccaacagacctggcaataattccagtactacagatattattttgcatagaagataagcagttcatccagaagcagccacagtgtgatcggatgtagggctgtttatcttgacaatcctccctgcccccgcttggattacattatgcacaattcaatgtggcttctggtttgtcacgtatgattaatcacactgatatctactatgcccatttcattaaatccttcccactgaagcaggatgcccatatatacccaaagtgtgttttcctctgccttattctggcagatagggaaataaggttaaggttttaccttcattggtaaagttaccctcaaatcaaaacaaaatgctgaaaccatcagttaaatatgagctaatcttataaagaacttaaaaagtttagtcttcaggaggcaatttccagagagtaggttcaataataggaatttccttgtgcccaaaatggggtggggcagtataaagtatactgattaattgtcttaaaatttaaaaattccaactcctagtaactagttgcagcactccaggttgaacatttaactcatggaagtacctagagaatattgccaggtccagatagcatcctacccaactatctcatttgaaacgtaaaaaaattgagggtccgggaaattaaatgatttgctcaggtcactgaaggaatatactgatttaccatgtggctcccacaagagtcccgcctgccagtgctacgtcactctggtatccaaagttcactgtctaagctgctcttctcttctgtctgcactgtcttccttcagaggcaacacagcttatgcttaagagtgttagggacatgaagctctgatttgagctgaatgacctggaggttttcggtgaccctctctgaagttccatgtcctcacaagtaaaatgggattaacaacagcacctgagtcaaagggcgatggtgaggaccagcagagcttctgtcctggcacttcatgtggcctcagcaagggtctactttttctccccgcttttttttttgagacagagtcgcccaggctggagtgcagtggtgcgatctcggctcactgcaacttccgcctcccaggttcaagtgattctcctgcctcagcctcccaagtagctgggactacaggcgtgcaccaccacgcccagctaattttcgtatttttagtagagatggggtttcaccatgttggccaggatggtcttgatctcttgacctcgtgatctgcctgccagggcctcccaaagtgctgggattacaggtgtgagccactgcacccagcccctttttctccctttatggcatccaggcagacagtctgtaacagtggggcaagctccttctgactcatctatttctttgatcattattgttcgttttgtttttttttttaatgctacaactcagatatatctggaagcattcctaagcaaacaggcagacgagccctgttcacagtaagaaaaaagccttctttagataggttacacagaagcaaatttcaggacagcctgaaattatccatgtctcctgcagccaccaagggcaacaacaaaaacaaaaaaaaaaccagaatgagtcaatcagcaaaaactcaaattaaaatctagctcacttgttttccaaaaataaaatactcaacacaaactaaaattcctaacttttaccacaactgtaagtctttcaaagtattcatagacatagaattgaacacaaattggttaaaatcatgggcagagaaacaggaggaccaatttatatttgtacaggtctcagctacctgtttataaattgggatgcttccgtatgcagaagagatttttcatcttgagtatataaatattcttcctaataaggctgcctcatttctctacaaaaagactataatctaaacatatgcaaacaccaggggtgaaattgactgacaatgagcaataaaaataggaaaattcattaattactctttttaaagaggtaaaaataattgctctgtattaaaaccactgtggtattcaaacagaaatttaaaaatacatatgatttcctccagtcttacatttcatactagatagccaagtcaattaaactgatataaatgtaaagaaggtttatgcaaccccacgttgacatttcaagcataagaataatgcatcagttttccactggttcctcctactgtgggcattagccagcttgtagctatcaggcacaaatataaaccctttcgctgtaaccctggcatcacccaattccctcattcaacagtttccatgtagtccttgaaaacagctgcagatgagaccccagtagagtctggattatctatcacctgtagaggatggaacaaacctcctcaccctcactgatgccttgggttcttacagtcaaaatacacagcaagggacaataggaagtgactcagcatttgaaaactgtgtcatcactggcaaacttagtttgcttctctgtaggatataacaagataattctttcttttttttatatatcaacagtgtcattttttaaaaatgggaaacactgggccatattagcacagtttttgtgcagcattgcatacactggtgttctcttcctgagtagcttagcagaaatgcattttctcagcaatttctttccagatgtggcgttggtattgctgggtggaatggggtcgggagggtgttaaaagacaagcaggtagaaaatatcatctgttgtgaagccactaagtagcaaccaggatctgatttgctttatattttttaacaagttaccatccaaaggctaaatgaccctgaaaatcaactgggttttattcaaaacacagtttccagccacaaatctccagtatgacacatatggaatgttgaatgtaccagtgagcagttggttttccactcgctaggagttctaaaccttaaatatactgaagtgattaaatgaaatgcttcttctggcttaaaaattattttacagctaacattacataaaaaatgttttttcatccaaacatctgcagagtaaattacctttcattcatgctagtgccaagttaagtgacacagacagaaaggtttgacctcagtttccgcttccaagcatgtgccgttttccagggctcgtcaattgaccctaatgagcctccaaccaacacccataatggtcttctttaaagattacaatcatatttagacatgtttctgcctttataaacacttgcttcaagcacagaggtgcatctgacattatgtggtcaaaatattcctaagcaactctctgtaaactgattatttttgtaaattgagcaattcaaattgcagttgagagtactctatttacagacactctatgactaattcttttgcaaagctgccttttgcaatctgaatatccagccttgatttatctgtcttgtaatttccaatcttcacatatcaagcatacctaaaaactgcctaccacagtgcctgtcgaacagtagtcattcaataaatgttctggtttaatgatcttgctgcagtttcaggaaatctgcaaaataatttattatatatcatagtgcacccagacacaattcaaaaaactaggtgctatatacacatttattactttggaatgatttaggcatattagatgactttccaaggaattttggaattctagagaagtctctggattggttaatcagcaaagaaatcttcccctggatccccctcatatcctggagctctgaaaggatactctgaagtgtatactatacagataattgtaaggaatacatttccagaccttgacttctatacgtagattttctcagaactttctacagctttctactttctagagctgaggcttcctgacacttcttcctatcacccctttccccagtacaaaaatctcaggagtgatgaatgaaaaccaacagaaaataagagtccccaaagcctaatcaaagagccataatcatcatctccctccattttattatgagatgtattgctagttttatgatttatatgtaataattgtttacaaaaaaatataattcattcacataattttggtcaatttgttttttgttttttgttttgttgtttgtttgtttgtttgtttgttttttgagacacagtctcactctgttgcccaggctggaatgcagtggctcaatctcggctcactgcagcctctgcctctcaggttcaagtgattctcctgcctcagcccccaccaagtagctaggattataagtgtgcacaactacgcccagctaatttttgtagtttttagtagagaaaaggcttcactatgatggccaggctggtcttaaactcctggcctcaagtgatccaccctcttcgggctcccaaagtgctggaattacaggcgtgagccactgcatcagtcctaattttggtcaattggatgctaacaataattataaagataatccaatccagaagaaaagaaattaatactaagactatggtgacaggaaattgatagagtttgattaatattcatattgtttgaggatatcatgatagggtgatcaataagagattttcaaacatagactagaatgaaaataaagtttccaattgtttaaagaactctgtccctattatgcttcttaaggaggagaataggtgccaaatcaaataaaatattccattgcatacactttaaggaatgatgtaaaagttccattttaaattatcaatatgtagaatgcactagaaacaatgtaattttcgacttgctaattttttttttttgagacagagtctcactctgtcacccaggctggagtgcaatggcatgatcttggctcactgcaacctctgcctcccgggttcaagcaatgctcctgcctcagcctcctatatagctgggattacaagcgcccaccatcacgcacagctattttttttttgtattgttagtagagacaaaccccatctttgccatgttggccagcctggtcttgaatccttgacctcaggtgatccacccaccttgacctcccaaagtgctgggatgacaggtgtgagccaccgcgcccggcctcaacttgctaaaattaaaattgtgactttacaatgaagaaaactgaagcgcactattttaacccagtgatcaaagtgaaaagcccaacaacgggacaactgacatcctgtgcctccctgtgtgttagacagagaaagacacaacatcatttctgtgatgttcctgccaaagatgcagagtctgaatttaatcatgaggcaatttctgacaaaccaaagttgagggatattctacaaaataactagtcttgacccttcaaattaccaaggtcatgaaagcaaagaaaggtgaaaaggagaagggaggatactgtgtataaagacaagtggtggaattttaatacaaactgtaaagtagataacagtattttatcattgtacagtgattatgttaagaaatgcatattgaaatatttaagagtaagagagtactgcttatctcaaatggttcaggaaaaaatagataatgatgaagcaaaactggtaaaatatgaacgattaataaatctgggtgaagagtgtataggagttcttttttctactcttgcaattcttcatgagtttgcaatgatttcaaaataaaaagtaagtaaaataaataaaatctaaatgtctaataagatatgggagtgactacataattttccaaaatctaacaggtgtatcagtcaaaatgatgcaaattctggattgtttctcttattctctccaggatctttgtcagtcatgcagtttctactctcctgagtgcctcctgttcatgcatttcccagcagcaagatctgtgtgttcaatttcatcatctcctctctcaatttggcctaacaaattgacacgttctgtctgccaccctctaaagaaatagtaaagaaagtgtcactttctgtttgataagcatgaactgctttgcctggagaagcaatgaattaattaagtttaaagatgaatgagctacaattaatctagcttagtttatattgtcagcatatggagaaaaaagaaaaatcttccagtagaaaacaaacaaaatgtatctactattaaatcactcgtacatgtatatgtatatgtatatatatatatatatacacacacacaggctattatacattatatacagtatgcacacatatatttacacacatatatacatatacaagattgagttcagagtatattgataaagttattctgaatatatctggtaaaatatataaagtataattgaaatttctctttaaaaggaatgaagtgagtctaaatgcatatttcatatttattttatatgtagtatcagagtgtgtgagatacactctctcatttattcctactctgttcctctgaggaaaagaggaaatgatcccatttgacagataagaacactggggcaacatgagacacaggtaaggagacgggttgattagactgagaaattagcctgcccagttgcctgtctatagttccatactggatcatgctgggatctgctagaattttccccttcccccacacacttagatgtctacaaacatacatacgtatgtataacattccatactatacattgtgttacatgaacatacatacataaatatataaacacatatcatttcacccaaactaaggcaaaaaccaacaccaataaaaatatctccagaaaccattttctttatgtccttatcaatgagaggagttaatggattgaacagaggaaagttgttattagcaaaaataaatcctgactcagattgctgagatgatccttaagccagagagttcaaatttccagcctcaagacaaaacttatagctagtgatctctgtaaaatctagagtaaatggcaaaagaaaactgatggtatactgttatctatctataatgtccagagtttcataactaaaaataaaactctggcttctaaatattcaagaaacttccagtatcttttctccaatagtacaaaaatgaagaaatactttgttcccactgatctcttgggcctctttctgaaagcaaaccagtaccaatgagagaaacccagagagcatttcaaagtattgctactgttaagacctctttaccttagaagcacctaagtgctaacatcttccaaaacaagttcactatgactgttcagtgccagccctggagtctgcacagaaaagtgagtcctttagtgctacttgcaacagttaaaaaccagtttggtatatgtcagaccatcaggacagaaaacagagtctgcaatgaacatgcttatggcccacactttccagtcaaagagaagtgagtcatttctgcttcaactgctatccctacaggcctagaaaaatggaaggactgggcaggaggggtcagagaaaggatagaagaagcatagaattggaactaaaactgtgtagccttaaagtgctctggcctgaaaatctagagaaggcttcagcaggagaaagcaggagaggacatggttattttcagtaagtcatagaagggaagatggctaacagaaatgaaatggacacagaacatcaccaaagtagcatgaaggtatcagatcccctgagataggtcttagccaaataattccactcctgcacattagagtttgacatctaaggcccctccatcttttttccagtcaagacctacacaaatgggtgagggcttgctacatgagaagtaagcaggaacaatacgagaaccaagacaagctacaagcaggacatgaacacatcaaaaggcttctgaaaagacacgtctacctagcctgtgaccaggtcaactccctcattaagtttagcccctttaaaaaatatatcttgtttatggtgcctttggtttctcccttttccttctaattaaaagcaatttttgttaacttcttaatacaaaagcaatgctttagaaaaattagaaaatacacatttttttaaaagccagatggtcaacataaacatcattaataaaaataaaagaactgcctatatttattgaccaattatcatatgccaggcactctactaagtattttacatatattatcttattcaatcctcacagtaagtcttatttaaaaaaaaggtgggaaattcattgtacgatgtttaacaccaaacgttatgctgaaacactagattattttgctcagcaaatatctgcttgtttgtttatatacttaaacatttatttagggatgaaatgattttcatcttaaaaaatgaagtcttcccactcagaagcatggactatttcccagtttattcagtctttatgtcccacagtaaaggactacaatgttcttcatataacttctgtccatatcttgctgagttactcttagaactatatttgtgatgcaattatgactggtattctttttctcccaatcatattattgcttgtatatttattctgaatttcctgtaatttttgagagtaatctgttacattttagaagaaaaccaaaaaagattttcttataaggattaaaagttgagggtagagggaggaacaactagaagtgaatttgaattggtttccttgcaagagacagaaataaacacagagtgcagtaaacatcaatcagcacctacttattaactcagtctggcattgaattaggctagagagggttatgaaagaattttataaccactgaccttgacctgaaagagttttacaaaatggttgggaggctgggagtcaatgtatgaaaatctgttagcacttatggagttagtaaatactaaatcatgaagcatgactttatctgtgttaggtgttaagaaaaaagtggggtggaggcaaggtggccaaataggaacagctgggagctatctacagctcccagtgtgagcgataaagaagacgggtgatttctgcatttccaactgaggtagcgggttcatctcactggggagtgccagaaagtggggcaagacagtgggtgcagcgcaccgtgcgtgagccaaagcacggcaaagcatcacctcacccgggaagtgcaagtggtcaaggaattccctttcctagtcaaagaaagggatgacagatggcacctggaaaatggggtcactcccaccctaatactgcgcttttccaatgggcttaacaaacggcacaccaggagattataccccacacctggcttggagggtcctatgcccacggagcctcgctcactgctagcacagcaatctgagatcaaactgcaaggcagcagtgaggctgggggaggggcgcctgccattgctgaggcttgagtaggtaaacaaagcagctgggaagctcaaactgggtggagaccaccacagctcaaggaggcctgcctgcctctgtaggctccacctttgagggcagggcacagacaaacaaaaggcagaagtaacctctgcagacttgaatgtccctgtctgtcagctttgaagagagtagtggttctcccagcacgcagctggagatctgagaacgggcagactgcctcctcaagtggttccctgacccccgagtagcctaactgggaggcaaccccccaataggggtggactgacacctcaaacggccaggtactcctctgagacaaaacttctagaggaacgatcaggcagcagcatttacagttcaccaatatatgctgttccgcagccaccgttgctgatacccaggcaaacagggtctggagtggacctccggcaaactccaacagacctacagctgagggtcctgactgttagaaggaaaactaacaaacagaaaggacatccacaccaaaaacccatctgtacatcaccatcatcaaagaccaaaggtagataaaaccacaaagatggggaaaaaaacagagcagaaaaactggaaactctaaaaatcagagtgcctctcctcctccaaaggaacgcagctcctcaccagcaacggaacaatgctggacggagaatgactttgacgagttgagagaagaaggcttcagaagatcaaactactccgagctaaaggaggaagttcgaaccaatggcaaagaagttaaaaaccttgaaaaaaaattagatgaatggctaactagaataaccaatgcagagaagtccttaaaggacctgatggagctgaaaactatggcacgagaactatgtgacgaacgcacaagcctcagtagccgatgcgatcaactggaagaaagggtatcagtgatggaagacgaaatgaatgaaatgtagtgagaagagaagtttagagaaaaaagaacaaaaagaaacaaacaaagcctccaagaaatatgggactatgtgaaaagaccaaatctacatctgattggtgtacctgaaagtgactgggagaatggaaccaagttaggaaacactctgcaggatattatccaggagaacttccccaatctagcaaggcaggccaacatccaaattcaggaaatacagagaaggccacaaagatactcctcgagaagagcaattccaagacacataattgtcagattcaccaaagatgaaatgaaagaaaaaatgttaagggcagccagagagaaaggtcgggttacccacaaagggaagcccatcagactaacagctgatctcttggcataaactctacaagccagaagagagtgggggcaaatatgcaacattcttaaagaaaataatttccaacccagaatttcatatccagccaaactaagcttcataagtgaaggagaaataaaatactttacagacaagcaaatgctgagagatttggtcaccaccaggcctgccctaaaagagctcctgaaggaagcactaaacatggaaaggaacgaccagtaccagccactgcaaaaacatgccaaattgtaaagatcatcaaggctaggaagaaactgcatcaactaacgagcaaaatgaccagctaacatcataatgacaggatcaaattcacacgtaagaatactaaccttaaatgtaaatgggctaaatattccaattaaaaggcacagactggcaaactggataaagagtcaagacccatcagtgtgctgtattcaggaaacccatctcacgtgcagagacacacataggctcaaaataaagggatggaggaagatctaccaagcaaatggaaaacaaaaaaaggcaagggttgcaatcctagtctcagataaaacagactttaaaccaacaaagatcaaaagagacaaagaaggccattacataatggtaaagggatcaattcaacaagaagaactaactatcctaaatatatatgcacccaacacaggagcacccagattcataaagcaagtccttagtgacctacaaagagacttagactcccacacaataataatgggagactttaacaccccactgtcaacattagacagatcaatgagacagaacattaacaaggatacccaggaattgaactcagctctgcaccaagcagacctaatagacatctacagaactctctaccctaaatcaacagagtatacattcttttcagcatcacaacacacctattccaaaattgaccacatagttggaagtaaagcactcctcagcaaatgtgaaagaacagaaattataacagactgtctctcagaccacagtgcaatcaaactagaactcaggattaagaaacacactcaaaaccactcaactacatggaaactgaacaacctgctcctgaatgactactgggtacataatgaaatgaaggcagaaataaagatgttctttgaaaccaatgagaacaaagacacaacataccagaatctctgggacacattcaaagcagtgtgtagagggaaatttatagcactaaatgcccacaagagaaagcaggaacgatccaaaattgacaccctaacatcaaaattaaaagaactagagaagcaagagcaaacatattcaaaagctagcagaaggcaagaattaactaagatcagagcagaactgaaggaaatagagacacaaaaaacccttcaaaaaatcaatgaatccaggagctgcttttttgaaacgatcaacaaaattgatagaccgctagcaagactaataaagaagaaaagagagaagaatcaaacagacgcaataaaaagtgataaaggggatatcaccaccaatcccacagaaatacaaactactatcagagaataccataaacacctctacacaaataaactagaaaatctagaagaaatggataaattccttgacacatacactctcccaagactaaaccaggaagaagttgaatctctgaatagatcaataacaggagctgaaattgaggcaataattaatagctcaccaaccaaagaaagtccacgaccagatggattcacagccaaattctaccagaggtacaaggaggaactggtaccattccttctaaaactattccaatcaataaataaagagggaatcctccctaactctttttatgaggccagcatcatcctgataccaaagcctggcagagacacaacaaacaagagaattttagaccaatatccttgatgaacattgatgaaaattcctcaataaaacactggcaaaccaaatccagcagcacatcaaaaagcttatccaccatgatcaagtgggcttcatccctgggatgcaaggctggttcaacatacgcaaatcaataaacgtaatccagcatataaatagaaccaaagacaaaaaccacattattatctcaatagatgcagaaaaggcctttgacaaaattcaacaatgcttcatgctaaaaactctccataaattaggtattgatggcacgtatctcaaaataataagagctgtctatgacaaacccacagccaatatcatactgaatggacaaagactggaagcattccctttgaaaactggcacaagacagggatgccctctctcaccactcctattcaacatagtgttggaagttctggccagggcaatcaggcaggagaaggaaataaagggcattcaattaggaaaagaggaagtcaaattgtccctgtttgcagatgacatgactgtatatctagaaaaccccatcgtctcagcccaaaatctccttaagctaataagcaacttcagctaagtctcaggatacaaaatcaatgtgcaaaaatcacaagcattcttacacaccaataacagacaaacagagagccaaatcatgagtgaactcccattcacaactgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcagtatcatgaaaatggccatactgcccaaggtaatttatagattcaatgccatccccatcaagctaccaatgactttcttcacagaattggaaaaaactactttaaagttcatatggaaccaaaaaagagcccgcatcgccaggtcaatcctaagccaaaagaacaaagctggaggcatcatgctacctgacttcaaactatactacaaggctacagtaaccaaaacagcatggtactggtactgaaacagcatggtatggtaccaaaacagagatatagacaaatggaacagaacagagccctcagaaataatgctgcttatctacaactatctgatctttgacaaacctgacaaaaacaagcaatggggaaaggattccctatttaataaatcattctgggaaaactggccagccatatgtagaaagctgaaactggatcccttccttacaccttatacaaaaattaattcaagatggattgaagacttaaatgatagacctaaaaccataaaaaccttagaagaaaacctaggcaataccattcaggatataggcatgggcaaggattccaggtctaaaacaccaaaagcaatggcaacaaaagccaaagttgacaaatgggatctgattatactaaagagctttgctgtgcttctgcacagcaaaataaactaccatcagagtgaacaggcaacctacagaatgggagaaaatgtttgcaacctactcatctgacaaagggctaatatccagaatctacaatgaactcaaacaaatttacaagaaaaaaacaaacaaccctatcaaaaaatgggtgaaggatatgaacagacacttctcaaaagaagacatttatgtggccaaaaaacacatgaaaaaatgctcatcatcactggccatcagagaaatgcaaatcaaaaccacaacgagataccatcacacaccagttagaatggtgatcattaaaaagtcaggaaacaacaggtgctggagaggatgtggagaaataggaacatttttacactgttgggaggactgtaaactagttcaaccattgtggaagtcagtgtggcgattcctcagggatctggaactagaaataccatttgacccagccatcccattactggttatatacccaaaggattataaatcatgctgctataaagacacatgcacacatatgtttattgcagtgctgttctcaatagcaaagacttggaaccaacccaaatgcccatcaatgatagactggattaagaaaatgtggcacatatacaccatggaatactatgcagccataagaaatgatgagttcatgtcctttgtagggacatcgatgaagctggaaaccatcattctcagcaaactatcgcaaggacaaaaaaccaaacaccgcatgttctcactcataggtgggaattgaacaatgagaactcatggacacaggaaggggaacatcagattctggggactgttgtggggttgggggagtggggagggatagcattaggagatatacctaatgctaaatgacaagttaatgggtgcagcacaccaacatggcacaggtatacatatgtaacaaacctgcacgttgtgcacatgtaccctaaaactcaaagtataataataataaaatttttttaaaaaagaaaaaagtgtctagagaatggaagtggtggaaaaatatcccaccaaaacaaacgagctgacatatcattgagtcagtggacagtttgcagataagaagccaatataaacacagatgctttaatatgaaaccagaaggatatctttatgtcgagccccaatatctactaaattctaatactttaacttctcaaatagtgaaaacaaccaacaatacagaaaagtctcgggcggagggaggaaaagtgacaacacacctgtgaaatggcttctcaaagtttcaatagcatgtgtttctaagatatgggaaagccaaaaaacgcatgggcagccttcttcctttagaagtattcaattgttctagatagaaatctcctttctttggttaagaatttattgtagtttcacctttccttagaaatgaaaactgtgattgttgagtaaacaacttgtaaaactattttcactgacacttattaagtatcttggctccctgcattgaatttctatttagtcacttccctcaacatgtagatcaaactgatgcctcaattataatccttgaagaacatgggggaaagactgtttaaagcattccctctctgctaaggaggaaaatatcccagtcacatgagctgtgtagcataatgtttgttttccatgttgatctgcaaaagagagagatgacagaaagagtgttgggtgtggtggctcatgcctgtaatcccagcactttgggaagctgaggtgggaggatcacctgaagtcaggagtttgagaccagcctgaccaacatgatgaaaccctgtctctactaaaaatacaaaattagccaggtgtggtagcacatgcctgtaatcccagctactccaggggctgaggtaggagaatcgcttgaacctgggaagcagaggttgcagtgagccaagatcgcgctactgcactccagccctgggcaacaagagcaaaactctgtttcaatacataaaaaataaaaatagagaaagatgacagaaagcagaatcagaggaaatgtatcactgttgaacatttcctacatgtattgcactgagctcaacactttgcagggtctcccttacagtgaccttctgtggtaggtatattacccttattttataacttgaaaactgaggcttaggggtatatacacagacctgggaactgaaagctacagttccaataccaccagctttgctgcttgctagccatgtgatcttgagtgagttatttagtcatgctgcagctcagtttcctcatcaatcaaatgatgggagtctctgacgatcacgctagggatgatgcatataaagcgcttagtgcttggcttgtagcaagaatccaacagatgacagccctcactattacggcctacactgattcttcagtctgcatctacacccactgtgggtcatcctgccacctgccctgccctgctgtatgacctgaggcttcctcctaaagaggcattgccagagcttcctcataggcaggcttctgggtgaacccagtcattgggaagcactaacaacaagagatcagagctcaggaggagaggagctgaggtatttcttccccactcccttcttcctccaaggtatgttttctgacagtgactgtccctccgtgtctccagcttccaacaggagatccctctctcatagctcctttacccactggtttcctgtagtgctaattcctctccttgcacctccaggactaaggatggtaataaccgcccactgtaactagtcttgggtgtccaacaccctttggtaattgtgttacctgctcccatatttgtaagcagtcctttcatcaaaatctcttggaccatctgaattggagtctgcttcttgcctaaccctggctgatatccaaactcaaaaatcatacactcgtaaatgaaggacccagcaacctctatggtctatggccaatgctttacaaatcacttatttgccaatgataatttaaactgtactggtagtatacaaccacgtattattaaataaccattcttaaaagggaatagaacattgttaaaatatagtttgcaattgctgagaaatacatttggtgatttattcagatgatatctaaaatgttcaatatctcattccaaaggccgcaccccaattacacaggttgcaaaccctatcctgcaagtagcaccaactacagtcccactttctctctgagaaatgtcaacctgactttatcctgagaaaacagaagatcaaaactcttcatagaatcttagagaaagtctctaagcaagagccaaaatgtaaaatttgaggtaattcttattgtcattgtcatgtgcagaagtgcagctacaattctgagggctcggttccagaatattttagaaaaagtaatgagcttctctagttttggacaagacggcatagactcttttccctgctaagtatgaccccaaaccctggatataacacaacaaacaatcataagaacattctgaaaggtgaaagaagaacacagactggctggggacctcaaaagtcaaggagcagcacagcaacctaaaatctcctaaccacccatccggaggcagaagatgtcccaggtaggtgcttcttcccctgtaggaggcaccaggaaagactaagcagaagcacagccagcaccaggcagcccgaggaagcactctctgccccccatgagcctggcatcttctgcctccaaatttggtgatgccaggccaacccatagaagcacttttcaccctcacaggtagcacaagcaggaactgagtgacaaccccatcagcactgggcagcccaagccagagaaaatagtttctgctcctgcaggcttggcatctctcatcctctacccagtggtactagatataaagaagaaccaaatggaaattatgagacttaaaacttcaataactgaaataaataaaaaaattcactagaagggctcaataggcaaatatatgtgacagaggaaaaaaaataagtgaacttgaagatagaacaatagaaagagacacctgtggggcagaaacaaaagactcaacagtcatatcattggaatcttagatggagaaaagaaagagtagagctgaaaacatattcataaaaataactaaaaacttcccatatttgctaaaaaacaaacctgcagatttaagaagctacgagaataccaagtaagataaacccaaagaaagccacactaaaacacatcataagtaaaattctgaaaactgaagacaaaaataagaatggaattcatatgggaaaaagtcaaagtttgatgttatttttcactgagaaaactttgcataacaacagctctgacaagctgatatacaaatggatagaattataacacaatataatgtttataatgtgttagatacaagccctttgacaaatattaatattaaattcttaaaaaattcctatgaagtagttattattattcttattttacagttggacagagacccagagaggctaaataacaaactgagacccagaaaggctaaataacttgcccaaggtcacacagctagtaagtgacagaacccagaattcaaactcagacactctggttacggggtctacattcttgactatgatgcctggaagtggtctagtatagtagtatggaatcatgtacatatagtttagtagtatagaatcaacaaccaaaattgacaaggtccttataaactagataaagagacaaggaataatccaggatttagttccagatgtttttgtttatttttgttttattaagattttctttaaaatgtattagagctggacagtatggctcctgtaggcttggatattagtaactctcattgttcagaattaagcttatactaaagttgtacttggtgtgggcaatgtttttttctgccagaatcatatagtaaaagacatctgtgattgtttttttaaagttgaagttaagcagttagtctccttggcttactacttttattaaatatcaatgctgatgtcattttctccacaaaccaacatcctaaatgatttttatcaggacagataaactctcaaatacagaaagcaggtcttttcattatcctattgattaaaagcaaaatacaaaaaaattagctacatgatacaggcacacaacaaaaatctttgtcaaattttaacatggcacaggtttcaaaataaaattatcccttttagaactggcaggtcaatattatctttttgttctaatatgggaccatttgcagaaatgtggtttcctgtgaactaagagaaagctgaagtgttttgacacactaaactgtactaacaacacccactgaaatgatggcactgtctttgaatgacgtttaccctgagactggagggagccactgggacatactggtacaaactgagtgttgaacacatataaccttaatggataaaaggcagggagggagggagggctagccaagcctctggcctatgtcccttaagtctcttcacctcactcctagggttcttgaataaaatgtaaaactaaggccttaaaaaacctgtagtgtgggaattgactgcaaatggaaatcagagaactctgggggatgatggaaattttcgaaaactgctgtggtgatggttgtacaactctgtaaattaattttaaaaatacagaggtatacagttctcacagattaattttataatgtgtacagtacagctcaataaaactatttggaaaaatatcctgcaggttctccccattgccttctgaacaaaggccgagttcatgaaaacatacaaaatcctttatgatacagcccttgcttaactcacttcttgtctttttttgccacctgtgttcccccagccctctgatccaccactccacctatattctatttactgagcaaccagcagttttcagaaaatctaaagtggctgcatactacagtcctatgcctctcaccctgttctctctgccttctgcctagaagtcttcctccccacagcttcctgaccaacaccaaatggggggttcaagacacagctcaacctgactactatattctaggatgcttttctgactttctgggtagaattggccatttctttttgtgttcctccagagtacttagtcattcaatgtctataaatactttttccttacaggtgacaaaagcatctgcaattctatcaaaatgtccgtgtagcaccaatcccttcctctcagacctataaagataataagcaagagtgtattgagactaacaagaaggtgacacaccaaggatgggagtaacactgagggagtctctcacatggacaattctagcagctttataaccagtctccttacagcagtcagagtgaaccctttaaaacatatctaattttatatatatatatatgaaaaagaatgtaagttttagtcagagaaaccgacagagaatttaaagcctgctccaccacttactatatatatgactatacaagtcgccccaacagtgagcacataatttcctcatctgtaaagtggaggtataactaccttacagacttttgcaaagaatcttcaagattagccacgtaaagttgtgccacttagatatgatttcactttcacttccttacttaggttgttggttcgataattgatattactgaataccagacaggctaagaaccacatcactgatttacactctcctccacatttaaccgaaaagtgaccaatcaaaaagtatcacaactcaggttgatgtgcattcagtctatcccatggtatctttgtctcttttcaaatcacaatactgatgttccaataaatgatgtttattatcaggccatgagccatcaagaaaatactaaactctgcttagaacactgtttaagaaggttggaaaatatatatcaactatagacagttttcttagaaggaaaatcaacatgttagcacataacaaattaacatacaatctgggtaactgaataatatataacggcatgcttccataatagatgaagaattatggaatctctgtttgcaatccaatgtgggtaagaagaaatgtattcattcaacaactattcaaacatttgttgaacaaatgatatatgaaaggataaaagaaccagtctagaagaggaaacttgtgatcttcaggtgaaatgcatgttacaaagcataagaggactgttattgtgttcttaatttcagaaagttaacaaaagactcagggtcagggataattaaattcataagtatgtgaaagaatgactagttccaaaacaatctaagatgaacatctcttaactgatatatggtttctattaaataggtgacatgagttaagtcatcattaactagtactttttcctcttgctatatcaaaactatcaacaaacattggaaagcctacctccaaaatgcatgctgaatctgtgcagcccactgccaccactctggtctacaccactagtctctcatatggacaattccagcagctttatacccagtctccccacagcaatcagagtgagccctttaaaacatatatcgaattatatcatgtgccaaatcaacatgtttcaaaggtttcccattgtacttagaataaaaagcaaacgccatggaccccatgatgcttacaccctggcccttgtctgcccctttatcctcattatctgccactgaccaattcatatgctcaagccagtggttctcaaagggtggtcccaggacaagaagcatcattacctaggacctttttagaaatgcagactttcaggacccatcccagacctactgaatcagagagtctgggtttaaggctcaacaagctgtgttttaacaagcctttcaatgattcagaaacactaaatttaagaattattactctagatatctgctatagtttaaatctgtctcacaaacttcatatgttggaacaatcctcaaattcatatgttgatggcatttggaggtggggcctttgggaggtaattaggattgggtaaagtcattagggtggagtccccatgaagggactaagaagaggaagagagacctgagctgacatgccctctcagcatttgatgccctccaacatatgatgatgcagcaagaaggtcctcgccagatgccagtgtcatggccttggacttcccagcctccagaatcgtgagctaaataaacttcttttctttatagattacccattctgtgtaattctgttatagcaatagaaaacagactaagacaatacattaggcttctttatatagctagaaaataccaagctcttttccatctcagcacctttgaatttactatagttctgcctagaatgtatccctcacctccaccccatgtcaccaccttgattgccccttctccatcaactgtaaaaattctacctgacccaaattactttgtatcatgctacactaatcactactatcataacacttagtacaacctgattttatttacttgtgtgttcatcttgtttgtacactaaaacatgtgctcctttagaacaaggatcttatctttatcaaccacccagtgagttacaaacagtagttgctcaacaactattaaataaattaatgaataagcccagtataaatccatttaacataaggttagaataacaaagttagaatagtgaaaaaagccaccactgacttataataaaagtatccaaattgcctgcttactatgggccagtccttgggctaaatcttttcttgtgtttttctctttaaattctccctagaactcaatgaggtagaactacaatcatcctcactttaagatgaagacgctaagatataaataagtgaaataaattacttgaggctaccaagctgatcattcgcagagccagggttcaaatccaggctgtccaactccaaagttcatacactgcacccccacccactactacctcttctgaaaaaggtatctgaccagatattttcaacatagatttcggcagactacagggataacctggtgaggaagtagtctctccaattcagatctcctacagataaaaccttggcaaaggggtactcaattctgtcaactgagtctcacaaaattataatgttaactgatgggtgtttagaggatgtacattttagaagactcttaaattgagtacagatgtttagaaaatcagtgtcaaattagaaagcattaagcagacattaaggcagaccaaattggtcttttcagaaagctgggtcaggatgggagaaatgtgtgcttgctaagtaggccaggttactcagaagtgggtcttctaactcagaaattagtgaaggcagcccagctttgccagagaatcagacagagtaagaagcctaaacatggagctgaaggattgacctacaggttttcaggtggagtggaaggaagcagattctcttgccaagaccttcacagcaacctgtagatgcagcactggaacccaggactctggcgtgttttttaaccattaacctgatgccagggatgttggaactgtcttggaactccacttttcaacagaaatttctggaagagattaaggagatcctatgccttaaaagaggaccaggacatgttcacatcatccatctgcgggtttctggaggtggggggagccaatggtctcagacttttggaaccactttattttcatttcatagtttcatcacattcggaaaggtttggtatatttcctcatcataaaaatctcattctcaaaattcctcttgaaatatatgtgttggtctccaaatgatgccacacttgtttataggactagatgacaaacactcaggtaaaggcattttactgtgtgcagcaaaatatacagaacattcactttcacaactcaagcatttatggctgatatcattaataaaacatagccttagaatccctcttaatccatcaatcagaatcaccactcaaacattatgtgcctcccatatcatgggtaattgtatggaaataaagaagtatatgaggcagtatagattgacaattaagagtttcaccctggagttacacagacacaagttcttatcttggtgttgttacttaccaaccatgagaattggaccagttatccatgccatggtttctatctctaaaatggaataaaaatcacccgtaactcattatatggaggttataagaattaaataattcaagtaaatacatagtcattattttactaaaatgtgctacgtactactctaggtgtttttcacatattaattcatctcaccctcaaacaatcttatgagatagaaaatatcattatgccccttttgaggaaacagccacagggaggggtaaaggaacttgcccaaggtcacacagccagtaaatggcagagccaggattcaaacccacgcagtctggctccagagcccacatatgtaagcactatactattaagaagacaacaattcctatacttactagcttcatgaaagtaaaaacatttgcaggttttgctttgaaagatccaagtgaatgctactagaaaaatacaaagaataatgtactttttttatcttaagcactagccaaggaaacaaagaaggagcagaattcactgtacccaagtactgtgtggttattttgatacaagtcaacaactacagcagatgctggtatccatcttcctgacaggtgacaggtagtaccaacactcttcagatcatgagacctcaaaatactcattttatcctgacagcaggggtgagaaataacatgtaaatcatcatggggagatggaggcctaagtaaatattccaggaaaagggctcctttagcataaagtagcctttttcacacttgtgcagactccagaaaggaggtgccccatggctgtcagctctggtgtgctctgcagatgactggtcttccagccaaactgttggctggcttttttctagcaattcaatctagcattctgctagtacataccccagcacaaagcgggccaggtccactttattacaaggttacaggcaagccatagataaaaagtgagtccttaaatatcagggattaataattcaggaagtaattatttttagaataatatttaatttcaggaaatatggaagttaaagctttatcctgtgcagaatgatttaaattccagcttaatttccatctactaacataattgtggtgactaattttgataaaagtactttggatttgcctaacacctctgagtgttgaattccaagggcttcagtaaatcctgggtcacaagattgctattttttccacatttcataagactttttggttaatactctaggaaatgatcacaagcaggttctcactctcctgatcaaagacatagttccacctgtgaccaacttgcttcctgactatgtcagtttcctgttgctgccttaacaaataccacaccttagtggcttaaaacaacacaaatttcttctcttagttctggaggtcagaagtctaaaatgggtctcacagggctacaatcaagatgtctacagggcagcattccttctggaggctctaggagagaatcagtttccttgccttttcaatcttctggagaccacccaccttcctgggcttgtggccccttcttccattctaaagccagtcagtagggcatcttcaaatctctcttggtctctggctctcctgcctctcacttataagcagccctgcgatgatggtgggcccacccagatgatccaggatgaccttcctatctcaagacccttaactcaatcacacatgcaaagtcccttctgccacatcaggcagcatttatagatttcagggattaggatgtggacaactgtggagagccatcatttcacttaccatattgactcttaaggctatgactcttaaagtcttttctcctaatctataaacccatcaagaatatttaagttattcttgtaactacacactaccttgttaactcaatcttattataataagctatgtcaggctatagtcaagaatattaccattataatattacctatataaatctggggatgtgaagcatagaaaagaatttttaaatctcaagttttgcatttgtgtacttatatacctaccaatttatagagtttgaaattttatagaatttgaggtttggtagataaggtcgtaaataaagtttgacgatttatatcacatcttcacttaacatatcacttcatatattttaattattaaaatgtgtgttaatgaaatttcaactgtaattaatctcctttctactgaaatggttcaatagatccatgagcctaaacaaatctccctggattttcatcattaatatttttactctttaagaataaagaatttatgaattatgatctacagtttatcccactatttcaaatgacaaaatcttgtcactgctttagctttaaaagtatgtcttcccacttttaaagcactttttctagacagccatacctactttcttcacttaagtagttgacacttatataacactacacacatatagttgtatgtgtcaacacacatgaaagaggaaataacagagaaagtgttaatctgcctatatctttgaatattatcaaagcaatttagaaagctttataactgaaagttaaatatgagaaagaaaaaagacagtttcatatcttacagacgaagttaaatagaacattctctgagcatggtttacatgtgagactttgttctaggtgctgtatgccaacactattcccaaatatatattttttcagtgccttcaaaagaggctgttatgctaccttagataaccccccttctaatctgcatgatgcaattcactgctatctgcatgatattccacttgaagtgcacagtagagcactgtgctttccatcagcaaatatctagagttatgtgggcatgaaatgtctcctccaaggagtcaacagcgacccaggaatcgttctcaactgcacccctgagctggcagccatccagtcgaggttccctagacaggcagtgttgtcactgatgttacaccaaggggcctgtgtttcagatgtttctctttctcaacaagcacatcggtgtgaactcgaaagaatgaaaaatagttccatgtgatattcatccagttgttttgttctgtaagtagcaatggttaagttacaaaccatgaatttaatgccaaactcctgtgctcaggtaggcatgacagtaaactctcaatagcctataaaaaggaagatgaaaggataaaggtaaatccaatttacacaagaatcaatactgtcatcaacaacactaatagggaaggttctatgatttttttaatttcctctttttttttagcataaaaacagaagttaatgggtccctctcagtttgggaaaatctgagtgacaagccaaaaccaataggttttgaaaggggcctgtgaataaaacgcaaaaagtgcctaattggagtcaagaaccaactcactataacaattgtagaatctagatggcaagtgtaggtgttcattatactaatcttttgaacttgcccacatgtttgaaaaaaaatcaaaatcaaaagttggaaataaaaaagtaaaatagaaaaagaaacaattcataagatattgttgaaccccatgggctttgagaaatttgcataaacttgaggcatattcaggctgaccagttagctcctctctccatatacagctccatgccaaaaaaattatataaaatctactatctgagaaaatgggaatccacattgcttcatagctcttctgaatgaacaaaatgcaactggtacagacttaaaatcgttagggaaatttccttttgcagatcatgtcatactgacatgtactagaatagcaattaaaatattctaaacccatccccctctccatgtaactatccttgtcatactctcttgaagtcagagtacaaattgctccagggctaagtgatgacagaaacatctcccaattactcctggttacacagactcaaagatgggaacaatgaagttctaatgcctacacactccttagtgaactcaaatttcctaagacaatgaatgatcaaagtagagtcttatgaaagcttctacataaaagacaggaaatgagacccaaatcaggagagttggggaagctcaggaggagggagatacatatccagccctcatttaagatcaattcatggatgactccctaaaacaccacagaaaatctgacacaatagcaaatgcactgaatgatgcatgccattcactatcacaactgagaactccaaacatttcgttgatattagaaagtgaaacaaatgttcctgcaaaagtcaaatgagaatcaaaagcaccatgtttgcactgcagcctgggtgacagagcaagaccctgcctctaaaaaaaataataattttttttaaaaaatcaccatggtttacagggaaggatactgccgtggctgcacagacctttagtgtctcaaagcattgtgcaaatacctgtgtatttctttcatgcaacatgagcattaacttgcaaattttaaaaccctctgatttatcattccaccacttcacttatttgtaaaaccaactaaaaaagtattaagaatttcaagacggcaacatgagagcatcagatcacatgcaggggctcttctgagctcgggctgttgaatccaggcctgaccatatgaactggcagagtgaaggagagatgtggggtggagtaggtcaaagatgctgcaggctgcccaaatgaaggaatgtgggaggagaaagggagcaaaagggctggaaaataaaggggtgtgaggcacgttcaaaagagcaggaggaggaagagtacctgaaggcggtatgatagaggtggagaggaaagggctagatcaggggtccgcaaacccaaggccacagactggtagcagtcaatggcctgttaggaaccagacagcaggaggtgagcagctggcaagcgagcaagacagcctgtgctctggctcctgtcagatcaactgaggcattagattctcatagtagcacgaaccctactgtgaattgtgcacatgagggatctagattgcacactccttatgagattctaatgcctgatgatctgaggtaggacagtttcatcctaaaaccatccccctgccatccgtggcaaaattgtcttccacaaaatgggtccctggtgccaaaaagttggagactgctgggctagatcatctggatgcagttcaccacccacagtgcctcaaagtcgctccttgttttctctttccctgggatcctctcaccacacgcccaacaaaggtatcactctttcatgcttgaagggccatggtcccctttttatgttttttgaacaaggagacccaaattttcactgcgtgcacactgggctctgcaaattacataagtggttttgcctagaagatttagaagatcaccagtctagatagagaattctagaaaataattcctgaggaaggtcccctttgatggagtaatcttttaaaaatttattctgtttgcagattgtctgttacctcagttaacaaaaacattgactgttaaattaaatgttgacacaaatgatcttgccatgtggaaccataacctccttttcctctgtaagaattccagcaaactaacaaattggaatctgaaagccccaggttggaaatctaggaagatgacagaaaacatcgtccttcagagtagcaattcctgaaacctcctaccctaggtccatgccttagctactctgaaggaaacacgacctttcctcaaagtaaaagagagcaaaatgtaaggaaataattataaaaattgacgcctaaagaacaaaccctgggaatctgctatccagacaccatcaagccatgagtgagtgcataccatgaaaggtttatcagcgcacggacaagggccaagagtagactagtaagcagtaccatagcagtcatgaaataagaccagatcatcatagggaaggcatggagttttcttacaattctttgctcagagctctataaaagcactaaaggggtctacatttttttaaatagtagggctatttatataatctgttaaattatatttatgattggcccccaaaaagtggctttccaggaaccttgagaaatctttttatctccaagaaaaaagagaattgaactttaatacgttttttattatttatttattttgttattatactttaagttctagggaacatgtgcacaacatgcaggtttgatacatagctatacatgtgccatgttggtttcctgcacccatcaactcgtcatttacattaggtatttctcctaatgctatccctcccccaacccccagcccccgacaggtcccagtgtgtgatgttccccgccctgtgtctaagtgttcttattgttcagttcccacctatgagtgagaacatgtggtggttggttttctgtccttgtgatagtttgccgagaatgatggtttccagcttcatctatgtccctgcaaaggacatgaattcatcttttttatggctgcatagtattccatggtgtatgtgtgtcacattttcttaatccagtctatcattgatggacatttgggttggttccaagtctttgctattgtgaatagtgccacaataatgttttttaaaagtgaaatcagtttcctgctctgccccttcccctagcaccttgctcctcatttgcataacaggtagaatgacattggccaactcccctcacagttagggtgaagtggattgactagtataccaccaaaattcacatctacctggaaaacttaagagtgattgaattattttctcaggactgccataacaaattaacacaaatttagtggtttacaacaacagaaatttattcttgcacagttctgggaactagacgtccaaaatcaaggtgtttatgggacaccttctctgaaggctgttgagaagaatccttccttgcctcctcctagcttctggtggtttctgacaattcttcatgttccatgccttgtagctgtctgactccaatttcttcctcctacttcacatggctttcttctccctatggcctcttccgatcttgtaaagacaccagtcattggatttgggacccactctaatccaggatgacctcatgttgactagttatatctgcaaagactgtattcccaaataaagtcacattctgaggttctgggttgatatgaattttggtggggacatttttttaacccagtacagtgaccttatttggaagctggatttttgcatatataattaattaaggatccagatgagctcatattggattaggatgccctaaatccaataactgatatcctaataagaagtggggagggcacagagagaaggccatgtgaagcaggaggaagagacctgagtgatgagaccagaagccaaggaatatcaagattgccaggagccaccagatgctgggaagaggcaaggaaggttcttccccagggtcgatggaaggagcatggtcccactaacccccttgattttggacttctggcctccagaactgtgagggaaaaaatttgttttaagccacctggtttgtgataatttgctgcaacaacattaggaaactaaccaggagaggggaaggtttttagctgaaaatagtctataacacttatagagttttcattgaacacgaacacacacacacacacacacacacacatacacacacaaaactaggaagaaacgcttctgttttaagacaaactccaaacatatggtcaatgctgattaaattaaatgagcatgagtcagaactacttgaattctattgaatctatgcctttagtcagctgtgtggaagaaaacatgtttgcatggactaggattaacctactagatatttcctttatttattcattgctgtatttgtttatttagtggagcggtgtttttaaaaaagaaggctctttacattgtttattcaggaaatctttgctaaagaaacaaccagctctcgacaaacaaacgattcttgaggaaattaagaaatgtaaacagagagatgcaaatgtgatgtgcaatttaaaggatttactcccagcagtgcttaggaatcaggacaggatgagggcccacccagctgagctcatcatcctgcctcagcctccattttccagaaagtctggtcacctcaggagcagtggagacccagaacttctaaaatggcttataaaggaaaccacccacaagcctaaagagaaaagaatgaacttagaaagtaagaaaaagtctccagctgcagtctcctcacagagctttgttctctgagtcctagctctgaaaagcacccaggtgaaatgaaaggccagggtcttggataataaaatatccccttccctaataaaaccaacttatttagcatcactatgtgttttttgtttttcttagagaacagtgttatatcgttagaagcacacaaagtaggacttaaaagaagttatttctggtactgtcagtaataaaatccctctgaatgatatccaatacagagctgtcttttgctgaattctctggtgcggaaaactgtaatgaactttcagtataaggctggaattggtagaaagtgctatgtgtctgtgttggttattctcagctaccctggatctgttctccacccttctctgtgcctgggggtgactgtggatgggccatcgctggctctctggccctctggcttcctgttgagtttctgttggaggcatcagcagatcagaaagtagaaagggaaggaagttagggtagatgaggcacttgtggaccataggaagctcacactggggctgacagtgacaggtgggatggcttgtctcataagcaatatcttgcctccagccctgcccgtcccactgtggcttcaccctctgccctgctgggtcaggccccccagtggtggcaacaaccccctgctgttgccagtctctgggggccttacaaggctttggattctgtccactctgcccagacgcctacagtaaagagcaccttcatcaatagccctaagttaaacccttgggcctgccttggtttccagccagagccatgaccaaaggtaataatgccaacatgtataagtcacttttaaaggtttctatgttatttacaaatcctaaccactcaaaagatgactttaccttacctgcctcctctattccacctttacctgttgaaattctgccttatccttcaagaatcatctttaacatatttttaactgcatatagtttctcaaacatttgggcctctataattttttttaatttgattattttggaccttactgcctggtgtagtggcatgtgcctgtagtccagctacttgggagactgaagcaagagaatcaggcttgagcccaggagttccagttcagcctggggacaacagagtgagaccctgtctcttataaaaacaaataaatacaggcttggcacagtggcttacgcctgtaatcccagcacttggggagggtgagacgggcggatcatgaggtcaggagattgagaccatcctggcgcacatggtgaaaccctgtctctactaaaaatacaaaaattagctgggcgtagtggcacatgcctgtaatcccagctactcgggaggctgaggcaggagaatcacttgaacccaggaagcagaggttgtggtgagctaagattaaaccattgcactccagcctgggcaacaagagtgaaacttcttctcaaaaaaaaaaaaaaaaaaaaaaagagagagagagaaagagagaaaggaaagaaagagaaaaaatagagaagaaagaaagagagagagaaagaaacaaagaaagaaagaaagagaaagagaaagaaagaggaaaagaaaagaaagaagacaaacacaaataaataatacaaaataataatgatattttggactttacttatatttccctcactttgctttattttcatttgtgttaaggtcatatcctccttctctggctaaagtctccttaagatcaatgacagaatggctctaatttctgtatctcctcccagcccagtaagtagttcagtcccagtatacatactcagtaaatgtctgctgttactgccagctacttgttttcaatgatttttccaccatcaaacccagaacatttccataaatatgcatatcaggttttatacattacatacatacatgatatattatatatctacatacacaccctaacctgaaacttttatctaatttttcttcttccatttggcgtatatatatgcacaacaatgaggtttttgccttcagtcaagtggtttctcaaacactttctacattcttacacttgggtgtctctgctaacccagaaagaattcagtgtcttccttgttctcttttcccttttatgagaccccataacgtcactcattagagctatagttagcctccgattggttaactgtcttttgctctccctggctacgataactgcggtgactagctgtgtctatgtctcagctttctcctgggcaggcactttatcttgcctgtgttgtcatttactacttacacaatcataagcaagttacctatcttatccaaaactcacatttcatccctcaactagaaaaacaagggaataacttagccattcaccaattcaattattcattaactacttattgaggactaggcactgtgccgggcacagggaagggagtgaatccaaagcagtccttccctcctgaaaggaacttgcagtccagtgggggatgtggatgaacagaaaagcagctacagtcacatgtgctatgggagacatgggcattagtgcagggcccctggggagcaaacaggaaggcccctaaactggtgggttgatgggtgatatggttggctctgtatccccatccaaatctcactttgaattgtaataattctgatgtgtcatgggagggacctggtgggaggtaattgaatcatggggacgggtctttcccatgctgttcttgtggtagtgaataagtcttatgagatctgatggttttataaatgggagttcccccacataagctttctttcctgctgccatgtaagacatgacttcgctcttcattcgccttccgccatgattgttaggcctccccagccatgtggaactgtgagtccattaaacctctttttctttataaattacccagttttgggtatgtctttatgagcagcatgagactagactaatacaataggaatgggctaggttagacttcccagaagaaggatggctaacccacactctcaattctaagctggggttcgatttaaaaaaacaaaaaaacataaaaacctcaatatttgtttgattttgagaatcattaaaataatgtcagtcacagttgcaacagcagagagatacttttcacaaccaaaattaatacaaatttgcttgaattctgctctatgtaaagagaaattatctgctttggtaagggttactatgaaacttaattcagcttcaagattaaattatcctctgctggagattcacatagagcagcaagatacaggaaaaaaatgaatttaaattataattgtacttaaaaattcaatagatcattgtgatcttacaatatttatttcatgcttaaactaccacattttttcctcacacagaggaacttttaccagcaactccaagctggatagcaaatgtggatagcaaataaggtttctagctcctcagtcctcttacttgactaataaagacaggaacactaatggaaacatttttatttttaataaatttaactattttaatgctataaatatccaacttacaaattttcaaaggttattacatatatgtcatatgcatttgaatgtgttacatactcaatttgtaagccacttaattggaatgtgacatatatcttcctatagaaatgagagttaatagtgcctacattctcaggctagccctcaaaagcctattaaacatctctttgaggaaacactgggcaatggtcaaattcagagctctggttctgatgatgtaaaacgaggttaggccctctgaggcaaagattggaaatgaggtggtagggacagagtcaagcaatgtctctgaggctctcgtgctatacaaaggaaagagctagggctttgaactcaaacagactagggtcatgtcagatttaccagttactagctctgcagtcatcaagaaattatgttctctttgccttcacatagttacctgcagaaggggaatggcttgggagcactgtgaggatgaagtaaaacagcatatgcaatgcacctccgtaaagcctgggaccgagcaggtgctcagtaaataatggctcccttccattcctccattggctttctgcacctgttacctatcttggcctatggaaaaaatgacctctgttgtagggttgaagaattaaataaagtatgtgtatgtctgtgtatatgcgtatgtgtgtggtatgtataaagccagtaagtagtaaatacatggcctagtgaataggaagaactcaataaacagtggtttgttttatttttctactagtagcatacttaacaacctgcttccttttccctggacacagcctgcaaaaattctggcacaccaattctgcagtgtgaatcattgtgtttatcctaacagacgcaaagctattgtttttagctggtaatatgttagcgggttcctattggttccagacctatctgggttaatctggaaaagggagagggaggcttctgtttccgtgagctgatcagcatggcctgaaaaaggacttggttgcagggatgagcataaagagaatgacttgttccccagtgggatcccatgcaccaggcccaagcccagtagggagaagagcagtactgaggctgtggtttcacaaggatatcctgggtatgagcaagcataggagtgaaacacttcctgtgtgtgcacaaaacacacatggctccagctcagtgacacccaagggaccacaccaggagtccatatctagccaaggaagcaatgttcctaaagaggataccagccatggtggcaacaatgaaggaggcaccagtacctggtgtttccaagtgccttggacatcagggaaaggtgggttcaaagaggaaaactatgatttgtgatcacatatgagacactcctgggacttcccaaacaaatgaggaaaggctttgttggagggcagggatgtgatgctgagacctcagtgggatgtaagccagggaaatgtgaattcccttgatgtggttcatgttgcatccataggctggtgaggtctgaaggagggtacatatgggagggtacctccaacaaataagtacagcaaccctaagtcaagcaaatgcagtcattgggcagagctcagtttcaatggcttgatagcagaacagaataaatggttacattatagctgcataataatatagtttccaaatattatgctatcaatattaataagcatgactcttttttaaacaaacacatgctgaacccttattgttcattgccacacagagaacataatgatagcttactagcacttgtcaggatcttgggtggaagacactgcataaatatcaatatagttagttgaagtgttattgttttccattctgcactggcattttatatggaacataatgaagtttttatctctaatcctcatatcaaacgatcggcacctacttggggtattgtctagaataattatattctgattagtttacagtagttgctctaaaaacatttcttatggatgcttttcatagtcaataattacttttgtgatgtctttcttccaatacatcccaacatgtactgttaagatttaagtggtttcacactaagataatataaaccaatgttgtgaatatatctcagctttctctcagagaatagctgtgactttcctccctatttgatcataacgctaccattcctgatcattcagtatgaatgtttagctcaatagataattgctgttttctggctaacatttgagtaggttggcttaaagatgtttggaacaaagcattctgggataagcaaaggatcaaagtccaagcttgactggaataaggagggcagacagggagcctagaagggtatggctgcagttacagggaattgtaagttagaagggaacaagaaagagaggcacagagatggagggcatatcacaagtctcctaagtgatcaattagaaagcaagcggatggatgaatagcctctataagtctaatttttcttattgcaaaatataaaagttatagatataaaaggcttgggtgtggaaaattaaggaaagaaattttgaactggggagtctcataaaatcttgcagaagcacagaaaacattagtaaaaaacaaatagcttgaattccaacataaacaaaagattaaatacagtaaaaaatgaatgaaacaaaatcagaaggcctaagctctgctaaaacttatcctcactttgtgatattgacacgtcttttaatctttctcagtttcttcctcatcagtaaaaagaaaatgatgaactaaagtgatcccttaacaacaacaaaagtttttataactggcgatatgcaatagccctgggttttccctttttcggcagtatgtgctttaaaaagcaaacaacccatatgtcttcccaatttccctgtgtagaagatagaataaataacctccaatgaagggcaactagaaagtggaaattccatgttgctactgaatcagtgttggagtctaatatataagtcccattttcctgtatttcctgagagtcaccaaagcagtagcaagtgcaccaagcccaaggagagctgcatacagaggcaaagcaacaatcacaatgtgtggtagaaagggtcaccaattccctgatatgctatatctaattttattttatggtcttgagtaagcccccaaatttccttatgtcttagttttctcacctggatgtgtaattcatattctcaaaactacctttttgtaaaaagataccaaaacttttttaaatactaaaaattgaggcatttcaaaataaaaagtaccaattttaagaggtcatgtgcttcatgggaatagcattgaacttggaataagaaataaaactgggtttaaaagtaggtttgctatctatgagccggatgaccctatgacctctcagttttcttatttgataagtgcaagattttaaatatgccctgcccaccccaagattgccaaatttaagtgagattatagaaggcatggctttccttgaactatatatagcaggctatgcaaagtgagttcttcgtagcctcaccataatcataattgcaaggaacctaattactttccactctccctcagtcattaagtttcacaggcccaaaaactgtgaatcaggaaccttcacaagttccccggaaggtgaaaaaaatatctgcaaaagaagtgaatccagcccaagtttcataaccttaggcaaatccaggaagagtgacggcacaattacaaagagtaactgcatagaatatctgttcagttaccactcttacctggcttgtaaaacaacagcagaaggtgttaacaaatgcttgtttaccaataagtccatactgcagcaaaattcctggccctactgaaaatgtagtaaaagcctttctacaacaacttgggtccttaaccatggaacaaaaaaaacccatgtggtcaggactgaccatgataatactaattagaaatgttttcagtcttgtataccaaacaggtctgtcctggagacaagcatctttgctagtttcataaaaatgtttgtttccagatgctattttggacatttcttctcttccatatttttattcagaaaggcagttttttgtttcccctgagtacttcctgtattccctttaactataggtgtagctactgcccaaagggttcctaaaattacagtgagaagagaagaggaagggagagagccactgcagcccctcttggtcagaggtctattttgtgaactgcttgatggacaagagagtccattacgcaatttttgttttgaagacccaaaacacaaacttgcacgcctacctgcaatgattcatcctccaccaaacctgctatgcccagaagccctgttttacagcagagaatatttcttcaacatttttccaactctacatctaaatccatttaacactaaaccatttttaaaattatgtttaaaattacaacataattatcatattatgttcctatttttgcatcaagttttttattgttgtgctttgtttgttttagtctcattgcctctagattttggctttggcaaaatttattgaattgctagttcctcgtgggcaagaatagattttctactcaactttgaaattccccaaagaacctagaagagttttacagctacacagagtgaatgctgctgagagctgacgggccaactggtctcctagcaaagggcaccaaatcttaggtccaaaacaaacaaaaagcatcaattctgaacttttatcaccattcaggccaaaaaaatgcctttgtatttgttgatggtttctggctggcccacattccctccatctacttgaagttcaggctgcctatttagagagtagaacgacccttggcaatgggtgcaggagccaaaaagcataggtttcttgggcagcctgcattactccgagagggacatctgtttagcaggaagcttccactctgtgccagccttcagaaccatctgtctctttacgcttccggacacacacacacacacacacacacacacacacacacacacttccatgcattcactgggtgtaaaaaccaagttgagagagagagaagctggcaacataggtctcccttgcaacagagcttggaggggcacacgaggaagaaacatcgtgattactctatggactttgcatccctggatggagcaaagttttcccaccccgcccatacccctccagcccagccccaagctagaacagtaacttacaggcctgaaagacttaataaagatcacccacaatgatcttcaaaactaaatttcaaggcagcagctctgatataaagtctttacacactcagaaaaatgcctctcttaaaactgctttcataagaggaaactagagaggcaaaagggaaagtgtcttttggatgggtgacctattaattacaaggattggttggtctgatgaggcgattatagaataaagtcagtgagactaaggtcacacaagacagacacatggaagccatgggctgggagcctcaaggggcttgtcctactaatgtctgtgtgtgtgcacatgtaagtgtctgtacacacctgtgaatggaaggacaggacatagaaactattgcttaaatggatccaacatctctctgctgctgcacattgtaaaactgacatccaacatgaaaaatctgtttaactgtttgaaaaatgttatagtgattttataatttataccttattttaagaaatatttgaaaactcaagaagtagtttaaaaaagagaaaagacagcaataagaaattctaaaaagaaagagggaggtgatagtaccagatatcagagatgagaattactgcaattgagcactcaatctggctctgcagtcaagcaaaaagagaataatgagaagtgacatagtcctcaccatcaaagaaaaaggaacattatcagtgcacagaaagataggtctctctggactgaattttaggaaaaatttattgcatagaaatatacagatagactaataggtgggcaaatattgacaaaacattaaataacaacaaacagtgcttcatgaagcaagttagtacagaagttttggatatgggctttttagtagacaggactgggttcagattaggaactacaacattggacaaattacttaagcacctcaagcttttaatttcttacctctaaaatggaggtgatggtacacacctctcaaggttatcatgaggattaaatgagatggcacaggtaaaggatcttacacagtatctggctagtagatgcttaagaaatgttggttccactcccatccctcacccccactcacaatggttggattcaggtctttttgtggacagaacaaaaatcagagccctaatgcccttgaagcatttccacagaaagcgtagatactacaatggtctgaataaattgccagttagaggcaacaatagagcttggagaacctggggggatggtagctggcctgtctcttatactgacaatggtgtcaacacaatgagggagttgctgaaggggtgtcaagactcagctatctggtaagtacctaaaaggtagatgctgtctgttgctcatcaaagataacttgatatttgagacacccattgtcaagcagtgggattaccattatttgagtgtttcacccagatagtggaccatcccacctacacagagagggttggctgaaggcatgattgtagataaagccatttctttgtctcaaagaaaacgtacatgtgaccctctcaaatgcttagacaacgatgaattgggattccaaaactctgcatcatagagcacgggagcataatttgaacttggaatatatgagaataaatgtcccttactttaaaaactaccaaaaagtaaaatgcctctatgtggctgttagaaacatcttatttttattttattttattttatttttatttatttatttatttatttttttgagacggagtctcactctgttgcccaggctggaatgcagtggcgcaatcttggctcactgcaatctctgcctcctgtgttcacaccattctcctgtctcagcctcccgagtagctgggactacaggtgcctgccactatgcccagctaattttttgtatttttagtagagacagggtttcaccatgttagccaggatggtctcgatctcctgacctcgtgattctcccgccttggcctcccaaagtgctgggattacaagtgtgagccaccacacccagccagaaacgtcttatttttaatagcattgtcaccagatggaaaaatgaatgcatgcattattggatgcattagtaaatacataccaatcttttaccatatgtatgactctatggtaggcctctgtgcatttattatgtcaattaattcctgcaaaggaaaccaaaggtaatataccgaatgatcattgtcaactatacttgtacacatctaggtacaactataagtttatattagtgatccataaaagaactgttaaactaaataatccttcataatcaggtatatggtctataacacagttaaagggacagaagcagaaaatgaccattagaagaaaaattatggtaatttagtcatcatatacatcatgatttgaacataactaacaatttcattaacacaaaaattctaatactaaaagttctttagctaaataattaaccaaaatttatttccacagccaaatcccagcccctggcaagttttataatatctgcacattttctcaaatgatgaaagcaaatcaacagcattaagccaaatcaacagtttaattacagctactctctatgcaaaatccactgcaaccaagcaggtcacagctgaggttgctgtgtcacctcctaaagactgggctgccagaaaaacctcagatcatttgcaagtactgaaacatgaaggaaatttggggctcagtaacagaagaactgatatacttggaacattttcagaaactctttcctatgccgacccttactcatcttcctgaagacacaaccactcattcattcagtacttctggcttgctcactgtgtaccgggcactgtgctaggcatgtggggaggggacagttgggggcagagtcatatcagacacaggcacagcccctctagaactcacagacattctcagacctaagcataaattcagggcacagtcctatggaagtaaagggcttagaatcaaaatgcagatacattaatatgcaaatgtgcttttcataagaacatatcacaggttgcacacgctcaaattacacttgggaaaatgatccaacataactgacacacactattacaactccgttcaaacacctatcccagggtcccacagccagggtaagggcaggggaactgtgcaaaaccatgctcagtagagcccaacagagcctggaaaaagcaccaggaatctgcaagacccagctctctgaccctgaagccacttcacactcagcttcaagataagcctcatatgacattgataaattattaaatctgttgattgcatggcagatcaggagccatagagtaaaaggcactctacatggatataaaaacacctttaggcaagagacagatgaactcaaggtgagatatcaacattaacacaccacatgtttttacactttaccatatacaatttcaaaacatttacaatgagacatgccttaaagttttggtaattaaggaaccctcacacacagagcagtcatgagagagattaatcattcagcaattatttactgagttcaacagctgagcatggctgttgctgggggagaaaaggagaccccaggagtggtgggaagaacaggcacaagtgctcctaatacagatttccatgcagaggcagggagttagggggagagttgagagaatcagattacaaaaacagttctgccactacctatggcacaaatttggcaagctgctcagcccctctgagctcccatgttctcatctgtgaaaagggagatacccacacctacctcacggtcactgtgaggattaaatgacagcagttatggtgacgtccggcagtataactagactgtactaatgtaaactgggcttcaccgctcaggaaaggggggagcctttctgtgcctcagatttcctcatctgtaaaatggtgataacagtctcttaaaaggtggggtaaggattaaatgagtaaattcatgcaacgagctcagaatggttggtggcatctggcgcatagtgagaactcaagacaagtaggctcctatcactgctatattcctgatgctataagagggaaacaagatggttgggggaaggtttggaaagaagaacaggatttcaccaggaaaggctggtggggtagaaggcataggcgtggagcaaagggagaaatcacagaagaggcaggagagtggtatgggagacctgagcccatgatggcagccacacccctcattatctgtttctgcttcactcagttcctgagctactcacaaacatcgcagaaccctctcaccagctcaaacacagccagaggagtggaaatcggagctttcatcatggggcaggtgcccaagatgagccctggacacgctcatgtcccatgggactcttcatatccccagccttgcccattaccacctccagcctccattctctgccggggatgtctggtaccctggaaccagagcccttttctgatgccatttagttcaagctccaatacagcccccacaccatttcatatggaatatatttacttttttgaatatatttttgcttttacagaatattttcacaggacataattttttaaactcatccctgaaaaggactactatttgctatcaaaaataaaaaggtcgagattgatctctccacgtttgtatacatgtgcctgtgtgtgtatacgtgtgtgtgtgtgtgtgtgtgtgtatgtatggggagggtggagacagcaaaaacaccaagtgaaaaaacaaggcatagaattgtacataatacaatcacactctgtaaaagaatggataggcatatatgccagcatgtgaataagcattcttaaagaatacagaagaaaatgtttatggtgatttttctttggagaataggactgagaaatctacagtggaaaaaataccaacttttcacttactgcacttttgtatgccttaagtttttactatgcatgtatactattttaaaagctgttttttaagtgagttttaaaaataaacaaaagatcccatatcaggagttgattctgatgcctaaataaaagtacgtatttctgatacatagcaagctactgataagtggcagctgcctatggctcctgttattatttgtattattatcatgtattacggttatttatgtgcatgagatcttccctgtgaggctgtgagctccatgagcacaactcccatcagggctggccctggagtaacagcgtacacaccagctcccataaaggagttcatcactgcagacttactaaaccaacacccacaggaatgaatgacctgaccagcgaccccatcattgagggagtaaatgcatccttatctccattttgcagatgacgaaaaaggtgtcatgtaaaaaagtaaaaaaaaaattaggggaggagctcaatcaaaatcaaaatcccaaggctccaaggcagaacttcccatcagcaagcattaaaacacaataggtctggctgggcacacctgtaatcccagcactttgggaggccaaggcaggtggattgcttgaggtcaggagtttgagaccagtctggccaacacagcaaaaccccacctctactaaaatacaaaaattagctgagcgttgtggcaggttcctgtaatcccagctactcaggaagctgaggcaggagaatcacttgaacccaggaggtggaggttgcagtgagctgagatcgtgccactacactccagcctgggtgacagagcaagactctgtctcaaaacaacaaaaaaccgcaatagatctgacttagtgctgaagactaagagagaccccagtaaaaactgcagtgggaactactaagatgtgagctttctaaaacaggtcaacaacactatttcattgtacacatatgtatgtaagtttctcccctgacactaatgaagtcaccctagaggcacacacacatgttcatggattacaaacatgaagcgagtaaaaaaaagaaacacattcataaatatctacagggagcacacgcaggagagtcctgctacccagccaaagcaggaggcaccatggagctggcgggctgatggctgacaagatatcacctagttgaaggtagtctcctccacatgaccttgggcaagttattgatcctctttgagcctcagtttcctcatctgtgaaaatggggtgatccaggtacctgtgatccacagagtccacttcggggattaaatgagagtataggtgaaaaagtaattagaacagcgcctgacataaaaagcacttaacaaatgttagttgtgtggtttttgtttccagtattattaaacaaaaaccatagccagagaataaacacaacacacacacaccacccccatcccaataagaattatgtgccacctcttatgaaattttgcacagatttctatcatactatttataatatatattaaaatcactggtgtacagatctgtccctcttcctttgaactgggtatttcctgaaaccaaaacaggttcttagtacctggaaagtgctcatatgtgtttgtttaaaatgtcaacatggaatgaaaaagtttaaatcatttggactaacagagtgataactacaagcaatattctgaaaattgaaattcagtttctttttcttgatatccttttagatagttcaccacaaaagtagtatctataaataaagctaacttatgctctgaggtctactaatatactaaaccatcagcactatagcttctcttgatggtcattcaatttcatttctgcaaagtttaagcctgcacatttgagtaaatgaattcaattcatcaaggagcccagcctacgacagagctactcagagatccaatcaacagcttctctctggaataaggaaatgtagactccctttaatgagttcacttgctggaatcagttctttttctcacagattagggcaatggagcacccataaaggaattgacaagggaaactctagctcatttccaggaactatgatagaattctgtgagtgaagtaactactacttcaatatctctgcgaatagatggtgagattgtgagctccaagagtgcattaatcacaaaccttattctgtttctgtatagtgcaatcacatttgtcctcagatgcaactgtgtggttcaagataaaacactgtatagtacaatgcttattgtctttaaatataagttccatccatcatggaagccagactcattcctcacctaaagccagtaatatgtcttttggataaagtacaaacttagggagttaattacttcattacattgcatggcccatccattataacaacatagctatgactggattcagctatggtagtcattcaatccaacctcatttacaaaacacagtttgtacctactgcctctacagagactgtagaaaaatggttttagaagccattcattcatgttctaggaactgtgtaatgagtgcctaccatatgtcacacactgtttcagatgctgtggctactgaaggaaagaagatagaaaaacatttttactcttatggggtttaatactcatatggagttagtgagagtagacaaaaaacaaataaacaactaatttcagataacaatgttttattaagaagagtgaggaagacctttctaacaaggtgaaatgtgaatgatgagaaaggggcatctgtgaagacttcccactgtatggaatgtaacgtggctgctctgtacgtgttcatgtggagctctgtggaagccatattgatcagtttgccacaaagccacagccaagacaggtaatgaggactcgaactcagttcctggcacccaaatccctgcatcccaagatcactagaaagatcttgtcagacttttgggtgcagtttagatacctggggaaaacctctgttgttttactgcctatgaacacaaaatggcccccaaaaaacctgaaaaaaaaaccaatataacaaattagactatttggacctctcgtgatcttattaaaaataatatcacttctctaaattttacctgaggaggagtgagctacaaaggcctggaaaaggtaaccaaggggtccatagatggagtggactcttactgcatacaggccacctggcgtccactcctcctttcctctggcagtagaatactcttcaggaactgttaagggataagcatctgtcccaagctccgctagtccaagtgagtcctgggggttgtgcaagagttactagagactttttttcctgctggatttgaacctggggtcttgtgaggcctagctgcaacagataagcctggcagagagcagagcctctttagagcagggatgtaggaagatggagtaagacacctggtctctatgccttcatctgagctcccagatcaacccaaacctaaatccaatatgctctcagattctccaattcctttgttaataaattgtgcttttatttcttataataatttaagatggattttctatcacataccacagaaatagttcaagtacacatattaggtacattttccttaatactaaattattgagaacagaatacactttttaacatatttgaagagccacttgtgaagaaatctagattgttagagaaaactgaggtctcttctgatttccatgaggtaatttatttgatacatattatgtgttcatattggtgctagctcctatggaggatgaaatggataaaacattgcctccttggactcaaagtgcatatcctacaacctagcaccgtcaccaatgttttactgatccatagcactttattggttatagagcacctttaaaacattgaacttcaggtccgtagaattagactgaattgatcaaaacccctggccatgaactctcatcattactccatgaatggcccctttttatcaagtgcccactcacatcatctcatttcacattcacaactggataaaaatattgagattctggccgggtgcggtggttcatgccagtaatcccagcattttgggaggccgaggcaggcagatcatgatgtcaggagatcgagaccatcctggctaacacggtgaaatcctgtctctactaaaaatacaaaaaattagctgggtgttgtggtgggtgcctgtagtcccagctactcaggaggctgaggcaggagaatggtgtgaacccaggaggcggagcttgcagtgagccgagatcgcaccactgcactccagcctgggcgacagagcgagactccatttcaaaaaaaaaaaaaaaaaaaaaaaaaagaattgtgatctgagaaatcacacaaacctcaccagatccagaattttaactgtgtaaaagaaggggtgtatgagtgtatattagtataaaagaaggggttcctccaatcacactagaaggaaccacacccaaatggctggtgtgtttgaagagtagaactagaatagacacttcaacactaagcatacatccacagtcctgggggttgtttctggtctactgctaatttggcatttttggatgtgcgcattttaaacaggttttgtacagattcagaatctgcatttgctaccttttttttctgcacgtactgttacttacagacacacttacatgttcaagccagacttaaatcaaatttttccagtactataaaagatatcttaaagtattcatgaaaaatatttttttcaagagtcacttctttaaaatgtcattattgcctttctttaggggccttttctttttgcagatcaataataagtctattgttcctttcttggttccattagttctgactgaaaagtcaaacaggtaagaaaagacacaggagttttatttgtttaatctggaaataaaatcacctaaaataaataccgttgaaattttttcaggtaattgatttctacttctttgcctgaaacagctctcctcttgtttttttggcatgttaatttggtggagtagtttcactttataggaacaatgctctccaaaagaattaatgttctctggcattggctgatcaatttgaaaaaaaattgtcttatttatcttaaaatagaaaatcctcccccacactatacaatacaggggtagaggatataagatgtctttttacaggaacgaaatgtttctacagtggtgaatgttcacaggggaaataagccatggtttgggtgtcagatccttcagacaccaccagtagaactgggtcagaggccctgtgtccaaggagggctccattgccaggcccatcacttacagctggtactagcagtacaagatgcagtgatgccatttcccttagaaggataagagctcaatgttggaatgtttttcttctactcataggcacagcaggaaacaaaaccgtgatgaaattccataaacaggcaagctgggtatggaagaaacgtggttgatgctggcaaagagctgcacttatggccaacaaaggtgaaaaacagagagaaattgtggcccatgaagccaccaaagacagtaaaaaagaagagtgccatgatgcaaagtgctccatctatggagtcacccaaggcaggtctaaatcttggctctgccaccctccagctacagtgctcttaagcaagacaaaagtaccaaaagcccagcatctggcatatcaatacttcagtggtagaggactccctacctcccccgttacattcactttctgtgatgctctttggtgtaatcatagtcctatgtcttccaagatttatcttaatttttatgacatttaagtacatgcaccatgactaaataagtgagtatgaaatttggaattccatcagcaacctattttttatcaaattagtttaactaactctattaggacccaaatagatcttaaagacaaatttatctggctgtgtcagagtccattgcttgccattttctgttcagtaccactgtctgtacataggccatgtgtcctaaaaaataagctggaccctcaaaaatgtcgcactaactcttttcccccaaagagccacctcagcacgtctaccacactggcctcctagctctactttttttctagcaaagcttcagcccactgacttttaagatattgtaaatcagatcagttttacaatcctgctcttgtggctgggatcaggaatatgagcaaaggaggccacgagaaggaatcacatgtgtaaaaggtggcttgaattattattttttaaaatatcatggaggcttattatgagacaaatcatcaagatagctgacaatagatataatgttcagccacttcaggtctttgccttttctgtccacactatatttatttgcacacaaataccaccaatgccactaccactgtcactagtcccaattagccttattgttctccatagcattgagcacaactagtcattccacgtattttacctttttattttctttatcttatgcctcattctaccagcatggaaactcaaataaatcattgatttgtttatttttcatttgtgcaccctcaatacctaaaacagtacgtggcacagggcagggattcaaaaagtgtttgttgactgaatggtcagatctattattttttgagacattctctctagaaagactatcatggggagtagaagctaatataataggaattttagaacaaagcatttcagagaacttttaagataagtggtaaaaatgtttatctacaaacaaaatatccagatatcaattcaagcatggtttttggtattgttttccaccattccttcaatgaatacttacagcaaaaactcctatacagctgtcttctataaccctgtggctattcagacccaatctacccatgagctacatgccagatataaaagcagctatggatgatctagtggcatttgcatcaagccccatgccactacctcactggcttagcttccaaaccactggtattttattccatgtccacctagtttctgcctcttgactgcctcccattttcatcacagcttgcatcctctgaatttgttgacttgatgctacttctaggcttgaccttcactgttcatcaaggtttctaggttaggcacgttccattaaggatcctttccacacatgtcttccttgggtagacaaaggaactcgaggtccagtctctgatgaactacactcgagtacaagtgcacctgccaggtccaccttggtccctactactgggttcagggatttaaaccacaacactatttcataggtcaccaacttgaagacacatgaaaatctggttcaaattaaccatgaactgaaggacacctccagtcaatatgtcacacataaaaatcctataggctagtgatttccagcctgggctgcaagaacatctggggaacctcagcgattattgcaaaggagtttgtgaattcatacgcacatctgcactgttagtgaactgaaaaaaaaagacatgactatataacaacatatgctttgccatgtttcagcatcaaatagatgctaccatgttttatcaaatacaagcatattgaaatgtattgattaagttacaaaagtttgtttaccttacgtgtaaatcaatagatattaaaggtccaaatgaagggttcaaaaatattttgatatcataagacaaaaaaaaggctatagattcctccaagttagataatgatgactagactcttaaccaagatacagaataatgcaagattatgggggaaaatatggcagattctgcccaaaatgaagaatcagtgactagatttatcctcccataagaaacaatctaaaaacatacaaatacataaaacaatggctttcaaaacactggacatcaggccacaaggaacaggcaatgaaggtttgcattggagatatgcgaaacaaagacagggagccctgtggttgccatagcttactgccttgggaaggtttccagggctcagtccaacacaagtaacccaggtggagcccagtgaactctctgagtcaggagatggagttggggttccaggaagaccaaggaagttagaattcacaggacagcataccagagaaaaaaagagctacataaagagagctaaatagagagatctgcaaagaatcccacttgagtatccagctaagtaaggatgaacgcatgcatatgagaaagacatggctgcttttgtactacaacatctgagtgagtagttataatggagaccctgtggtcctcaagccaaaaatttactaccttgtacttttcagagaaaaggtgccaacctgatcaacatcatacttaaaggtaaaagactgaatgctttccttataagatcagcaatgagacaaggatgtctcctcttactgctaatattcaacattattatgaaggttgcatccagtgcattaaggcaatgaaaagaaagaaaacgtatgcagactggaaaagaagaagtaaaactgtctttatttacaaacaacatgacattttatgtagaaaacctcatggaatctgccaaaaagctattagaactgatcaatcagtttaataagcctttaggatatgagatcattatataaaactcaactatatttctggatactataaatgaacaatcagaagttgaaatttaaaaataccatctatagtcatataaaaaatctgaaatgctaataaatctaacaagagattgtcaagacctgtataatgaaaactacaaaacatcgctgaaactaaacaacatctaaaataatgttgagatacacctatgtttataggtcagaagacgtgatattgttaagatattatctcctcaaatctatctatgattcagtacaatccagctataacaactgacaaactgattctaaaattcatatggaaatgccaaaggcctaaaatagccaaatcaatttttaaaaagaacaaaggggaactaaaacaatctgatatgaagtcttattataaagctaaagtaaagaaggcagattggtattagcatcaagatagacaaataggtcaatggagcagaatagagggtcttgaaacatacacacatgaatagaaaactaatttttaacagaggtaaaatagcaattcaatggagaaagataatcttttcaacaaatgaggctgaaactaccggatttccatgtgtaaatttccatattgagtttcaaaccatacttgccaccacataaaaaaatcaactcaaaatgaatcatagacctaaatggaaatcctaaaactataaaagttccaaaagaaaatgtaggagaaaatctctgtgacactacattagtgtgcaatgtctgccatagaaaagtatcacaaaccaggtcactataaaatcagaaatttattgtcttacaattatggaggctagaagtccaaaatcaaggtgtcagcaaggttagttccttctgagggcagtgaaggaaggacgtgttccaggcctctctccttggcttggagatggctctcttttccctgggtcttcacatcagtcttccctctgcacttgtgtctaaattcctcctttttataaggacaccagtcatattggattagagcccatcataatgacttcattttaatttggttacctctgtaaagactccatcttcaaataaggttacattctgcagaacaaggggttaggatgccaacatcttttttaggtggacacaattaacccataacagacatcaaaagcacaatccatacaaaaaaagaaactaataagctggactttattaaaattaagaatgttatactcttcaaaagacagggttaagaaaataagaaacaagccacagaccacaagaaaatattttcaaatcacaaatctgataaaggacttgtatctgaaatatacaaagacttaaaattcagttttaaataaattaacaattttttttttttttgagaagaagtctcgctctgttgcccaggctggagtgcagtggtgcaatctcagttcactgcaagttccacctcccgggttcacgccattctcctgcctcagcctcccaagtagctgggactacaggtgcccaccactatgcctggctaattttttgtatttttagtagagacagggttttgccgtgttagccaggatggtctcgatctcctgacctcgtgatccacccacctcagcctcccaaagtgctgggattacaggcatgagccaccacacccagccaaattaacaaattttaaatgagcaaaggatttaaacagatatttgaccaaagaagataaaaaggtaataagtaagcacatggaaataccctcaacatcattagatgttgcagaaatacaattattaagtcacaatgagaaacttttctctattagaatggctaaaattaaaaaggctgattgtgccaagtgttgacaaggatatggagcgactagaactctcatatcctgctgatgggaatgtaaaatggtacaactttggaaaaaagtttgacagtttcttaaaccattaaacatgcagctactatatgatgtagccattccacttttaggtatctcttctagagaagagaaagcctatatccatacaaaatcttgcatatgaatgttcttagcaactatattcataacagccccaaactgaaaacaacccaaatgccagccaacagtgaataaattagaatattgtgatatataagccatataatgaactagtattccacaatataaggaatgaaccattgatatatgcaacaacatggatgactgtcaaagtagtcaaactaagtgaaagaagtaagctgcaaaagagcacactatatgaatgttaatttcacataactataaagaaatacctgaggctaggtaattcctaaagaaaagaggtttagctggctcatggttctgcaggctgtacaggaagcatgacaccaacactggcttggcctctagtgagggcctctagtgaggaagtttacaatcatggcagaaggtgaaggaagaagtcattgtatcacgtggtggcaagagtgggagccagagtcaggggtggagataccagactgttttaaacaacccaatcatatgtgaactcactgagtgagaactcactcatcaccaagtggatgtaggaactaggccattcatgagggatccaccctcatgacccaaccacctcccaccaggccccacctccaacactagggattacatttcaacatgagatttggaagggacaaacatccaaacccatatcagaatctgtgtatgtaaaattctagaaaatgcaaaataattgacagtgctggaaagcagataattcgttgcctggggataggcatatgggggagagggaggcattaaaaagggtcatgaggaaaattttggaagtgatggatatgatctttatcctgaatatagtgattgctttggtgtatgcatatgtcaaaacttattatacactttaaatatgtgctatttattgtatatgtaatcaataaagctgattttaaaatatgcattccacagtcaaatgacctactatttcaagtcctggctctacctctaactttgttatcttaagcaagttatctttgagcctctcattttccagctgtaaaatgatcattcataacatacatttcacaggattattgtggatatcaactgataactaattcaatccctgaaaataaaagataatcaactgtagctattaatcataacaacaataaagtcccttgttcttagtttctaatgtcctgtaaaagcaaatttgaaagccaagatgtacaactcatatttttagaacctgaaaagctgagtcttccccactttctcattcagtgtttcagatagtgttaatatacacgagctctgataaggtaaagagtgcactggaagaaactcaaaagtaagttttttaattatctaaaatcaaattttcaaatatgagtcatgatctcccctactagaaacacaaacagtttagacaataatgaagtaccagcaaaataacactccttatgcacgtgtgtttgaaatgcttgttccctggtgccataaagaaatagtacttgaacataaattttctcagcaaggccatttttactttctgcagaaaggtacacttgccagcagttttgccacaagaatacactgaagaaaggagacagggttatttataacttgacacatccaccctactgctgtgtctggtttccattggctggaatgggacctcacattctgtatttgtcctgattggctagcaacttagaactttttaaaagaggcaaaggcagaggagaataaaggaaggacgaagtaacttgtggaatgctgagaaaggtaaaaacatctccaaataaggaaaggaacaggctatgacctaatgcttgcttggactggtataagcacgccagggcaaatattttggctaaattgtgggagctaaggacacaaagtacattgatttatttattgtggctagcagatacctaagaatgttagcacaggtctttgaatacattttgcttctaagagaagttattatttattcttaattagatgggaggaaagtctctttgaagaggaacctctactttactttttacatgtgggccttcctcagctgcagttggtaaaactgcatttccagttttaaaaaatacacacacctctcaaaagaatttcaacttaaagctcttttacatatgtgctgcttagcttagaccctcaagaaagaagacaaagaaagccctaatgagttatccctgtcccatagaccacgtgggtggccctgtggggttatgcaaagagactggtcgggatagcaccttcacaatatgtagctgaaagaccagacccagaaaaaagtgcaatgcactgcaataattggtaaacaggcaagacacacaagtattttcctgagactctggaaaacgaaataaggaaaactcacatgccaaaggtattaaatgtcaagtcagtaagaagatagtctgaaaacatttaaaagctataacgtcaaaaaaaaaaattctggtacaatgtgattcaaaagatcaccctatcacagcagtagtttctgaaaaagtaacattgttttaacgcccacaaatctagtttgtgtagaagcatacactctcaagaacttttatttactgtgtcttgaagaaatatatgtctttttttttatttattttaagttctgggatacatgtgcagaacatgcaggtttgttacacaggtatacatgtgccatggtggtttgccgcacctatcaacctgtcatctaggttttcagccccgcatgcattaggggctctccctccccttgccctccaccttccgacaggccccagtatgtgttgttcccctccctgtgtccatgtgttctcattgttcaactcccacttatgagtgagaacatgcagtgtttggttttctgttcctgtgtcagttggctgagaatgatggcttccagtttcatccatgtctttttaacgctaattggataatgtgtgatttttctaaccaatggtgctacaaaagtccctatgatctcatacacattaagtcatttgtatgtgatatggttaggctttgtgcccccacccaaatctcatcttgatttataatcccattatccccataatcttcacgtgtcaagggagagaccaggtggaggtaattgaatcatgggggcagtttcccccatgctgttctcatgttctcagttctcacaagatctgatggtttcacaaagggctcttcccactttgtttggcacttctccttcctgctgccctgccttcctgccttgccctccttcctgccttacttccctgtcaccttccaccatgattgtaagtttcctgaagcctctccagtcatgctgaactgtcagtcaattaaacctcttccctttataaattacccagtctcaggaagttctttacagcagtatgaaaatggactaatatatcatgtattcatgctaggagcaaattcaaatgagtttaaaaaaaaaaaaccacagggaggaaaatattgctgaaaaccatacaactgggaggagacactaattctccaccccaggtggcctcactactgacattgttaacgccaaatggttaagctgatgctttatttccctgtcagttaagggactacaagtaatcaatgtttaagataaaacatgcagcggaaataaaaaggacaatttatatgattcctcatatttctgcctgccccccaccccacccaccaccaacgtctagctcatggaagacaagagctagaaacaattttttgacctttgattttcaaacacaaagatgccataaagaaaaagatgtatattttttgctgataaattttgccacttggaaatttaaatcttctatacatcaaaaaattcccaaaaattttaaagaaaaatgacaaactagaggaaaacaccaaaaaaaagatacatggttaatattttagtatacaaggagctttttcatggaaatatgggtaaaaatatgaataggtaattcacacaagaaagattataataatcattgatacatgttcaatctcactgagaatcaatgagattcacactaaagtgataagaggcaggactagactccagaggcagggctcagacactggaccaaattgaggactagctaaaatagggacaaggcggaaacggctttccataagacacccatcagtatgccatgtcagtttactattgttatggcaacacccagaagttaccaccctttctctaggaatttctgcagactgctccttaatttgtatatagttaaaggtgggaataaatatgactacagaactgtcctgagctgctacttctcagcatactccctatggggtagccctgctctgcaggagaagtcacggagccataacactgctggacctataacactgccagacctataacactgccgctttaataaagctgttttctttattagagaaggaaagaattcaaaggctcacccttgaattttttccttggcaaagccaagaaccttcccagctaagccccagtgggagcttgcctaccctgaatcagtatcagagtaacctatcaattataaaacattaattgtaaataagtagaaacttcctagagaacaatttttcaaaatgcattaaaaactttaaatgtttttccatactctttacatttcttctagaggaattttttcttatcttaaagaaaacaatggaaagaatataaatagaagtatgtgcaaagatacatacatcagaacattgtttataaatgaaaaactcagaagcaacctgactgcccaataacagtggaatggttaaatcagtaatggtgcagacatgaggtagaatattatgtagccattaagaataatgctttagatatagaaggaaggaaagttagtaatgatacatcaataaagtgaataaaatcaagaatgtatatgtagtctaatcccattattataacattttttgtacagaacaaagtttggaaagctatacatgaaaattttgacaatacttctctggataacagaatttgggctgttttaaaattttcctcctcctataaacaagacacagtcaggcacagcatgatgtctaaaaacagagattctatagtcaggttgcctgagttcgaagcctgcgtccaacatttactacctgtatgacctttgccaagttaatctttccatgcctcttcatccttaagagaaaaatgaggataatagcagtacttatttcatagttactgggaatgctaaatggagatcttctagaatggtgcctaacacctaactgagactcaataaagctaatcattatttgttaacctgtgttactcatatggcaaacaataattatgagaataattatgacaaaaatgccttgacattgacaagagtgccaagataattcaatgagaaaataatggtcttttcaagaaatggtactggctgggacaagcgaacatctgtacacaaaagaatgaagctggatcacaactttacatcatatgcaaaaataaactcaaaatggatcatagatctaaatgtaagagttaaaactataaaactcttagaagaaagcataagaataaatctacatgaccttagattaggcattagtttcttagatatgacaccaaaagcacaagccacaaaagaaaaacttgataaacgggtctatatcaaaattaaaacattttgtgctttaaatgataccatcaagaaagtaaaaagaaaaagcacacagaatgggagataacatttgcaatccctatatttaatgagggactagtatctagaatacataaagaactcctaaaaattattaaaacgacaaacaacccaaataaaaaatgaataaaggatctgaatagacattccttcaaggaaaatacacaaatggttaataagcatgtgaaaagatgctcaacatcattacccctgaaggaaatacaaatcaaaaccacaatgagaccaggcatggtagctcacacctgtaatcccagcactttgggaggctgaggatggtggattgcttgagtccaagagtttgaaaccagcctgggcaacatggtgaaaccctgtctctacaaaaaataagaaaaattagctgggtatggtggtgcatgcctgtggtccctgctacttgggaggctgaggtaggaggattgcttgagcccgggaagtggaggttgcagtaaaccaagattccaccactgcattccagattccaccctgggtgacaaagtgagaccctgtctaaaaaaaaaagaaaaacacaatgagatacaacttcacatcatctaggatggcaataatccaaaaacagataataacaagcgttggtgattatgctgagaaattggaaccctcatacactattgatgggaatgtaatatgtatggtgcagctgctttgaaaaatgacttggcagcacctcaaaatgttaaacagagttaccacatgacccagtaatttcacacttaaggatatactcaagagaaatgaaaactaaaaacatacgtctacccaaaaacttacataagaatgttcacagcaacattattcataataaccaaaatatggaaacaaccacaatgtccatcaattgataaatgggtaaagtctggcaaactcacagaatggaatattatttggtggtaaaaaggagtaaagaactgatatgtactacaacatggatgaatcttgaaatctttctaagtgaaagaagccaaacgcaaaagatcagaaattgtattgtcccatttatatgaaatgtccagaataggtgaatctacacagacagacagtagattagtggttgtgtagagttatgggagagtaggaggggaaaatagggaatgagtactaataagtacaggatttctcttttgagtgataaaaatattttaaacttaaactttgagaatggttgcacaattctgaatatatgaaacactgaactgtatgctttaaatgggtgacttttatagtattgaattgtatctcattaagatgcttaaaaaatgtttttctaatcccttgacaactctgagctttatttcctaagaatgccctttgaagagccagcagtttatagtggtagtagaacaacagcttgaaaagatctcctactgtaccatggaggatacagtcatgttgctatattcacacccccaccccatgccctgactgatacattaactccttattcagtacctatgataaaccaggcatagtgctaggtaaggggcccaaaggtaatcaaaccctagtcaagtttatccttgagtagaggggcaccacaagacacattatgttgttttaaaaaaaaaaaaaaaaaaaaagcaaacatgacaaagtccaaggtccctggaagcacaaggctgcgtggtaagagaaacatcctggaagcagcaatgtgtaagtaaagaactaaaacatgattagagttagtgagaaaatgtgctgaaagaaggaatcaattgtgttctgggcagaaggaatgtgcaagggactggaggtgcacatattgtttgagaagttaaaacacatacaatatggttggtgcacacagtgttcactgtggtgaggaaaggcaagtgagtttccttataaaggccaggcataccatgctagcgagctcagactttagtttgaaaacaatgcagaaccattaaactgaaaaattacctgataacattcatgttttagaaagattattctggcttcagtacagctacatatgacttgaaggaaatacaaatggaagcaaatacctaaattaagaggccactgggaaagaaatgatagtttgaaccatgctattaatggtgtgggtgtagggaggcagctagattcaagaactattttacatgttgaacggacacaactttgtgattgactgtatataggatagggaaacaaggggagggaagggtgactcccgggtttgtggcattagcaactggatgatggtgcccttcactgaagtagggaacatacaagagcagcaaacctggaataaaaagttttaaatacattccatttggatttactaaattgaagtgtctatgaaacttctaagggtggatatataggtctgaagttcagggaaaagagcaagctggaggatgtagctttgagaattaagagtctgcagagatgagatgaagctctgagggtagctgaggtgtcagagaagggaataaagaggaacagggcagaccctatggaacatgggaaactcaggccatggagagcccatgccgggatccctcaggctctcaagtggtctctcttctaccttcagtggtcagcttggtgggccccaggataaacactgaagaaagtggtttttcattcttggcctcaggacatcctaacccttttgtgcaccttcaataagcatttgttccaagaatattgaggaaaggctatatgtcaaggactttcctgggcactgggatatgaagaagtcaacaaatcccctgccctaaaaaactctggttggtcaagggaccaaaaatagacatatagaaattcttcatattttttctcctttttggtgagaaaaaaaaatttttttaagggaaattaattttataaattctaaatttatttttttctgaaataataagcacacaaagcgacacaaggacctgaaaaataccaaagtttcataatgttctttcaaagttggccacttaaaccaaatttcatacataagaaacacagctacttgacaatcaaaacagaaagaaaacacagatacttatttttagggagtaaaaacatttagtgtaaaattgcagttacatttttctgaaaagcacactagagcctcaaatcctggtaagttgcacaatgagataaactgtattcaaacaaggcccaaaagagttcagtcagtgtcaaaaaaattttacacaaatctaaattttactctggggagcaaatcaaaatcttcccaacaacatgaggatcatatagtatttgttttcattgtgattgccaggaacatgaaattcaaagccatgttttgcattgcagaaatttctagaccctcagtctggtaacactcttttgacctgtgacatagttggggcagccatatttctctgctgccagatgctttgctacagaaacaaacaagacacaggagagaaatgccacagtgctagcatatgaggtagctacataagtgacttttagaaagagctccccaggtcactcgtctgtctcctttctaatttgagtgtgatccagccgtactggggccatccatagaactggtttgcccctcctgatagtggttctatccccagtgaagctggccactaaagactgccgagctcctgtgatctctgagccctttctgcctggattttcccacatccatagttgcagatgccttgatgtttcccaaagattttgttgtgtggaaatgaactcttgcagactctacatttattccctaaaatccagggcattgaacttctgacagctttgtaaacttttatctacaaaccccacttcactgacccctctctaaacaaattacacttagtggatgttcctagctttgagtatgttctttccacaataactttctgagaagagagaaaggtagagaagagttagaggatggcattcttgtttatcatttatcaaactcctcagtcatagaacaatttacaaaattagatacccacacaggaagtaaaaacaaacgaaatacttattctgtagttccacttgccttttaaaatagtttttttataattcagagctgtattccttggctgaagaattttgtgtaccaataaaaattatttcaatacattatttgaattccagtcacatctccctctagcattttcagtttatatcatcagctgacatctagttgatgtctatccacaggtagacaataattttccttggaacacaataattttccttaggttcacagaatcctggatctgaaactgaagtgagtcctattgccatttaggaactctacatttacatgctcctctctcaagaaaaaaaatagttgcctttcacttaaaatttctctaaaatttttgtaaaattcctctaaaagaggaatatccaataccttctgtcttaggatgttcttagtatctcaatctaacaatcaggaattttttttaattcctcatgtttaacttaagtacataattaggttgccttaggaacctacaatggctcttaattctttctactcaaagcccctattacagtgtttggtatatagtaggtgttcagcatatatttaatgagagaaaaaaatgaacagagggaggaaaggaagaaagtgagaggaaggaaaaaagaaaagaagggagggaaggagagaacaaataaacactaaaaggaatcaaacatgaatccactactaaggaaattaacaacagagtagcaagaatgttaaatggacataaataactacaatataaagtagaaagtattaaagggccacagacacaatgttggaggaaatccgaagagaggtatgaaatttctagctaggagaaatcagaagcaagtcaacagaggaggtaagacttgaggtgggatttgaagaacaggtagatttcagacaagtgatcagaggggataagtgtcccaaggagaagtcatgaatgtggaaaatcatggggtgatggggaatgaagtggtttaaggggagcacagaaggtggtatcgggcccctttagtatctaggcttataagcagaaatattaataattattcagaatatcatttgaatgaatgaataaatgaacaaacaaatgaataaacaaacaaattaacttaggcctggaactttaaagataaagcagaatatgaatgttgtttctataattattcctattgcaaattacacctctatctctgaaaaggacctcctgggaaagccttctgccatcaaattagatctacttgaaaaaaaaaattaacgacagaattttaattatttcacagtgtttgcatgtcactttattttaatcccagggatatgggaaatcaatataaaatagtttgttactttcctattaccaacacaataatccatccagtgtaattttgctttctttaccttctatttcttttttttttttttaacatttaaaagcaaaccggaagaggctttgctcccactcttcctctttcctatttgctcccaacgatttaatgcacatacacaagactggccaaccaatttgtcagtgaagtactctcctgctggcttttatggctgagttattgcctttaaagaactaagaaataggacatactgctacacaactggtcctggcagaaacgttaactctagaataagacggatagaacaaaatcagtataaaagccagtgggattagtgaaggctttaacatacagcttgcaatggttgaaatctcttatgacccatgatgttggttaaagatcatacttgctgaaaaacaaccttagccactgttactaagttctaattgggttttctctctatagctgtcaaactccctctacaatctgatgactttttttcatacttaagcgcaaatgaattttaagacatacatcacgagaacttaatctctttttaacacaggaacttgtacacaaatgttcatagcagccttattaacagcctcaaattggaaactccccaaacatccttcagggcatgaatcgtaagacaaaattttggcacatccgtaccgtggatgactatttagcattaaaaaggatcagaatactggtatctacagtttatgctgcgtgagaaaaaaaaaagccagtctttaaagaatacatgccatatgattccatttaaaaaacatctgtgaaattacaaaattatagagataaagaacagagtaacagttgtcaaggcttagggatggaggagaggggatgggtgtggccataaaatagaagtgttaccatgatggcacagtagagaggctgttgattgtggaggtaattacacagggctacacatgtgacaaaattgtcacaaatgcaaatgatgtgtgcacaactggggaaatctgaaaaagctctatggataatatcaatgttaattccttggttttgagattgtaccataatcaagtaagatgtgaaccctgagggagctggaaggtgaatacatggcatttccccatacatttctttgtgagcctctatgcatctatcattatttcaaaataaaaactttaaaatatatgtagtcaatttatatcaggatgtgtcatgaggtttctctctcctgagttgaacaatatctaacataaagctgagtgatagtaaggtccaaaataaacactgtccaaagaaaagaagggaggaaacagggaggaaggtgtataaccatccctggtcaatctaaaattgatgaaaacctgatttggggggaaatttataaaatgtctgaagttttcaatatacctttttacaataaggacattaaaatcaacattataaggcaattgtgaaaattaaaggtatatacagatatgtagatttctcaatatacatatgtgtgtgtgtgtgtgtgtgtatgtataagagagctcattttagtaagagcctgggactcaagaagtattcattctcttccaataagcaaaaaaaaaagaaaaaagaaaaataaaatcatcattatattcttaattcctcactctcttactctttcttattgcataacctcacatcttggtgaaattattttctcctccttcaacaactaagagagagcaaagattaaacacaaaatcagagctcttttcatctaggcccatctgcctaggtaggcctaagttgaatcactgaaccactgacacacagttctgtgagctctcggaagctcagaatcccacatacagtttggccacagggctgaaatgttgtagcattttatcaacaaccatgttttgaacaatttaacacccaagctctctcattcctgtctccttcccaaggcaactgcagattcctcttccctcagggaatataaccccactacctttcctcattttagggaactgtaatgacctggacagatggtaaaagaacactggaaaagtgatgtcttcaagtaccagcccaatgagggtatctactcggggggcttaaaatggaacactcaagcacgccaatgaccagcaaagcaggaaatggtcccagaatcactgacagaagaggcaaatttcccagaatacaatcccttcatgccgacccccagggtcaaagcacacagagcagaatctgggccacaagcttggaatcatcctcatgtagagttatcctcttttcagaagatgcttccccatctcaaactgggcttttatggctgagtaaaatttaccttgtgtatataatttacattaatttgtttggcaggctccaaaaaggcagtacaagcgagaggtccaacagagaggtcagacacaagtaacagcttgaaacccaaggccagggtccagatgggtgtagagacgagctggagtgggagttgagggtagggggattagcagaaaccagtggggcatgcagactataattaggagcatgtatgtatttggggcttgaagacattgctaaacagctgaaggacactgctcaggaacatgagaagctgatcccagcaaggctggttgacgtttccaagactggacagaaaacctgaggaggctgggaggagtgggcagtgccagaaaaagtgagagcagcagctctgagcaagcaagtcctaccagcatcataaatgagacgaagagctaggtttgccatggtcaggattttgccacagcagggagaggatgttaagatcagttactggctggctcaaactgacatgcccataattacttactgagcgtccatgtcatgaatggagtgctctatctgtacatacagccagaggtcatacagtgaagatagtgtccctgctccacttctctgttcacaggggagcatcttctctctttgatcataaggaagaggagcagagcacctacctagctgtgccttttcaggccaaccacgtgctggcagcgtctgttccttgtaagaccttcccaggaatctgctctgctaatgaggcccctctacctgacagctggttacacaagctgctatcagaaaacaaaagctgcctgttgaggtaaccaatatttccacacctcacacacaagcgtgtgcatgcacacacatacacacatacacacacacgcgtgcactctccccagtaaaattcagaaaccatgctcggaatgaatcaaccaccaaatggaacaaaggctgcctccaagataattagagtttggactgaactgaattttttctggcttagactcagcattcccacttctttggttgccagccccacagcctacacaataggcacatggggcaaagctggctgcagcttatagttttagatgaaatgctggtaatccatcctctggtctgccatcttctcttatccctcagtagcaaccacagaagacattcactgtcgatctcagaacatcaagaacatacctcggtccattctgctgagacaagagaattccaactgaaccactgatttggccatattaagacagtcttcaccattgcacacctattacaacggccaaaatacaaaaccctggcaacaccaaatgctgtagaggatgtggagcaataggaactctccctcattgctggtaggaatgcaaaatggtacagccactttaaaagacagtttggcagattccttcaaaactaaacacactcttaacatcagatctgggaatcatatattccttggaatttactcagataaaatgaaaactcaggtccacaaaaaatggcagctttattcataattgccaaaacttggaagcaaccaagatgtccttttataggtgaatggttaaacaaactgtggtacatctagacagtggaaaataatccagcactaaaaattaaaaaaaagagaacatcaagctatgaaaagacatagagaaaacatgaatacatattgctgagtggaagaaccaaatctgaaaaggctatatgctgtatgattccaactatatgacattctggaaagtataacactatggagacagtaaaaggattagtaattgccaggggtttggaggaggaaaagttgaataggcagagcacagagagttttcagggcagtgaaattgctttgtataacacaacgataatagatacatttcattataaatttttccaaacctgtagaatgtacatgacccaaagtgaatcataatacatactctgaacttcgggcgagaatgatctgtcaatgtaggttcattgattgtaacaaatgctccaccctggtgggcgatgctgacagtgggggaagctgcacatgtggggatgggggttattatggaaaaatatctgtaccttcctctcacttttgctgtaaacctaaaactgctctacaaaataaagcctattgattaaaacaaaaatcttcagagactgacaaaagtcaaatcaaaaatatgttgacatgcaaacttaatggtgtattgtgtgggtttctgtttgtttgtgcttatatgtgtgtttaaatagataccaagttatagcattctagaagaatgctaaatttaccaacatggaaaaacataagattccaaattcaccacaaatggaatgccactgcttcaattttctttgcaaaggcagaaaaaaaaaaaactatcaaaaatggtaaaaaaaaaaaaaaaaaaaaaaaaaaaaaaaaaaaaaagactaatgggaagaaatttttatcaatcaaaaatcaccactctgatcctctaccaagatgagcctgactgttatgagctgcgttacaaatgactgcaaaaaaaaaaacttttaaaaaaatctgctgtctattaggctaatctagtgattgccattttcctcaaattcttcatttgatgtttccaaagcaacaacaacaaaaaaatctgatgtagcaagccttacactgaaatcatattaaatcttcaaaaaccaatcagaaaaaaagcataggcaagtcttcttgggattcagacttaatcacctttaggtactaaaggtgggattagaacttaagtatgtctctaataaacaggatgatgcaaaatcaatcctggctcactgccagtcttcctcctgattgacagctagagcagggctgtccaacagcaagacaccctgaattgcagacataatttaaaattttctaagtagtcatgttttataaaataaacaactgaaattaagagcatattgtatttaactaatagactcaattatttatcattttaacatgtgaccatggtagccacattccaagggctcaagagccacatgtggctagtggttaccatattgaacagcagatctagacttccagtgtaaatctaacaggtcccaagcttctccctttcaaatatgtatttattcattcaaacacacaaagtctcttcatatgcttcattattcctactactggaggttcaccagagtcagcagtaacagtgcttgagtcacaccttcaatctatgcaaaccataagaaagattaagctctatgccaatgtgaaaaccagctcaacttcagtttcttattgttattattattattactaatttatttccagtatatatccttcccatttctttatcttaatttttattacatattgactatttgtaattatatatatttatggggtacaaagtgatgttataatttatgaaaacaatgtggaataattaaatcaagctagttaacatatccatcaccttaaatacttaattttttttgtggtaagaacgttagaaatttaccctcttagcaattttgaaatgtacaatattattaactatattcactacactgtgcaatcgatttcaaaaaaattcctcctgtgtaactgagattttgtaacctctaaccatcaattccccattccttcccttccccccagcctctgtagccaccattctattatctgcttctatgagcttcgttgttttagattccacatctaagtggaaacaattaacaaggtacggagacaatctacagacttggagaaaacatttgcaagccatacatcagataaggtattaatatccaaaatatataaggagctcaaacaattcaatagcaaaaaaacaaaaagcctaatttaaaaatgggcaagggacctaaatagatatttctccaatgaagacatacaagtgaccaacaaatacatgcaaaaacaaattcacattgttaattattagggaaatgcaaaataaaaccacaatgagatatcatctcagatggagaaaaaaggaaatccttatacattgttggcaggaatgtaaattagtacagtacagccattatggaaaactatacagaggttcctcaaaaaactaaaaatacaactaccatatgatccagcaatcctacttcctagtatttatccaaaggatttgaaatcatcttgtcaaagaaatacctgcactcccatgttcaatgcagctctattcacaatagccaagttacggaatcaaccttttcacactgtttggaaaaacaaagaatttctcaactaaagtttatctttgtgatagaataaatcaagaaataataggtgcaaagccatctagggtctgcaacaagagtggaggtaagtgtagtgaggggtgggaggagaggaaagaaggcagagaggaaagaaagaagggaggggaaaatatcacagcaggtcatagaaattacctcaaggcatcgagtttaagagcaggattcccacattcaatgactttcacccaaacaggtaatgcaacctaggtttaaaaaattgtgtaaatgttgtaaaagggattttcaaggcaatgaacattgattacatgcaccaatacatctgaaagagatagaaagcagagtttagccaatacatttgtgcattttaaagactgtcccttaataaacacaataatgagccttcttatattgctgcaacattatttatcacagtaaagaactcgaaacaacttaagtgcctatcattaagagaacatcccaattaaccgtgatttagccatactgtaaactttttaaaaagaggtacatttctatgagctgacatagaaaaatatccaagctacgggtgagtgaaaaagcaagttgctgaaaaatgcatattataacacacacacacacacacacacacacacacacacacacacacacacaaagtgacaatagctataatctctcaggaggaacctgggataagttggttgtggggatagaggaggaatcaaagaagactggacactttggtcttctcagtagtatttttttaataaagaaaatgtattcagattttacttagagaaaaagaatgattttaaaacaatagtacacaccctcaaatgtgtttatcccaaatcaaaatttaatatattgaaacccaccaaactcatgcttatgcttacctaagaatggagtttctctcaccatgtctatgaatatatttgaacacgtggatatatccttgaatacagagaaagtgttttcttgaattggttattttttaaaaaattagatcgctgaaaatcttctcatgaaaaactgaagacatcagtaggcttctacgtacatgttgatggggtttcagacacattaccgccaaaataagttacctgggcatattgaatattttaagctgaaggaattgagaaacagcatgtacaggaaggactttctgatcttcccctgaagcagggcataaaacttaggaaggactttctggtcaacttcataataaacctatttagaaacttataataaacctgattaaaaatttataaactaaatgcaaactgtggtagatgctattactatctgtgaataaagacctccttctctcctcaaggaaggactatgctcctccactccattttggacttcaccaggagatttgccttgatatatacaaccaccaagaaaaatatttaaaggtgaccaagtggtctaagtttctcttgtcactgtcctctgcaacaagaggcatatcccatagagcctttgatctattttacaactacatgaattgtggataactgataacaacatgaaacaattcctgtccactgacatgcaaatattactttctgtctcgtgaagattcagtgagcttcccttctccactatggaatgtgttttgtccttcatttgcacattccaatctatgaatgtggctattctttggattgtcatttgaacatcattggtagtcataacatcctaccagttccctcattaataatgagttaaataaaatctctaacacatgttcattttatatccaaaagagagtataattttacctttctttgaaaattatcctgggtgcttaaaatgttagataattttactatacactgattccccctaacaaccctatcttttactaatgagaaaaaggagccccagaaagattaagtaacttgcttaaagccacacactgattagtagcagagctggaatctaaactccaggtctagatgacacctctacactgcttcaagggcaacccttcagagaaaggagagaatagggtggaatcagggtattgtgaaatcacagaagtgttaacagccagttccttttttgatcatatgagggaatgaaggcacaaaagtataaagatcttggccacgttgcatagcttattataggcagggatcagaacccaaggttccttacaaccagcctgatgatcttgcgttcaaggaggaagtcaaattagactagggccttgatggataaatagaatcaacagactggcaagatgcaggaaacagaggctggacacatgtgaatgtgaggtatggaaagtaggagaggcccctctaccacaagggttctaggaaatttacacagtggggagcctggaagtgggaagagatggggcaaggagactgtgtccagacgttgtcagagggggccacaggtttgtaccgcaggagaagtactgcttgggggagaaattcctggaggctgtaaaatgagttatttgctttcccagtagtcagagactagatgcttggccacctgactttgtgcacaaccctttgccatctgagcttctgcttcacctgaggctgaaaaagatgacatccaagattccttctagggccaaaaactacaataaagtcaaaagagtagacatacttcctcataagttgatcatggtggcatactctgttataatcacatgtgttctagaaacccaggatgccacatggggcagaaaagccagaaaagcccacatggggtcctggagagaagaggctgcctcaaaggttattttggaggaggaggtggagacctcatgttctaaagaggaaaacaaacctacttgcccttgcctgactgtcaggctgtgtcccagaccagcagggacttcacagcaaggccaggcttcctattctgtgagttcctcacacccgtagagtgtccccatctctctgccactggggcataccctgctcctcacaactccgaggcaagaatcaagttcacagggcatctgttcactgctacgagtgtgtggagacagccactgacaggaacactgattcccaaaaggcacatgtaaatacaagatgaatgcaaagagaaaagtgactggactagagagaaaatatcagctctaccaagaaggaatcgtgattcctgcttctattattatagataaaaacctaccatcttatggtcacatgccgggtcttatgaaaatgagggctgtgcacacagacagtgccctctccacacctatgcaccaacctgtggagcctccctccccaaagaatggccaagaaccagggcatcagtaaccgttagacatgcagaatctcaggccccatcccagctctgcgggatcagaatccacgttttaaaaacatccccagatgatcacattaaactttttgagaagtgctgtttgtaaggttcctgtgagtaatgcagcagcaaagctcgggtacacaaggaaagactaacaagtgagcagagagctggagatggggaaagaccagaccatgaactggagatcacaagctctcttaccaacacaataattcagaaggtgacttctcaaaactaatcttcagctgagatcagctgacggagtaagaccttcccaggatgaaaggagggctgaatccccaggcagggcaaggcagaagggaaggggcagactctctcttgatggcatcctagcagaatcaattgttagttcccaaagctgtcctagaggcgtgatgctctgtggtgcatttgctatctctttgtgactcatccacagatgaatgggctcaaagaaaagggagaagcgagccatgaaatatagtaaattacagcttaatcttcctcaccctggaattcattcagtagttttaatgaacttacagtctggaaagcatgttgaagaatgtatatggaatatatttcatgccactctgagcatcaaaggagcgcaattccctttgttattaaggggataaatgtccttccttcagtcagtaccttggcaaaaaaacaaaaaacaaaaaaacctgttttccattattgctgttatctactgcaaaactctaaagaatacagattttcaagaagtggttcccgagcacagtcagcttcctgaccttgtatcttcaccctgaaccactgagacaaataggggaccctgaactgtcaccttgaaactccaccaggttctctctctgttggctacctcctttgacttgacccacagacccaagagagaaattgtcatggcttgcttctaattcaggttggaggaaaacccaaagacccctggaaggatattgagttatctccagaaaacaaaaacagtaccctgatttattaacgtacttatatgcattaatatatgtccagattagacctggacatttaaattcatccccaaaaggatatagcttatgctctgatactctactcccaccaaccattatcagtaattttcaaattatggactgctctctatcagtagataataaaatcagcttactgggttatagccaacaattttatgttaataaaatagaataggaaaattagacttaatcagtggtagtaagatgagagactgtgtgtgtgtgtgtgtgtgtgtgtgtgtgtttgcacgcataatgtaaagtgtatttttttactgtgtgtcacagtcaaaccagcatacagcacctggatatcaaccccttactggaaagagcagagagacaacatgagcaaagaactggaaaaacaggtttccttcatgaacttctaaaagcaaaatgaggaagaaattaagccctcttgtggcccaacagatgggctggagcttctggttaccctctcccctactcacatcccccactccccctacccattatggctcaatcagaagccacatcccataaatctcacaagaatgaagaaaagctgatttgtgctgcacagatttgtgcctcggacaaagatgccaatctggtggatggattccccttagcagtgaaaaaagaggctgagcgatttggagatcctattccttggcacagttttcactgaggtccccattctctacaaaaattattttccttttctccccaaggtgtgttcatggtagctcccagtcatgcttggcttcaaatgcacaaaaaatctaaacaggaattaaccaaacctccaaacagtactgatgtgaactttaatgtaaacactaagtcataatcccacctttgtcactatatcccaatacctccaaagttaaatacagaggcaaggtagcataagagttaagagattggggccaaaagtcaaattgacctcaattgaaccaagccccatcatttcctgaccttggaaagttacttatgattatctaagactcagttttctcacccataaaatggaggcaataatattatagcacctatcccagaggagttaataaaaattaaataagtgtgtaaagcatttatctcagtgccaaggacatgattatcatgcatcttcaagtaatattatggctatttttattattacaatcatactctattatttaaaggcaaagtttagtttctcctcagcctagtgacagagcaggagcattgccctcttggaaaagcaccaacattttaaagttccccttgatcaaaagccaccgaaatccaacccaaaggacatcagcctaatggctaatgtcagcatgaccataaactacaaatgacatctccaaccagaagcattccaaccctaagacaaacgcctccacaaccagagacatgcctgccccaagataaactcccctacaaccagagacattccaaccccacaataaacttctcctccacacagaaacattccgagcctgtgataaactctctcactctgaacccctaaatactcttagtctgtaagagagagtgctcctgaccaaattggccagaagcccctctcaggtttattctccaaaataaacctgtctttgactattgagctgcttttcacgtttctttcctctttctttaactcttacacctagcttgtttgtttggttgttgtttgttttgcaatcaataccaatggtataaatttaaaaggaagagaataaagaaattatattttctgatcaacgtttgttgtaaatgatttatacagtgatgggtcccaaactaaatttcccagggaattccctatttccttgcgggggtaaagagcatccgaattatttgctcattaaatgagttgccaaaagccagaaaatctatgcatctgagagttttcatctcaagagacccaggagctcgaaatcctagcagtatgaatcatctctgtccaagtgtatagagtctattagcagagggcagctcttgcttctgatggcaatggatgccagctgctgctgagaaaacaggaaaggtaatcccatgtttcagctttaacgtgcctggtcaattgtgaaaactgacttgaagggagagaaatttcatcttgacccccttggataatgaacaagaaggacagcctggcctgtgaaggaaacaccagagtggggcaagctcagagaaaattcagccaacatagcagtggaatcatgctctttaagtgtcaggccagcctcacaggtaccacactttttctaaacacaggtttctccattcacaaattgtttacttcagaaatgactttttctcctataaatggaattcctttgtctgagaaccacatacgcaagaaacaaggatgaaggaagagccatctaaactaccaggtcagctacattcattcattcattcacctgccccagcatatccatcctacgggtttactaggtaacaataggggtatggatgaggcaacagggatgtacagagaaagaaagtgcttagagtgagttgtatagcttaaatgctcatattagaaaagatggaaggtttaaaatcaatgccctacgtttcaccttaagaagttagaaaatgaagagcaaattaaacccaaagtaagtagaagaaaggaaataataaacaaaaagcagagcacaataaaacataacacaatcaacagaaaaagttaacaaggacagaagatttttaaaaacattaataaaagtaataaacaagtagcaagcttgatcaagaaataagagaaggcacaaattactaatgtcccgaatgaaaaagagatattgcagatcttacagatattaaaaagatggcaagcaacattatgtcaatgagtttcactacttagatgaaatgaacaaattccttgaaaaaccacaacttaaccaagaatgactcaacaagaaatagaaactctgaatatccctatacctattaaggcagaggttatccacatgtagctccagcagaaaggcagcatcagcaacacctgcaaactttttgaaatgtaaatccacagctctcactcggacctaccaaatcagaactttagagtgggtggggtgggggtcacagcaatttgtgttttaacagaccttgctggtaattctgataccatttgagaactgtttcaatactatcttcctacaaagacagacagatctagatggtttcactgatgcattctatcaattacgtaagaaagaaatcataccagccttacaaaagctgagaaaatttaaaaaggggggatcacatctcatcatttactgtcaatctctactcttttatggaagttgtaggagtctttattttccctgattcttattttaaagtgattcctggtttctttgaaatgggccattctgacagacaagtggtccacatagcccaaatggccacactgcatgttctcaagtagagaaaggtctttattaggtgttttctgtcttttgcttgcagcccttaggggagtgataatctagttcacgataaggtaattaaggcagggagttgcccctcacccacaaggatacccacagcatagcaatccttcccttctcttgcatacaaacctcactcaagccagagcagggactgggactcagataacaaaagcggtgataaaaatgaactatctgctcatagtattccttctaaataaaacacccataccacctttccacatctggctgtttttcttactcatccttaagcctcaggtgtcatctacagaaagacttttctgaacccccaaactaagcagatgtaactaaatctttacatctttatccaagaacttaatattgaaattctctatgactttgtacctttgtcaaataacttatattgaaattacctgtctgggtcctatatctctccaattatgtcattagctccttgagggcagaaaccacatttcattttttgttttggttttggtttaatgtctcacagtgcttgactactaattgcatagttccactcagtaaacctgtagtgaaatgaagagtctgagagtggagtcaggtcaaaatttacctccataaataaaatacactcaactcaaaacattcagtatgacttatttttaaaataagtactttcaatttgttcaatctctcagtagtattattaatgcaaaccacatggactgactttcattttgcaaatctcacctaccctttttaaatatatggtggaaacataaggtccctgcccacagatctatgcattgcagagcctactagaagataaatacagggatcaaaagaataacagtagtaggtgacacctagaatcttaggataaaagggttggatttcttcttttagcctctttatgcagacctgcaagttttgccttcacagccttgaggatcatcctgaagcatgagacacagattctcccacctccgcctattgcagaccccattccaacaaatcctccaataaatgagatcctgaagaattaatctcccgcacaagcagaataagtgcctgagggaggccaagttttgcagagagttaattatgatgaaggaagacattctgtggccattaatttttattgggagggcaggcattatattaacagctagtatatatatctagaattgggccatatagcatacacgcattgtctcatttacttatcacaaccctttgaattaggtaccattagtaagccccaccctgagaataagcttaactggccgaaaaatcacaaagtttaagtggtggaaaatggatttaaatttacatctctcagaccccaaaatccatgctctgaatgctagtgatatattgcctttttacagtcttctggtataattatgctcctacaatgttccacccaagccagtggcaaaagtaagtcactgatatcaaagaggggggatcatctaccctatgaatctgaagacaaaaagcaccctttaaacatgattcatcttcgacacaagagactaatttaagaaacatttctttctattcaaaataatgatgctaaatgggaagcgatttaagctttacaatggcttcatcagaatctcatctgtcagatctcaaaatcatgctcccagaacatgtttctcaatagaatgaatcagcaggaaagaaaagcagatgtaaagcaaacaggtgaaagtatgaagttagcaataactgtgctcatgggccaccaccaccatcagcaccaccatcatcatcctcatcaccagtattatattgttattattaagtaccttcattcccaaatagtagcattatgtcctctgaaggaatggggcttctgtttacccagcaaacaggcactgtttgcattaccttaagggttaacctactttcttgataatgggtcatgagtgagtaggggtgatcagtaaagatagtactattacaaacaacagagcacacttgtagttactaaaattatccaaaaaatcatggcaaaattatcaaagatgtaggattatgaatttggtatgacagcagaaggatgattgcacatctcacagtccatattgctcacatcgggttctcacatgctttaattgcagtgctaattctgagaattcttgattatgatctaatggtggaacacatctgaaagattaaagaactgattgtagaaaagtcaacacaaagtcctccatttatgtacataccagagtgcaggacaacggggacgaccctgtcccctggtggcagagctccgcgattcagaacctcgcagcaggaaggaacttgcctgtgactccacattcagccatgctttcagaagcactggacttttatcaatttctagggatatttgtgttgtcagggtatactaagtaggaatctattcccatttatattgtgatttgctttgtacctactaattttcactgaaatcactattataatttactgtctctacccccacaagtaagggatggaacttcatttcccagtaaatatattttgttttattgcctcctaggtaacaatgtgcaacaataccaaagtgtttcatttaagacctgtgattttgtgcttttcaggactagtaaaatacaatagcatgtggaacttatgatttctaatttgtttcagaacgtagtatactgtgtttatataagccacacaatattaacccttcaagacaactttaaaatctctttcaaagcatgattaaaagtacgtctaaaaattttccttgtgaaatgtaaatgtatctaatacacctataaaatcttgtcagctacatttatgaaacataagtcataaatttactacataaacaacaataagtcaaaatagtaacattgataacaattgctaaaatgttctttacacttactaaaagccaggatatacacttaacacttttaatctttatctcttttaacccttacaacaaacccacaaggtaagtatgttattctctttttaaagaagaaggtacagcttagaactatgtacctcaacattggcactctaacattttggataatcctttgttgtggtggaaatgttccatgtactataggctatttagcagtatccatggtctctattcacttgataccagtaatataccccatatccagaagtgacaaccaaaaactgtctgtagacattgccaaataccctcgtagggccaaatcagccaaatcacccccagtcgagaaccactggcttagagaaataaagtaacttactaaaggtcatatgcttagaatataattgaacagaagccaggcattctgacacaagaatgtatactctcaatcaatgaaatacagtgttgtttactctgtgatagtttaaagaacataaattttcctcaaaatagaaaactaaaaatgaagacaaactgtaaatgccttcccgtagaaagatattctatggccacaagagactgtgcccttccaaaattttcctttcctaattaaggtccatgtcccaatgcctattgcccttacgtagcttgatctcctgccccacctaccccaatcttctttaagtcctattccatgtgccccaaaagacagtcaccaatcccttgttaaggctgattccatgctttagtaaataagatccagactctgcctcacagagcccctgaagaacaagacctgtctgcttcctacctgttcccttagatgacccaagacttccacctgtatcatctcaaagtgtaagccttctgcatagtggtcactgaattccggtactgaagtcccaagacttcagtgactaaggactttccacacaccaaagtcttcctatgtgcctcacatagactatttcattccaggctcacaagaaccctaggaagcaaatactatttccatttaccaaaagaaacagattccagtaggcaggggaaacccacacaagcatttcaccaggttcacgacaggactcagattttaacccaagtatggacaactccaaacccctgctctgtattccaaccctatactcttccaatttcatggcagggcaaagactacagacacacccttccaaagcatgttctcatcttgccatactccctccagcttgcttagaagttcatcattccagccccctctcctcgacatcccaaatttatgagaataaacaaagcagagctgagtgtgacttcacttgtggaatagaaaagggaaaaattcaggcagtgacctcacgaactttgaaaaggcagtatcgtattaaatcagaggatagaaaaatacagaacatgttttctcttatccgattctatttttgttatttactttttttatgcataaagagttatgtattcatgtatgactgatcacatcgcttcaaagcactttagctgttaagtacgaaaatagacaattttgaaaaaagaacctggtggtggaggtgaggatttttccctttcaatcacattacttaaatatagcttgttgtttttttgttaagtcttcattaaactttcctgagagcttcaacttttaggttaaggccaaatacgaaaactttcaaacataaaatgtctgaagagaaaagaacaattggcagagtagagaaatgaactaccaaaggcagatctttttgacgttgatttattcagctttaagctgcttcatttggggaagaaaaaaaaaggaggggctccacagctgtaaaaatctataaagccaggctgagcacagtggctcatgcctatgatcccagcactttgaaaggccaaggcgggtggatcacttgaggtcaggagtttgagaccagcctggccaacatagtaaaaccccgtctctattaaaaatacaagaagtagctgggcatgatggcatgcacctgtaatctcagctactcaggaagctgagacaggagaatcgcttgaactggggaggcagaggttgcagtgagctgagatcttgcctctgcactccagcctgggcaatggagaaagactccattaaaaacaaaaacaaaaacagaaaacagacaaaaaaaactataaagccaaagggatagaaagaactcaagaaactttcagtgtctgaaaggcctgcctttaaaccctggcccgaccatttgtctgctcatttgagttacctcagatgagttacctcttttccatgacttccttttctgtaaaacaggatcattgtgaagatcaaatgagaaaatgcatgtaaagcacctggcacactgtagacacacaatagatttcaatcagtagggggccctctggacatacctatgtgcttgccaaagtttgtgctttagcaatacttttaatgtcccatgattacttctcattaattaagtgaatttagaagtattgtaaaccaaggataatctggctaggggctaaaggacaatatatatggggtacagactatgtcacctgcccagtgatctctgtgctaactggcagctttgttcttttctggtgattcagttaaacagcagagagtgcccaccatcactgcagatgttgttcagtgacctagacttcctcctggaaggacctcagtaactggaaccagagaatactgtttttgagccaaagaccacattcgttctcagattgaatctcatctctttacagacaaggacactgaaccagagaggagcaattcggcacagctaaatgtgacagaacacaaacacgattcttaatcttacctctttaccagtggttctcaactagaggtgattttgacatacacgggacatttttggttgccacagctaggggaagatgagatgttactggcatctagtgggcagaggccagggatactgccaaacatcctacaatgcacaggacagcccctacagcaaaagcatcaatagtgccatggttaagaaatgctcacctactccattggaccagtgtctccagggagtctgaaatctgcctttaaagctgctgctgctggaagttgaacttggccccagcatggcggccctcactaatgactgattcaaccctgtcaattgtgcctcttagcattgaaagccaccaggtttgggaaggatttagagatttgcctcctcaggtaacttaaagtctggacataacttttgaagcaccctgatatgcctgggcataagtgctattgacagtcctgaaaatgcacttcggtcttattaggcaatctaagaaacttactctcaaaaccattttggcaaaacaccgccaaacagccaaatgatgcacaaccacacagatacctgaatatcaaatattcagaatgatccaccctgagcaaatacatctgatactgtactaagcacctccaggattaatggcttgagtagaggaaacacagagattgaagcactgattaaagctaaaatactctcagtgtttccacccaaagcttgagttccatgttgcagggactaaaaaaagaaaagaaaggcagagtcaatgatttaagcaattatgtacttactgattcttgccatgcatgccatctgtcttgctgacctcacaggcctctacaccggccagtgtgagggtcaaatgagagtctacgtgtgggagtatgcagtgaactgcaaagccatttgaaagtatgagtcacaatccaaacttatttacccagagttccacctagtaactatgacgttagttctgacccatgatagaaatatatgaaggatcccaatctgatttattcataaaatcaatgcacatttaataaagatctgtcatgcccaatgcttttggggagcatattccccacttaaaaaaatcagtgatgccacaaggaatgacatgcaccccactaactcttatacagaattagagaagcaggaactcttttaggtggaaatacctaagaagtttccattgaaagggatggtctttgaattggatcttgaagaaaagatgggatttcaacagataaaaatgagaacatttagagtactggaaagaatatgaaagaagaaaggatcataaaaaaatcaggcaaatatgacagtcagtaaggagttcagcttgactggaacttagggtgaatggaacaaggtaacagacaaagcagcaaagtttaggtggaagcaagtgtaggcagccttaaaatccaagacaagaagataggcatttaatggccaacaggaagccaatggagatttgttgctatttttcaaacatagaaggcacaatcagaggagctgtggagaaagtaatcagacataggtatgcagcatggagaagatgaagaaaccagagtaatgaaagagattaaagaggccacccaatactctaagagacaggtgatgagactggaccaagatcatgggagggaaagtaatgtgaaggaaaagcccacaatccgttagggacccattgatcatgggcaaagaggaagaataaaaagttaaagttgaaggaacacccaacagaagatcatacaaaggggctcagaagttttgatcctggataaatggaagaatggtagtaattatcagacataaggaagatggaagagaaaagacgaatgaattgtgcctagatgatcctcttgactcagaaaatgacagctcaatgccaaggtcactcctgctactggtgtctagatacactacccagacgaagtgcctgagctattatacttactacatctcagcaccctctcatcccatgcctagttcccaggtgaaagcctctaaatagcctttctgggcctagatccctacacctgtgccctgcccccctcccaccccctcccttccccccaccgactcctgctgatacattagcaagggtaagtgagtgaatgactaagtagtgaatgagtgatggctgcctgtactctgaactctgatcaaaactatatagactctccatcactccccttcccccacccccagccatgttttacctgaaattgtagtgctttttggccctttctcacattaactgccccaggacttgcacttgcaggctaagtctcagcatccatctgtgactggggctctaaccagaccactgtggctgctataaaggcaccctgattcaggtggcaatcttggaatgtaaactggacacattctcatggctgatgcacttgttcttactactttgagactgtattattagtcatcacaaatgtaggaaaatatttgtaaagggatttatctcttggaagatcctcttgtccctgatgttaccacttaggctctgaaaatcaatactactaagtaagcagtagaatgcaggattggttgtgcattaagtttgcaaaaatgtatgatttgatttatccagtgtcacccctgttaattttcccaacaagttacttagctgccacttttaattgcaaaggtaggggacaacagtctaccaattctatttcaaaggtgctgaaagaacttcggaattaaccaatgggccttaatatatcctgggaaggaaacgggcagagttcagcagaagatgtaccacatcccatcctaggatacaactgcttagcaggcagcctcccacagggtgataaccactcgccttccctcccttcacatgtgacaatctattattaccagcaaaggtggctgttgatgatgacttattagctatgtcaattcatgaaggctgaacatgggcaggcctgactaagggaatcatttgctggatttaatcaattactgggttcatcaagtgtgattactgagccacgtcaaaatccaagtgaaataacacattagacattcatggaaaaacataactccttgctttgccttgccacagatagaggccacactattatctatatgtacaatatccaggttatcaattatctgcacatgtctgtatcctgggctgtcttcttcctaatgtctagaatatttttgagccatttgccttttttttaaaaaaaaaaaagaaagcctaaaaatcagcaaaacatacatttttaaaataactgaaaacatgaagaaaacaagaaggaaagattctgggctatcctattagacttcagtatgcccatactttcaagcaccacgaataataaacaatactggaggctcactttataatctagcgagagaagagtatatgataatgtaagtatcctcccaacagatctgattgttcccaatgaccttcaatacttatatctattatagcacttaccacattttattataatccctttgttcacctgtatctcacctacaagcctctgtacctattaacagaggcaattgtacatatcttgttatttccagtatttactgaactatatagcaatatactatagtaagtattaaataaacttttgttaaatggaagatttttgtaaagtactgtgcatgtgactatcagtataatatgattatcaaaaacatgagggacacctttgtctaaagttaattactcacagaaatatgtctagatttagaaaatgaataaatcagacacagtaagagctagaacttctacctaaactatctaaacagtgctatgattaataacaaataaacaaaaatgttcatgctaatgaggttgttcattacctggtatggcttttttaagccacaactccaactcctaaacattctgaccaaagtatttccataatccagacacatgaaaattgaacgtgtgtctgtagaactccctcaggtttgtggataggtctttaatttgtgcctctatttcttaatcccctatcatactgaaataggggtgtgtgtgtgtgtgtgtgtgcgagacagagtgtgtgtgtgtgtgtgtgtgtgtgtgtgttggaagcacctctatcatagattcagcttgcaacatcagctctgatagcaattcctttcttcaagggcagctcataagtatttggttatttctaagtatttctcaaaggtataaacttctgcaagccagacctgataacttgaaggtgaaactctattaaaagaaaccggatgagacatttatgagtaagcaggtttacagcgtaatcctctctagccgtcaaattaccatttcaccacttctgcaaatctcttggaatgattgaccctcatgaacaagattcattcacaagcaaaaggatagttccccttaaatatgtggatttaaaacccaatccaataaggttttctgtgcaaggagaggcttacctactacctattgattcccttgctaacccgataaagaggacttatgaaatcactctttctactgaaatttggtcttggaagagattagtatactctccttaatgctaggagtgagactcagtaaaatcactatcatcaaaacattcccttgggctaccaaaatatgcctcgtacttggtgaaatacttaaagaaagataactgcctcaattgtgttgtagtaggatgacaattactttgaaagctgtgggttttttttttctttaacaaggttttgataggtaaacaaatacataagtgaaataaaatgaaagttagcaagaaaagcgtaaacaaatgtagattatttttgtatcctgggctgtcttccctttgatgtccaaatcaaaccttttaatataacatttatatcacttagttttcctatattaagccacctactttatttgactaattattaactccagccaaataactgcagttagaattaaactcaccagttaagtccacattgctgtgtttattcctaccatgagaaaggaatcacagctattcccagtccaaataaaccatcaagtaggcaagcaaacattcaaacagaccattacttgactgggagtgtcaagatatatttaaaattgtctaccattcatcaaatgaggaatccacctactccaaatctacagatccccagagaaggtctcaagcaagattattctgaaaaaggctgaaggtttgctctatagattaaacaaggctggaaattttttaaaacacttcttttatcaagagatttagtctatggtccattctcttgaatgggtgggttcagtgatagcttgaccaataagacacagcagaagtgatgctgtgctcacttctggacccaggccataattaagagactagcagcttttaattcctgtctcttagaacatttgacctaagaaaccagacaagtgcaattgccctgagcccaccatgtagtaagaagcccaagccagatggaagcaccctggaggacaaaagccatgtgaggagagagggagagagagaaaaaaaatagagagggagagagcaagaaacaaaaagcaccaagactcctaacgtgagcaaagatactatcttggaagtggagtctccatccccagcagccccagttgacaccaggtggatcagattcaaaccagccagccaagtccttcctgaattcctgacctgcaaaattatgagcagaataaaagttattttaagccactaagttgaggatggcttgtaattcaatgatggatcagaagcacatggatctacttcatataaaaaatgtatttcattaaaaatagaagagctcaaactgatcctctattaattcacactttaaatgacttcaataaagcttgttcaacataattggtttatttttcattacagtgacaaaataaaaaaaggcaacagcattcacgtcagatatgcaaaaaacacactttcaaaacaaaattgacattgtaatttgaaccttgacaggtttgagcagctctcttgtaaaacttcctctcactgtctaagtatctctccttaaaataaaattgaggcaactttgaagcacctcatactccaggttaactacatgtgaaaatgataaattactttttactactcaagactactgtgccctctaatctgagtgattaatttacatcctgctcagtggttcacatgcaattactaccgtgagtccaacgaacctgaacaagacagaattgtttagccatctgtacaagctctcactatatttagaaaagtacagcaatctccaggaagctttcaagttttagttcattttcctctcaatgactcgtgcactctatgctgcatatcaaattataataccactcccttggacccaagtttgctcaacccactttattttgttgttgttgttgttttgttttgttttgttttaggcttttagcagcctgaagccatgatttttagtttctgtctatagtgataagaataaaagagggatgaggaaggggctttactggcccaaatagaaacagaaactaagaactcatgactgtattctctccactggacacccctggaggagaccatgcaacacaggaatctctactgtgagatgacgctcattagaaaaggcgagactaaagcagtgatctaaaaaatgccattgttgaaacctactggcaaattttaattgcattaatgatttttttaatctgcatgtaatctgtttaattccataacacccaagtcaagtacaatgaaagcagatacaggccgtctagattgaattgtgggcttcaaatgcttggtcagcaaaaggtctaagtaactttatttcctaactcttctcaataaaaagaataaatattacagaatataacaatggagtcaccttataataaatgtgtccttaggcaatattgacattgtgtgaaaatcattaagtgtacttacacaaacctagatggtatagcctactacatgcctaggctgttggtatagcctattgctcctaggctacaaacttgtacagcataatactgtacttggtaatgtgggcaactgtaacacaatggtaagtatgtgggtatctaaacatatctaaacatagaaaagctaatgcattgtactacaatgttactgcagctactatgtcactaagcaataggaattttttagcaccattataatcttatgggaccacctaactcaagaaaagcctcctaacatacatgaggtctacacctctagataagcctaagataatatgcttactaaaagtttatgaaagctcttcctaagaaagcatccatgatcagctggacctttagaatcccaactttgatggagagtcatagctaagtttaaagaataaagatggaggttggaagtagcaagaaatgacgctggagaaataaaagaggtcatgggagaccgtctgtgccattattgtccaatgaaatttgtgaaaacaaatcattgtaaaaaacagaaagcagtgtatacaagatgaaccaatgaatgaacaacgtgaggtgatgaatatgttaatttgcttgactgtaatgatttcactatgtgtatgtatatatatatatacacatatgaaaaaatatcatacactttagatatatatataatttttaaaagatgaacaaatgaataaattccacgaggaagtacatgacatttcctaagctcatttcattattctatcattagagaacccactcaccctctccatagtcacaacctgtatgcatgctcaaatacacatgctgctccaccaagtcagcaaactacatctgtcaacgggtcctgtaatggggaatgaaaatcgcatatgcactgaaaaatgggcttcccattggacttcggaggccatgcactcaaaaacctggtgagttatttttgaactataaatacagaagatttaagtccaacatttaatagccacataggttagggccagtgaccacctgatccctcatggctccttatgccaaagagtgcaaagcacagcccagaggcaggctgggcacatgagggatgatgacagatgtcattctagttaaaattaccctttccacagtcaaatcgaaagactgccactgcccttaaaggaatctgtgcctgtgctttgagctcaacagcattttgtcagcaaatcaggcaaaggatattctgagacaaaggagaattcagacactaaacatgttatataaagaccgctttgtgctccccatccataaaccttcagcccccgccagcctaatcactctctggtcaaggttttaggaaaatcactagacagcatggcagtaacaagcttttgagcccacaggatctactctcttgtgaaggcatccacctactgtgcctcactagatgcctgcaatcaatttttaattacagcagcagtcacgatcggagataaagcacgcaacatgctgagaaagaaccaaaagcctgtttattacagttccagtccaccatgagccagacttgtgaagagctgggccacaaatgaatcaaccagttgcagctcagaaagacgttcttacctctgggacgttttcttatatttcctcctgtaagaaaaggcataaacatatatcagaaaagggttgtggcaggcagtgggtaagaaagggattacttcagtggggatgggcatgggggtcaacacttcttaggggggtttctctgtgaagcttatgggtttcaaagcttagttaaaagtttgggaatgctgtgttatattgtagtcagaagtacagaacctaagcctttagtaaaaaatagcatcccaagagctcagtggctctgctcccatgttcttcccttttccttttgaaggttccatggcattttagttgaggtcaggctttaaagaccacaaaatctaggttcaaacctcagtccttcctttaccaggttcatgaggttcttacagagtaaatggacacaagcttacaaaacacttcttttatctggcacatattaaatgggttaaatggtgaataatgatcagttatttatgttgtcactatcgttactattatccccaacatctagcactgaggtccctttaaggatgtgcctttttaaatgtaaatgtgcaatcatgcagctaaactatgagatgagacataaggtcttcaaaaaaagaagaagtgaggaaggggacaatgagaaagtctagaagcaaatgttgagaaccagcattaggaaccatccccaggaagcagaagagacccagttccagcccacgtctgttatttacagtcatttagccttgggcaaatcttgtgcatcaggcttcttaatctatcacatgaagctagtaacatctgctctgaccatctcacctaggtcagagtggcagacaaggagaaaatggccataaaatgtatgttgtcccaatatcccaaagttcttcatatgtgtgtcaatttttgtagactctgaagacccttaaaagagtttcaataggctcagcactggaggggattagaggagaggaagtgttaaggaaagaaaatccatctccttgtagcatatccgggaagtacaatgtttcccagttgaccttagttccacaccagcatttccattacagtcactgtacccaggaagcaaaccactggtttgctaatggagagctgtgtaccatatttctttgtaaactaaagaggtttcaaattgagaatcactaggacctgttacatctctgttaaaatgaaatcacacagggcagtgtcaggtgtgtaaagcagcaagtaacacagaacctacagtgtggtcttgactagatatgtagtgatatctatttacctgaaaggagacacaccagaatgacaaccatgactccagggtagtaggatgacaaatcactcctttttagttttatgaattttccaaattttctttaaagagtgagcattataacagaaaaaaatattaaaatatggatacacctagttacatataaaggtatatacaaatataggactatatagagatatttccatgtttatattatatcacatataatagggaggaaagttgactaacagtagattaaggcttggcctttgaagcaaactatctatgttccagtcttggctctagcacttagctttacaatgctggactagttattaaatccccctgaacctcagtttctttgcatataaagtgggaagaatcagagcccctcttctgagaccttgttatgagaaataaatgagataattcacctgaacatcagctccccaagggcaagttctttgtgtggtttacctcatactctccccaaaagctatgatgcatgtgcactgatcaatcactctctcgcacctggaccctgtcaccaatgacagctcacactttccaggcagcagccaagggcagaggcttcaccttcagccatggagcatagtgagctgtgggtgtgacctgtgcccttggactcattagcacagcagtctaacaaactgatctaaggtacaactggcaagacgaaaaaataacccattgagcgtatacagggaccaaaggcaaggaggcagttggaaaagaagaatgcccctagcctctactcagaagcccaactaatcctatcagcagacagcatcttcagaggtcagaagaagacagcccttgctattggtttccacagaattctcccaatacttgccaaagaaatctataaaggcactgctgggagttctgaaagaatcaaagatgaacaaaaataagaaaagcttcattttcagcacctactagcaataagcacttaatatactttgctaatcctcataactctgtaggatcccctctctgaaagagcgcaaattctaaaaaggaagttaagacatgcacctaaagtgttattttaacaacaaatacaagggatgctttgtgaaagaggtagtcttgattgctgggtgaaatgtcagcaggaagaaatatggaagtatacagcaagcagaaacagagggcatgcctcatggtctcaaaccagtccagcaagcagggactataaagtgaggtagcaggaaataaggctggcaagtgctaaggacagagttaagtgggaagagtaataaaatttatattttagaaaagatgatacccagggggagtgtcacctcttgtgggaagccgcattacacaccctcttctgtgctcccacagcatgctgaaacctctctgacaccgttctccgtggcattgcattgtctcatgtctgattttgtggaaaggcaacagggctctggagtgtgatagacctggctcaaaacctaacttcacccacactagctatgagacctcaggcaagctctgtgctaaatcaagctttcatttctgcatctgtgaaatggatgagatgatctcaaatgagatagtgtattaaatttgtcatgtagtgtgcctgccatgtaagaggcattctaagatttttaggccccttggtccctagttctgagcttcttgaggtcagaggtctgtcatatgcatctctatatctatcccaagggcatgcacgttaactggcacatggttggctaaataaatgaactatttgcaactgtcacccatacacatcaaaagatgggttgtgcatctggtagacccaaagaaagacagaccagaagtctgattttcagtccaactcaccttcctgacacgcccctcgttcatagatatattcttagcttcagatattgtaaagtttcccccttcaatcttctcccatttagacacagccctaaaatcaacccaaatggtatcatcttacaatggagtttggaggtcagctcttaaagcacaagagaaaatgcaactcataaaaattactcaagatccaactctcagattattttgaatgggcaagattggtgaggcctgactgagccctactcatccttcagttctcaactgaaacatcacttccaaagaccttctagggccccccaaactgggtaacactccttctgtgtgtcccatagtggccagagcttacccaccacattgcacttatgactgctcatggtcatgatctgttattcttatggaaagaatgatggcttacctgacatctgctagtgtttcttccttgtcatggcaactgctcaatatgttgttattgaattcatgaatgcatttacccaaaaattgatcaaaaatgctttctttttattctttttccttctactaagcaatgatttataatgagcagtgaggacatccaccacagctgtggtttcctacacacagagggaaagcaatgagaaggctggggagctcacatttgttgagcacctcctctgttccattcctcttacacaagttaactcacttacaactcctgcaaaccctgagaggttctacctactttcgacttgacagaagtgagtctcagagaggttaagtaacttgcctaaggatacagaaccttaaagtggctgagacagaaggcaaattctgaagccttcaaagaaaattaaggaatgtatacaaagaaggcaaaagattccaccaagaaacttagacactagataaaaccaaaataaaattaataacaataaaacatactgcattctgtccaccaaaatgcaggaaatgagctggaaaaaaaaccccagtttattcttggccttctatttttaagaacttcaacagaatccctgactcgcaatctgaaagacaaagggaatttttttttgctttgttttgtttttgagagggaatctcactctgtcgcccaggctggagcgcagtggcgcaatctcggctcactgcaacctcctcctcctgggttcaagcgattctcctgcctcagcctctgagtagctgggattacaggtgcatgccaccatgcccagctaagttttgtatttttagtagagatggggtttcaccatgttggccaggctggtctggaactcctgacctcaagtgatctgtctgcctcagcctctcaaagtgttgcgattacaggcatgagccaccattcctggcttgtttttaaaatttgtttctaaaacttaatttaaatttgtaatattttgaaacttgaaacaacacactacaaatctcaagatttcatgtagctagaccaagctgatgtagaaagtagagaatgacaaagagctgttgtgttctgggacctggcaaatttggcagggtgggagatggagaggccagcttcatgctgggagagaaggcaagggcatcttcacaaggccaggctgaggacaccacttcaaagaaggtctagagtggcactttgcaaagtctgttccctggaatgggtccaccgttctctctctctctctctctctctctctctctctctctctctcactgaaacacacacacacacacacacacacacacacacacacagcttcatctgtttgtcgtttctgtttttctaaggggaggcattacagcatactgctcaagatcacttgcctgagctttaatcccttctccaacttattgtgtccgacaggctgcatgacctttagcaacttatatcacttctccaaccactggtttcctcatctgtaaaatttgggtaacagcagtgcctgctttacggggtgatgtgagagttaaatgtaatgatgactgcagggcatttagcatagtgctgggcatcctggaaatgctcaagcgtcagctactgtactaaaaacagtagtattgcataaataataatggcattataattcagtaggttttcaaaacttacttgatcaaaaatctttcattgattttaaaagtcacaaaaaaaaggttgaagattgcttttccagaatggaaaaattggatactcccaattttccttatcttggaacacttgaaccacaaagaaagcaggtgctaatctcagttctgctaagaggagaatgagctgaaacactgcccagcttttcccatgcataaggggccgtgtgcctgcctgtacaccctgccacccaccccagcaatgtcccacttaacctagcagagccacacactccccttaaatgtcaaagctgagccattgcccaaaaggcaggagaaaagaaagtaaaactggatagttatgaactggatatcacaataatccttggaaatatctaaaattatctttcaaagaaagtcctttttatcaataactccctaaaaactgagcccagtgacttgcttacacacatccttaagcagtctcaggaagttgtaactcaatgcggagatctcatgtgctatggctagaattattgattaacccatactcatttagctcttaagtaaattaaaagaccactagtcttaatgtctgtttatgtccggaatgtttcaatggaactgtggattacccaagaagtattaaatgatgcatgtgtgtgtgtgcgtgcacttgtgcacaacaggggacatgaaccccaaaacccccctcaacggcttcggtccatttacaggcagctggtcacatcctgacaggcagattctgaaataggagcatcatcaaagggcaaagagcactgacctccagtatttaaataggttccccaaagctctccacggcagtgtcataaagtggaagcttctagaccctgaacttcattttccttctcctgccctcagtcagggagataaagaatgaaactaagcaagcttaaggggtgattctgtccacagtcaggggcaaagtaaagataagcaggcaaacagcgagaaacaacagtgaggtgggagcaaggatgcttttaagggtctttatttgctttttgatggctaggagttcccagagtactgggcacacctgcagtcaaatgtaagcatcaagtactccagaatcaaacagatgatttggaaattgtttctaatagcctggataagtgagagtcgattaaacattgatgctaaattatgaagcgcctggcagtctttcacttttttaaagtgagtatctttgaacaacagccatatgggtgctgcaataatgaggtttataaataggcttaatattctaacaagctggctttgaaaaaccaaaacttgtgctctgtttctaagttgacagaaagatacctcccagttgggcacaagatttcctggtatgggaagttgaatatgcaacaactgcatacacacaatgcaaattccagttctgccttcagtgttctccagggtttctgggtaacaatgactcactcttctccaagtcctatcctgtctccattcttttctccagagaccactaccaccgccgacacacagaccgcttcggaaagcttggttctcagccctcagttctctcaagggataggacattgaaagacaggctcagataaaaacaaaatgcacagcaaggctcgtgtagttaactacaggttctcatgagtacagatcacatgtgtttcactcatgggaaagtggactgagataaaatgtcacaaataaccatgaaatgagtgaggatctgaacgatcatctgatcctctggttttgtttttcactggcatgcagggtacaggttggaaagaattggatatctctagaaacttctaatggatctcttacatcatttgtatgaattaatctacgcgctactgagaatggaaagtctttgtacatttcttctcattcctatcagtgatttcatttccatgatgcatgtattaaaaactaactttgcaaagctatccattgcttcctggcctttcccatattttgaacaagtaaatgctaatgagaaaaatatatacataaactggtggtctcttgacaccttccacaagaatatttaagggtgagaaaggagataatagagtaagagaatctcctgtcttactagctcgaatatttaactgatgagctacaaaatgaaattccatgtgcacaatgatttcattttcctgcctggccaaaagtccaaagcaagacaacaacaacaacaaaagattataaaatggaaaaaaaaaaaacctcatttttaccttgaacagcccaatcattaggaaagaaaaactaacaaaaacaaaaattctagggaatttattagctaggttttctagtagagaaaattgttctacagactcatactgtcattgaattatcttagaaaaggaagatcatattcagagatagccagctcccaaacatagaggactccagtatgtttagccaaaagtgatggatcaaattcacatgaaggaagcctttgacagtgtggtttgggggtggggatggtgaccctaaagaatgggagaatgcaaatctgaagcagagatgtaaataagacagtcaattttttactctttcttaggagcaagtgcatttctatctagtgctggccaggcagtggaaagtagagaaacctaggagaaggtaacaaactccaaactaaacaaccccacaggaagccccacctggggctacaccaactcacatggcagacccaggctgccccagtgctcctgtcctcccaaagcaagccccactcttcactgatctccctccgcatcccctcggctgcctgcagacagctggccagaaacagaaatcaaatctgctgctcatgcctgcttctctcatgagcctggattaaaaattccagcacttggactcctatttaagaagccctaaatgggacccctccccaaagaaagctgaactcttcctttggaaggcaagattttttttttagcaaaccaaacacaatttcctttccttctagctaaaagccttttgctcaaagctgggcaatgagctaatcagtggcaccaaggaaaaaacagggaaaggttttgagagaaagaaaatagaaagcaaatgtcatgcttgtggaagcccaagtagtacgttttttgcataactgatttagtcctctattcacgtatttacaaccacttgctgtgttataagtactgcaaaactgtgtgggtgggaatggaagcaatttttacgaccttcttcctgggagcccgtctcctgcttaaataaacatcagtaagaaaagctaaaagcaaaactatctcttaatatctgtgacggcactgccaaagtagatataaatccaaaggattaagacaaaatctcactcttcacagatctatccctgtaattaggggaggagtagggttttttctaattgaattattcacagagctgtttcaattctctactttgtttttccccttgtagatttagccagaacaaaaactgtaatcttctgctgaatttcacttcaatgtcagtctaatttttctaagtcttgcctacccactcctgcagtgttccttccctctccccactctgtgcccttcctcccaactcttatcaaaactgactcctggcagaaagcagctgctggtcatttacaattccaggtgaatttgaatcagtgccatggctccttgggagcatgagtccttcctatttcatccaaaatcctatcttgtagtagcatcatctatgtaagcctccctaaacacacgctctataaatctcaacaatttaaatatggcaaaatgagcccattgtccaaaatacagggaaaaaaagcgccaactagcagatgcatttcttgggaccattttgagctcttctgtcaactgaaatcagatgagcattggaagcaaattttcctgagctatagtagttaccttcactgaaactatgccaaatctcccagaaattggtgctttgaacgattctttcattttttttttaacaatgactaatttcagtcagtgattttatagtcagaatggcagttctgaaacaacatttatgaggcttgatttatgataattaatccttctatttcactaatgagctaggaaaggccttatttatgaaagtgtttaaattcctcacagttagcagacacggtttccagtgacacccacatggaatggtatactaaatgcaataaacttttgtgggtcatccttagacaaaagtcagagagacaaatgaaaacaagtggcaggatgtcagtcggaatttgaactactcctaaaacatctggaaggagctttcaaagattaatctttcacttccatatttactagatgtatctctagagtgtaggaaaagtcttggttatttaagcattttctttggttggaatctggataaacaacagtttaatggtctttggatatccaattgtgactttcagacaaaatgctccatgcactctcatactgattgtctaaattattgctcttctggtggccttaagggaaaggaaagctgtattttggcagaatattgaataccgggtccttgcaatgggtccttggatttgggtagaaatagaaggaaggccttaaagagcagagaaagggcatgaatgggcagaggtggtacagtgagtgagcgctgtggccagaactgtggactgctccaggagacaaggcccagccatatccatggaggcacctctggagcaggcacaggaggccaagccccctcaatggagcctaaactgcagaaaggcctcttgccagagccagagagcctccacgcagccaagcttcacttggcccttctgcagtgggctaggctccaggcttcaggtctcagccccatggcatgtgccctctacctcccagaaggtccgtgatgagggctcatcccatttggctccctgggtcatggcctctttctgcccttggaatactgggaatgaccatactggtttctgtctctgttccaaacctatgttttgatgggcatgataccaagtagtcaatataagtttcaagtaaagttatgattattagctggcctaagtaaatgccaatattttgaacaagtaaatgccaatgagaaaatatacataaatttttggtcttctgaaaccttccttcagactatttaggggtcacactaaactgtattctctacttacaaaatttatagatatattaatttggcatcattcagatatacacagaattttcctgcttactttgctgggctgtagattatatctccagacctgtttaatctccagactcacttatccaactgctcttgccttccccatatctcccctcatagtcagtatgtcccacactgaactcatcccatactgaactctctatcccccattcattctgttcccactcacgacaagacctgcaaacatgttcctcccttagtgatcctaatctaagaaaaaagaacctggggattcaagccaaaaccctgcgagttgaccttaattccactttcttcctcatcccccatatccaagtcctgttggatctacctcctaaaaagttctcacatccatgcctactgataatggcttccccttgctgaggccccctggtggatgaagtcggacctggctcctctccagctgtgtctggagccttcgcctccttccagtctgcgctgcagccacttggccttctttcattttctcagaggggccatgctccttcttgtctttagatctttacaggtataaacatcccaggccttaaatgcctagaatacgcttccctaactctacttaactacaatttacataatcttcatgtctcagcatgcgtctcttttcctcagagaagccttctctgaatcccggaccaggtttgggtcctctcttctatgttttcacagctccctgtgctggacttcttgcagcactcgtcacagcaggtagtaatttatggaagtattgtttaatatattcctctactgtaggctgaacatcccccgagggagggagcctttgtcttgtttcccactaattccctggtgcttagcacagcaccaggcacatagtaagtgccacagaaatatttggtaagtgaatgaatgactgaattttctgcatacagatgtgtattccttcaactatatgaacaaaactcattacctaaaatgatcaatttttatatcttctggatggaatgattctctttagttttttcataatctcacaagctaggaacatctagctttgtcttacggtcattaagactcatttattttgtttaataacagctgtcaagaggactctgtataaacagtacaataaaagcctgaagaataccaacactttacacgaattcagtatacttcctccagaaatagagtgttgcatttgttgtagaattcatttttattgctagtgggaaactccgatgatggtcattctcaaagctgtcccagtctattgtaatgtgccttatatttgttaagttggtgcaaaagtaatgcggtttttgccgctaaaactaacagcaaaaactgcaattacttttgcattaacctaataacaattatttcttttagttgtttctcaaaaatccaggagataggtcctataaacacttttcttccatgtggggaaatggaaaccaaggaaagtagtcttccatgagccaaagaaaattaaagattgaaaactagagatggtaatgcagaaacctctctgctgagggctgcttcccaactgacagaggaatgctgtaaagctcagtcaagatattaagcactttgctgctaaatattgagttgtaattaactaatacactagcataaccaaattacaataatcaagtgatgatgtactagtaagctgcatgagtattcaagtaaagaaaatttcactgtaaatgtgagaatctacttcttttgatattcacatttttcccctttaatatacattaagaatgtatttcagagagatttaacttgatctttattaagaaaagaaagactcgaaaacaatccttcaaacacaaatgtctcccttctctgaatcctagcatgtagcgtccacatcacttagtcagcaattaattattgccctcttttttgttgttgatttttaaccttttcacatgtataagacgtatcttgtttccctcaatatattctaagtttcctgatggtaaggattttcttctgatattttcgtatcccttctgaagctcctagcacctagtacataatggaaacccaataaaaatatgctgaacgatctggcaattccaattgaatgggagagtaaaaggaccagttaatacattaaatatgtaatctgggggaaacaaacaacaattttttaaagtattctcctggaattgcttttctggtaagattcaggtcaatgccctcttccctgggtcatctccttgcaaggatttaataataagaaccaagattctcagacccaccactccaggccaaaggtctctccatggctccatattgccatcaccaatagctacttgaacattccagaggctaccaatttaacatatctatacccaagtttatcattctgctttatcctagcctgctcttatctccatagtccctaacgaggcaaataacaccaaattcactgagacatctaagctgaaagaactcagaagacaacagctcctctttctctactctaaatctatgttctgtcaattctcatttcaaacatgccccctgttctttcatcttcagcagcgctaccccaaatcaggcatcttccccaactggtctccaggcctcgagtcgcatctccaatctgtcctccaccctttttccagaattacaatcctaaaattcaaatctaattttgttactctccagcttaacatcttttaacaatttcttataactgaaaggataaaacacaaacttctaaaaatattatgtatcataaaatatatatatatttctctagaagatatgaaagaacacctagaacacagcacttttttgttgtatagtaaaatgtgttcaattactcacctcctcaaactatgagcatacataattttgagtaaaacaaaaagtaaaatttttaaatgtcatgtatcactacccagcctctgccttcctttccagcatcacctctcatgactacacttctatctgtccctcagtactgcactagatgagctgcaagaggacaccacacattaagcttttaaggaaagtaaggctcttgggaattgattagtaggagaaggtaatcctgttacccagaccaattcaggggccaactacttctgacggaacggcggtgggggggggggggaggagccgggggccagtgagggggaggtggtgagatttatctccaatagctccatgttgcatgacagcaaacagacccaaccatactctctccttagggaattctcaatgagtggtgaacatagagaaggttcactagaacacaagccatatctcagttaagtgcaagcagctttgccagtagtccctaagaacatctcagaaatctcaactagtttattttgggctgcccggaagactccttgtttttctctcatctttgtaaaaggtttctttgcatttttgcaaaaggctgacatcaatgaaaagagtctaagcaagtttcttccttatgactctaatgagtctcctagaatgaatacacaattcactgtagtctgtaacaccttctctggccctcccaggtagacgtagcttccttcgcatccccctggaactatattcatcacctccaggtactcatatcagtctctgccactagccttcaaattgctgaaagttaagtaagtatcttacctacttttgcaaacccagggcttagcaaactgactggcacctaatagacactcagtaaatgttaattgagtaatcccatgttgcctgaacactaattatatcatttaaaagttcggttatatagaaagaaaacacagagagggcttaaataagaaatttaaaaccaaaggtccaggctttgttgcctatggcttttctcctcatctttgctgtgtaggttggaagagtcacttaacttctctgtacatcaatagggtattagttaagactgtttcagagaaaccaaattcaaaacatcctaagcaaaaacagagtctaactagctcatgtagctgggacagctgacagaactggagacacatctacaggaactgggacctccaggagctgacccagggattcccactccgtgttttctgcttccttttgagcactagcctcactgcctcctatcataaaaggtcttctctatgaggtgggaaatggatccaatggcagccccatgaaagtccagaagaaaagcaaagcctccctttcccacagccaatacagaaatgtcaatgagggactctaatgcttctgtttgggatccataccctacttgaaaccaacttttattacctggaaggtgaattctgtgattggccagtcctgtagtatgctggggtgaggagtagagtctgttagcatagtaaggtggatgggaagcttgctgcatagacaaaaacaatagttgttgcagtctattaacttaatagccattctcttgcctttatattaataatgttactttaggtaatgcaaaaaagcatcatcatcttcatggagtgttatataagcataaaatttattataccaactacctcatagttgggcaaaataaatatatgagattagataattataattgtgataataaatgccaaggaataagtaaaacctgctctcttgctctcagtttttaaaaaatgcagcatagaaacacgtttctgacatcatctagcaggctggcaatagaaaaactttttggtcgggacccaaggtacagtcataacccaattgctcaaacccaaggagccctatgaggcttcatcaggggtatatagaacacccacagccctgtttccctgactgaaagattctgtaacaaaaaagtaattcagagggacacaaaaaagtaattcagagggactcaaaaactctatccagtcctccagagaaaagagatatgacaacagctcattgggaggaactgaggtttatggaaaaggaaaaatgaggctcctctccaaagagtaagaggacagcatccctctgagagttccaattaagaaagctcaggtgtgcagtatttgttttcttctcacttagagaaatgggagcatgtgcgtaagcagcatcagggccacagagcaaggctgaggaccagcaccctccctggaaatcacagctagcctctgagcgttagtgtgcagaacctcgctcaaggggcatgggcgccatcatcataacagacacctgggcttgcaggtgtctataatcccagctaagatagagtgtttaaaactcacatctccaatatttgatgcactgttagtatgctgatgatgctacaatgctaagagttattcctaattctttcttagagaaatatgtaaaacagctctatgtttcaaatatgtattactgtataccgggtggaagcgtaggcactggggataaaaagcaaaccaaaagcaagtgaccaaagcaaaccaaaaaccctgtcttcatggggcttatattctagctggaggagacagacaataaacctaaaaataaataaactatacagcattcggatggtgggaagtgctagagaaaaataaagcatggcagggtatgggtacgggttggaatgtataggggacacctccctgcaatatacttggctgttgattatttgcaggtgataaccacagaaatcctcttgctctggtaaagactacctctcaccagtgtgaaagaggggctataaagaagggaaagagaaagcccacatgatcaccacagtgggattcagccctgggccacaactctgccacacatcttgcccatttcccacctcagtttagatttctgtgccccaacctgggcaatgatgttaataaaacctgcatcctagctagctcatggctcattgtgttgacaggtctcacggccataagctgtcctaaatatatatttatcttcattttgaatatttaaaagctcacatttgggtttttatgcttcaccacctattgattgagcatctactatgtgctaaatgctgttctaggtattgcagtgagtaagtatgtgtcctcatggaacttacattctaatggaggagatgaaaaattcaacaataaattaaatacgggcgataccaacaagaaggagatgcgataacattgaataatccaggcgtgagttgatgatcacatcctgaagtgagatgtctctcagacaagctgaactgaattcctgaccatctgtggtcacctacagagccctttctataaaggtgtcatggtaatatattggtatgaaaatccaattatggtttgaggctttctaaaatgttgaaagagcagcttcctttctcttactgacaatctgttgtgtggacaaatatgcacacacccttccttcccctaagggtttctattttgtggacggcaaagtgttattccaagttgtggactgcaaaaatgttattccaagttgtataaaagagtgtgtgctttggtttccagagtctttagctatttattctagcactgctgttatgtttaaaaagaagaagaagaagaagtggtaaggatcacatactggtaaaaatatgtataataataacaaataatagcatctccttttcaaattagaaagtgaagctataatcaccccacacttttcatgttcaaaagcactaggttctgagtagatacaagagactagaaaatgaaaatgtagttacattacactgcaacaccttggagagagaagcctagcagatatgaaactgagaaagctacacgacgcagtgttgtaagtgctaatgcttttccacacaagttcccgcctcagcattgctgatttgaccaaacacttgtctctagcccaaatgtctccatggagtcggtttaaattgaaaagcagtccaagagaagaagttcctgggtgtatggatatgaatccctctagtcagcatggcaaggaatccagctcgacaacgctttcacattatacactttgggcccagactttgtggacacaacaaactttctgtgtgcagcacaatacaatcggacgtaatgttcactaaatataacatgagattactgtaaacaccactccgagagctgctgcgttgcaggcatctaaactgtcaggaaagcctgccagccagagacaaggtttccaaataaatttacagtctccactagcggtggctagacaagtcaaaaatcaaattatttggcatggtttcccattgaaatcaatggcaatgaagctcacttggactatatatggaatggcttttataaattgcacctgtcaataaggaccccttaaagaaacacatactaccttaatgcttctccttagaaactttgaatatcaagctaacttagatcaacacattttttatttgtcttttgtttgtgtgtgtgctttcaaaaacaataacagcagcaaaacaaacaaactggcaggaagctggttttcccatcagtgcccttgttagaaacagaatgtctagagaatatgcttggagaaaagccatatttttaaaccacactagatatctgatgccaaatgactgatgaaagtagtatctagtagtaatggaaggtgtctttgggacctgcccagtgactgaggagcaagctgtgaatatacagctatccctcaagctcctgactggagtgaccagcagttcactgatgatgaaatatttttacagaaaataccatgtattttcaggtcacctctcctcagtacccaaaaacagacagaacccaatgaagtgaatgaaattcagagatctccatccatcagggcaactagaattctggccactctatttcattgttcaaatattgcaagaaaaccccaatatcgtttctgccccccctttctccacaagagcctttccttctagtaaacatttctccaccaaaaagaaccccaggaaatatcagaagttcgactgggctaaggagagggaaaaaagaaatgtagcagccagaatgcatgttgaattttaactgttggtaagttcttggaccacctgcccaagtgtatgcaagcagtttgcagagaaaaattcttccttcaattaaaagtccctgtctgggtctcaaacttttctccctgggcaaaaaggatcagaaacacctcattgagtattgggccaccataactgactcatcaaaggacatctctccttccccccaaaaaagcatgacttggaacagcaaggcattctaagacagaaagacaaccctctctgtgttggaagaaaagtagcagtgactgtaattaacagagcagcagttgtggaacttctagggttgtatttaaaggcccatgcaggaacagggtgagcagtcgtgactgcggctgtgtggtaaaataaggatgggagcgggaaatggggcaggagaagtaaataggtatacttacagcccgcggagccgaagccagattttctcgatctgttccggttgcaggtatttcagagagttgctctcaaattcttcaatctccttggttggcgactccatagctgcaggtaggtgaccactggcggtgaagctgagatagtttgggctgtcccctccccgtctcctcgcccagctcgcgatgcccagccaggcgcggcgcgcgtttgcccggcactttctcggcgcgctcccccttctgcgcccccagactccgacttagagcggactccgatcgcggcaaaccatggccccaggtgcgctccggaggcagctgcgggaaccagccatggtcccgggctaatgcccagggataagcacagggatagggatagagatagggattgggattggactccagctccaagagaaagcacctcgggtctattcgtattctccccctacccccaaacaaagccacagaagcgatcagcgcgcagctaaagggtttggaggtgaaaaggagggctgggtggggaggagagaaagtgagaagggagagaaaagcggcggctgagcaaagc
